United States Patent 11,098,302 (IDENTIFICATION OF POLYNUCLEOTIDES ASSOCIATED WITH A SAMPLE) - sequence listing, part 85

SEQ ID NO: 293715 - DNA, 730 bp, Homo sapiens
  misc_feature: GYAE6OF02FQ2DO.16.10.A10.1.454.CMB.1.raw
  modified_base (707)..(707): a, c, t, g, unknown or other
  misc_feature (707)..(707): n is a, c, g, or t
tcagtgtactactccacgaccggtgctcgatttagcgtcgatctcaggggggtgggtccaggaggcagaactctgggtgtctcaccatggcctggatcccctctacttctccccctcctcactctctgcacaggctctgaggcctcctttgagttgacacagcccaccctcggtgtcagtcgtcccaggacagacggcaggatcactgctcttcagatgactattcgacaaggacaagtatcgtcctttcgttcggtaccagacaacgaacgaccgaacggacccgaccggtccccgttggttagggtaggtagtaacgtaataaagtaaaacgaaccaacgaacgaacggaccggacccgtaacggtacgggtaccgtacccggtacgggaccgttacgttccgtcgtcggtacctaccgtacggtccgtaccggaacgggaaccgtaacggtacgtaccgtaacgttaccgtacccgtaggtacgggtacggtaccgtaccgaacggtaaccgtaaacggaacgggaacgggtaacggtaacgtaacgtaacgttaccgtaggttactacggttacgacgtaaccaaaccgtaccgtacgtacgtacggacggtcgggttaccggtacgggacgggacggacgaacgtccgacgtaccgtcgcgtccgcgaccgaccgaacgtcccgtccgtcccgtacgtaccnccgtccgttcccgtccccgtccg

SEQ ID NO: 293716 - DNA, 363 bp, Homo sapiens
  misc_feature: GYAE6OF01B6D0D.47.34.D01.1.454.CMB.1.raw
  modified_base (361)..(363): a, c, t, g, unknown or other
  misc_feature (361)..(363): n is a, c, g, or t
tcagagctcacgtacacgaccggtgctcgatttagatcgtctgtgttgggtttgggtgcccaagctgctggagggcacggtcaccacagcctacatggagttgaggaccctgagatctgacgacacggccatttattattgtacgagagggtattactttgatagaagtggatattaccgactagcggactactggggccagggaaccctggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcatagnnn

SEQ ID NO: 293717 - DNA, 366 bp, Homo sapiens
  misc_feature: GYAE6OF01BSR9Z.47.34.D01.1.454.CMB.1.raw
  modified_base (361)..(366): a, c, t, g, unknown or other
  misc_feature (361)..(366): n is a, c, g, or t
tcagagctcacgtacacgaccggtgctcgatttagatcgtctgtgttgggtttgggtgcccaagctgctggagggcacggtcaccacagcctacatggagttgaggaccctgagatctgacgacacggccatttattattgtacgagagggtattactttgatagaagtggatattaccgactagcggactactggggccagggaaccctggtcaccgtctcctcagcctccaccaagggcccatcggtcttcccctggcaccctcctccaagagcacctctgggggcacagcggccctgggctgcctggtcaaggactacttcctacgtgagctctgagcgggctggcaaggcgcatagnnnnnn

SEQ ID NO: 293718 - DNA, 368 bp, Homo sapiens
  misc_feature: GYAE6OF02FPO85.47.34.D01.1.454.CMB.1.raw
  modified_base (357)..(357): a, c, t, g, unknown or other
  misc_feature (357)..(357): n is a, c, g, or t
  modified_base (363)..(368): a, c, t, g, unknown or other
  misc_feature (363)..(368): n is a, c, g, or t
tcagagctcacgtacacgaccggtgctcgatttagatcgtctgtgttgggtttgggtgcccaagctgctggagggcacggtcaccacagcctacatggagttgaggaccctgagatctgacgacacggccatttattattgtacgagagggtattactttgatagaagtggatattaccgactagcggactactggggccagggaaccctggtcaccgtctcctcagcctcaccaagggcccatcggtcttccccctggccacccctcctccaagagcacctctgggggcacagcggccctgggctgcctggtcaaggactacttcctacgtgagctctgagcgggctggcaaggcncatagnnnnnn

SEQ ID NO: 293719 - DNA, 267 bp, Homo sapiens
  misc_feature: GYAE6OF01B3G4L.1.19.B08.1.454.CMB.1.raw
  modified_base (184)..(194): a, c, t, g, unknown or other
  misc_feature (184)..(194): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (200)..(267): a, c, t, g, unknown or other
  misc_feature (200)..(267): n is a, c, g, or t
tcagacgagtgcgtcacgaccggtgctcgattttagtgagtcagtattcggtcggggggaccgttcggccaacgggaccgaaggttcggaaatccaacgtaactgtggctgcaccatctgtcttcatcttcccgccatctgaacgcactcgtctggagcgggctggctaaggcgtcattagtannnnnnnnnnngngngnnnnnnnnnnnnnnnnnnnnnnnnnnnnnnnnnnnnnnnnnnnnnnnnnnnnnnnnnnnnnnnnnnnn

SEQ ID NO: 293720 - DNA, 258 bp, Homo sapiens
  misc_feature: GYAE6OF01EHCTD.1.19.B08.1.454.CMB.1.raw
  modified_base (257)..(258): a, c, t, g, unknown or other
  misc_feature (257)..(258): n is a, c, g, or t
tcagacgagtgcgtcacgaccggtgctcgatttagtgagtcagtatcgcgggaagatgaagacagatttcactctcaccatcagcagtctgcaacctgaagattttgcaacttactactgtcaacagagttacaatactccggccacttttggccaggggaccaagctggagatcaaacgaactgtggctgcaccatctgtcttcatcttcccgccatctgaacgcactcgtctgagcggctggcaaggcgcatagnn

SEQ ID NO: 293721 - DNA, 166 bp, Homo sapiens
  misc_feature: GYAE6OF02GYQR1.1.19.B08.1.454.CMB.1.raw
  modified_base (166)..(166): a, c, t, g, unknown or other
  misc_feature (166)..(166): n is a, c, g, or t
tcagacgagtgcgtcacgaccggtgctcgatttagtgagtcagtatcgcggggacgttcggccaagggaccaaggtggaaatccaacgaactgtggctgcaccatctgtcttcatcttcccgccatctgaacgcactcgtctgagcgggctggcaaggcgcatagn

SEQ ID NO: 293722 - DNA, 321 bp, Homo sapiens
  misc_feature: GYAE6OF02F29GU.1.19.B08.1.454.CMB.1.raw
  modified_base (203)..(203): a, c, t, g, unknown or other
  misc_feature (203)..(203): n is a, c, g, or t
  modified_base (300)..(321): a, c, t, g, unknown or other
  misc_feature (300)..(321): n is a, c, g, or t
tcagacgagtgcgtcacgaccggtgctcgatttagtgagtcagtatcgcgggaagatgaagacagatttcactctcaccatcagcagtctgcagcctgaagattttgcaagttactattgtcaacaggccaacagttttccctcgaacgttcggccaaagggaccaaggtggaaaccaaacgaactgtggctgcaccatcctnttctacacttcccgtcccgactacttcgtaacgaccgacctaccgttccgtcgtaggacgggccggtcggtcggaacggaacgggccactaagtagnnnnnnnnnnnnnnnnnnnnnn

SEQ ID NO: 293723 - DNA, 508 bp, Homo sapiens
  misc_feature: GYAE6OF01CFD8U.48.1.A01.1.454.CMB.1.raw
  modified_base (496)..(496): a, c, t, g, unknown or other
  misc_feature (496)..(496): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtccttattagcctggtatcagcagaaaccagggaaagccccgaagctctaattttcgctgtctccagtttgcagagtggacgtcccatctcggttcagcggcagtggatcgtgggcagagttcattctcacatcaacagccttcagcctgaagtatttgctaacttactattgtcagcagggtgactacgtttccctccctacgtttcggcggtagggaccgagggtggacgtacgaaacgactggtggctgcaccatctgtcttnactcttcccgcc

SEQ ID NO: 293724 - DNA, 500 bp, Homo sapiens
  misc_feature: GYAE6OF01D3ZMM.48.1.A01.1.454.CMB.1.raw
  modified_base (474)..(474): a, c, t, g, unknown or other
  misc_feature (474)..(474): n is a, c, g, or t
  modified_base (490)..(490): a, c, t, g, unknown or other
  misc_feature (490)..(490): n is a, c, g, or t
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgctaacttactattgtcagcagggtgacagtttccctccctactttcggcggtagggaccagggtgacgtcaaacgaactggtgntgcaccatctgtcttnactctcccgc

SEQ ID NO: 293725 - DNA, 516 bp, Homo sapiens
  misc_feature: GYAE6OF01B23SF.48.1.A01.1.454.CMB.1.raw
  modified_base (369)..(369): a, c, t, g, unknown or other
  misc_feature (369)..(369): n is a, c, g, or t
  modified_base (501)..(501): a, c, t, g, unknown or other
  misc_feature (501)..(501): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatctggggcagagttcattctcaccatcaacngccttcagcctgaagtattttgctaacttactattgtcagcagggtgactacgtttccctccctacgtttcgggcggtacgggaccgagggtcggacgtacgaaacgactggtggctgcaccatctgtcttnacttcgttcccgtcc

SEQ ID NO: 293726 - DNA, 501 bp, Homo sapiens
  misc_feature: GYAE6OF01CDQ4S.48.1.A01.1.454.CMB.1.raw
  modified_base (484)..(484): a, c, t, g, unknown or other
  misc_feature (484)..(484): n is a, c, g, or t
  modified_base (493)..(494): a, c, t, g, unknown or other
  misc_feature (493)..(494): n is a, c, g, or t
tcagagtatacatacacgaccggtgctcgatttagacgtctcatcaggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcgcagtggatcgtgggcagagttcattctcaccatcaacagtccttcagcctagaagtattttgctaacttactattgtcagcagggtgactacgtttccctccctacgtttcggcggacgggaccagggtcgacgtcaaacgactgtggctgcacntctgtcttnntctccgc

SEQ ID NO: 293727 - DNA, 567 bp, Homo sapiens
  misc_feature: GYAE6OF01BF9WS.48.1.A01.1.454.CMB.1.raw
  modified_base (414)..(414): a, c, t, g, unknown or other
  misc_feature (414)..(414): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccaggaaagccccgaagctcctaatttcgctgtctccagtttgcagagtggagtcccatctcggtcagcggcagtgatctggggcagagttcattctcaccatcaacagccttcagcctgaagtatttgactaacttactattgtcagctagggtnactacgtttccctccctacgtttcggcggtagggacccgaggggtcgaacggttaccaaaacggtaaccgttggtacgggtacttacgggcctaacccctaagttcccgttacggttaccctttacctaactttcccgtttcccccggtaccc

SEQ ID NO: 293728 - DNA, 671 bp, Homo sapiens
  misc_feature: GYAE6OF01C1QVJ.48.1.A01.1.454.CMB.1.raw
  modified_base (256)..(256): a, c, t, g, unknown or other
  misc_feature (256)..(256): n is a, c, g, or t
  modified_base (262)..(262): a, c, t, g, unknown or other
  misc_feature (262)..(262): n is a, c, g, or t
  modified_base (270)..(270): a, c, t, g, unknown or other
  misc_feature (270)..(270): n is a, c, g, or t
tcagagtatacatacacgaccggtgctcgatttagacgtctcatcaggggagtcagacccagtcaggactcagcatggacatgagggtcccgctcagctcctgggctcctgctgctctggttcccaggttccagatgcgacatccagatgacccagtctccatcttccgtgtctgcttctgtcggagacagagtcactatcacttgcgggcagccaggatgttacgtcccttatagcctggtatcagcagaaaccnggaaanccccgaanctcctaatttcgctgtctccagtttcgacagacgtggactcccatcgtcggttcagcggcagtcgatcgtgggcagtacgttcattctacaccgtatccaacgtacgtcctttcgacggtcccttaggtaaacgttcgttttacgaccttaaccgtttacgttacgtttcgtaccgtaacggtcctaacggggttacctaaccgttaccggttttaccccgtacccgttaacggttttcccggggaaccggttaaccggggtaaccctacgggggttaccggtaaccggttacggtaaaacccggtacgttcgggtaccgggtacgttacggaccgtaacccggtaacgtttcccgttaacgttacccgttaaccgtaccgttcccgttacccggtaaccg

SEQ ID NO: 293729 - DNA, 513 bp, Homo sapiens
  misc_feature: GYAE6OF01BE20K.48.1.A01.1.454.CMB.1.raw
  modified_base (501)..(501): a, c, t, g, unknown or other
  misc_feature (501)..(501): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcggcgagccaggatgttagtcccttattagcctggtatcagcagaaaccagggaaagccccgaagctcctaatttcgctgtctccagtttgcagagtggagtcccattctcggttcagcggcagtggatcgtggggcagagttcattctcaccatccaacagccttcagcctagaagtattttgactaactttactattgtcagcgagggtgactacgtttcccctcccgtacgtttcgggcggacgggaccagggtgacgtcaaacgatgtgctgcaccatctctcttcncttcctcccgcc

SEQ ID NO: 293730 - DNA, 515 bp, Homo sapiens
  misc_feature: GYAE6OF01C6V12.48.1.A01.1.454.CMB.1.raw
  modified_base (415)..(415): a, c, t, g, unknown or other
  misc_feature (415)..(415): n is a, c, g, or t
  modified_base (483)..(483): a, c, t, g, unknown or other
  misc_feature (483)..(483): n is a, c, g, or t
  modified_base (501)..(501): a, c, t, g, unknown or other
  misc_feature (501)..(501): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttatagcctggtatcagcagaaaccagggaaagccccgaagctcctaattttcgctgtctccagtttgcagagtgagtccatctcggttcagcggcagtggatcgtgggcagattcattctcaccatcaacagccttcacgcctgaagtatttgactaacttactattgtcagtcagggtnactacgtttccctcccgtacgtttcggcggagggtaccgagggtcgacgtacgaaacgtactgtcggntgcaccatcttcgtcttntactccgttccgcc

SEQ ID NO: 293731 - DNA, 515 bp, Homo sapiens
  misc_feature: GYAE6OF01ADLJO.48.1.A01.1.454.CMB.1.raw
  modified_base (505)..(505): a, c, t, g, unknown or other
  misc_feature (505)..(505): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcaggagttcatttctcaccatcaacagccttcagcctgaagtattttgactaactttactattgtcagcagggtgactacgtttcccctccctacgtttcggcggacgggaccgagggtcggacgtacaaacgacgtgtggctgcaccatctgtcttcncttctcccgc

SEQ ID NO: 293732 - DNA, 514 bp, Homo sapiens
  misc_feature: GYAE6OF01B8U64.48.1.A01.1.454.CMB.1.raw
  modified_base (504)..(504): a, c, t, g, unknown or other
  misc_feature (504)..(504): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtggggcagagttcattctcaccatcaacagccttcagcctgaaagtattttgctaacttactattgtcagcagggtgactacgtttccctccctacgtttccggcggtagggaccgagggtcggacgtacgaaacgacgtgtggctgcaccatctgtcttcnctcttcccgc

SEQ ID NO: 293733 - DNA, 648 bp, Homo sapiens
  misc_feature: GYAE6OF01BRUKK.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccattcttccgtgtctgcttctgtcggagacagagtcactatcacttggtcgggcgagccaggatgttagtccttatagcctggtatcagcaagaaaccagggaaacgccccgaagcctacttaattttcgcttgtctccagtttgcagagtggacgtccctatcgtcggttcagcggcaggtggatcgtggggcagtagttcagtttcacaccatacaacacgtccttacacgtccttagaaagttacttttcgaacttaacctttacttagtttacgtacaggtcgtaaggggttactaaccgttaccggttttacccccttccccgtaaccgttttcccggggaccgggtaacggggtaccccggaggggttacggtaaccggtaaccgtaaaaccggtaacgttcgggtacggccggttacggccctaaccgtacgttccgttacggttaccttaccgtacctttcccgttcccccggtacc

SEQ ID NO: 293734 - DNA, 599 bp, Homo sapiens
  misc_feature: GYAE6OF01BKPJG.48.1.A01.1.454.CMB.1.raw
tcagagtatacatacacgaccggtgctcgatttagacgtctcatcgagggggagggtcagacccagtcaggactcagcatggacactgagggtccccgctcagctcctggggctcctgctgctctggttcccaggttccagatgcgacatccagatgacccagtctccatcttccgtgtctgcttctcgtcggagacagagtcactatctacttgtcgggcgagccaggatgttacgtcccttattacgccttggtatcagcagaaaccagggaacgccccgaagcctcctaatttccgctgtcctccagtttgcaggagtgacgtacccatcctcggttcaggcggcaggtggactcgtggggctaggcgtttcagttcctcgaaccatccaactcgtcccttacgacgtccctaggaacgtacgttttagacctaactttagtattcgtactagtcgtagggtactacgttacgtttcccctaccgtacgtttcgggacggtacgggtaccgtaggggtcggtacgtacgtaaacggtacgttggcggtctcggccaccgtcttcgtcgttaccttactcgtcccgttcccggtacc

SEQ ID NO: 293735 - DNA, 526 bp, Homo sapiens
  misc_feature: GYAE6OF01EB2NA.48.1.A01.1.454.CMB.1.raw
  modified_base (360)..(360): a, c, t, g, unknown or other
  misc_feature (360)..(360): n is a, c, g, or t
  modified_base (421)..(421): a, c, t, g, unknown or other
  misc_feature (421)..(421): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtggggcagagttcattcncaccatcaacagcccttcagcctgaagtattttgactaactttactattgtcagcagggtnacgtcgtttccctcccgtaccgtttcgggcggacgggaccgtaggggtcggacgtacgaaacggacgtgtcggctgcaccatctcgtcttctacttcctcccgtc

SEQ ID NO: 293736 - DNA, 506 bp, Homo sapiens
  misc_feature: GYAE6OF01A4CR2.48.1.A01.1.454.CMB.1.raw
  modified_base (478)..(478): a, c, t, g, unknown or other
  misc_feature (478)..(478): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctgggcagagttcattctcaccatcaacagccttcagcctgaagtattttgctaacttactattgtcagcagggtgactacgtttccctcccgtactttcggcggtaggaccgagggtcgacgtcaaacgactgtggntggcacatctgtcttcattcctccgtcc

SEQ ID NO: 293737 - DNA, 576 bp, Homo sapiens
  misc_feature: GYAE6OF01DOA8W.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgtttagtcccttattagcctggtatcagcagaaaccagggaaacgcccgaagctccttaattttcgctgtctcctagtttgcagagtggacgtccatctcggtcagcggcaggtggatcgtggggcaggtacgttcacttctacaccatacaacacgtcccttcagtcctagtaaagtcttttgacctaactttactaattcgtacaggcgtagggtcaccttaccgtttcccctcccgtacgtttacgggcgggacgggaccgaggggtcgaacgtacgaaacgtaacgtggtcggtctacggcctaaccctagttccgttcgttcttaccgtacttcccgtccccgtac

SEQ ID NO: 293738 - DNA, 506 bp, Homo sapiens
  misc_feature: GYAE6OF01E4B6B.48.1.A01.1.454.CMB.1.raw
  modified_base (358)..(358): a, c, t, g, unknown or other
  misc_feature (358)..(358): n is a, c, g, or t
  modified_base (386)..(386): a, c, t, g, unknown or other
  misc_feature (386)..(386): n is a, c, g, or t
  modified_base (417)..(417): a, c, t, g, unknown or other
  misc_feature (417)..(417): n is a, c, g, or t
  modified_base (478)..(478): a, c, t, g, unknown or other
  misc_feature (478)..(478): n is a, c, g, or t
  modified_base (493)..(493): a, c, t, g, unknown or other
  misc_feature (493)..(493): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctgggcagagttcattcncaccatcaacagccttcagcctgaagtnttttgactaacttactattgtcagcagggtnactacgtttccctcctacgtttcggcggagggaccagggtcgacgtcaaacgactggtcgntgcacatctgtcttnacttctcccgtac

SEQ ID NO: 293739 - DNA, 542 bp, Homo sapiens
  misc_feature: GYAE6OF01A7YIO.48.1.A01.1.454.CMB.1.raw
  modified_base (529)..(529): a, c, t, g, unknown or other
  misc_feature (529)..(529): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtgggcagagttcattctcaccatcaacagcccttcacgtcctagaagtattttagacctaacgtttactattgtacagtctagggtgactagtttcccctcccgtaccgtttcgggaccggtacgggaccgaggggtcggaccgtacaaacggaacctggtcggctggccacctatctcgttcttacncttccttcccgcc

SEQ ID NO: 293740 - DNA, 511 bp, Homo sapiens
  misc_feature: GYAE6OF01B628D.48.1.A01.1.454.CMB.1.raw
  modified_base (268)..(268): a, c, t, g, unknown or other
  misc_feature (268)..(268): n is a, c, g, or t
  modified_base (506)..(506): a, c, t, g, unknown or other
  misc_feature (506)..(506): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaanccccgaagctcctaattttcgctgtctccagtttgcagagtggagtcccatctcgttcagcggcagtggatcgtgggcagtagttcattctcaccatcaacagtccttcagcctagaagatgttgactaactttattactgtacaacagtacttagtacgtaaccctcgtacctacttttcggcctagggacaagggtgagatacaaacgactgtggctgacacatctagtcttcgtntcccg

SEQ ID NO: 293741 - DNA, 559 bp, Homo sapiens
  misc_feature: GYAE6OF01C1DT7.48.1.A01.1.454.CMB.1.raw
  modified_base (304)..(304): a, c, t, g, unknown or other
  misc_feature (304)..(304): n is a, c, g, or t
  modified_base (339)..(339): a, c, t, g, unknown or other
  misc_feature (339)..(339): n is a, c, g, or t
tcagagtatacatacacgaccggtgctcgatttagacgtctcatcagggggagtcagacccagtcaggactcagcatggacatgagggtccccgctcagctcctggggctcctgctgctctggttccccaggttccagatgcgacatccagatgacccagtctccatcttccgtgtctgcttctgtcggagacagagtcactatcacttgtcgggcgagccaggatgttagtcccttatagcctggtatcagcagaaaccaggaaacgcccgaagctctaatttcgctgtctccagtttgcagngtggagtcccatctcggtcagcggcagtggatcgngggcagtagtcattctcacctatcaacacgtccttacacgcctagtaacgtattttacgactaacttactattagtctaggcgtagggtgactacgtttaccctcccgtacgtttccggcggtacgggaccgtacgggtacggaacgtaccgaaacgtacgtacggtacggtctacggccacctactcgttacgtacttaccacttcccgttcccgtacc

SEQ ID NO: 293742 - DNA, 535 bp, Homo sapiens
  misc_feature: GYAE6OF01EVXSJ.48.1.A01.1.454.CMB.1.raw
  modified_base (266)..(266): a, c, t, g, unknown or other
  misc_feature (266)..(266): n is a, c, g, or t
  modified_base (287)..(287): a, c, t, g, unknown or other
  misc_feature (287)..(287): n is a, c, g, or t
  modified_base (290)..(290): a, c, t, g, unknown or other
  misc_feature (290)..(290): n is a, c, g, or t
  modified_base (363)..(363): a, c, t, g, unknown or other
  misc_feature (363)..(363): n is a, c, g, or t
  modified_base (372)..(372): a, c, t, g, unknown or other
  misc_feature (372)..(372): n is a, c, g, or t
  modified_base (387)..(387): a, c, t, g, unknown or other
  misc_feature (387)..(387): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaccaggaaanccccgaagctactaatcgctntcntctagttgcagagtggacgtccactcgtcgtcgacgcgcgagtgagtcgtggcgagtacgtactatctacacnctacacacnctctacgtactactntaacgtatttgactaacttacttattgtacagacgtagggtcgacgtacgtttccctcccgtacgtttccggacgggacgggaccgtagggtacggtacgtacgaacgtaacgtggtcggcgtgacctacctactctcgttcttctac

SEQ ID NO: 293743 - DNA, 685 bp, Homo sapiens
  misc_feature: GYAE6OF01C1XUO.48.1.A01.1.454.CMB.1.raw
  modified_base (226)..(226): a, c, t, g, unknown or other
  misc_feature (226)..(226): n is a, c, g, or t
  modified_base (662)..(662): a, c, t, g, unknown or other
  misc_feature (662)..(662): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtcctccatcttccgtgtctgcttctgtcggagactagagtcactatcacttggcggcgagccaggtntgttacgtccttagttagccttggtatcagacaagaaaccgagggaacgccccgaagtctaccttaagttttccgcttcggttcctcctagtttcgctaagagtggacgtccattcgtcggtcaggcggcaggtgagtcgtgggctaggtagttcaattcctacaacctacgttaccaactaccgtaccctttacgaccgtaccgttaagtaagttacttttacgaaccttaaacgttacttaacttcgttacgacggtacgtagggtaccgtaaccgttaccgtttccccgtacccgttaacggtttccgggacgggtaaccgggtaccgggtaacggggttaccggtaaccggttaaccgtaaaacggtaaccggttcggtacggtaccgttacggaccctacccgtaagtttcccgttacgttacctttaacnccgtttaccccgtcccgtaaccg

SEQ ID NO: 293744 - DNA, 586 bp, Homo sapiens
  misc_feature: GYAE6OF01C32CV.48.1.A01.1.454.CMB.1.raw
  modified_base (311)..(311): a, c, t, g, unknown or other
  misc_feature (311)..(311): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggcgggcgagccaggtatgttacgtccttatagcctggtatcagcaagaaaccagggaaacgccccgaagctcctaattttcggcttgtctccagtttgcagngtgacgtccatcgtcggttcaggcggcagtggatcgtgggcagtagttcattctacaccatacaacacgtccttcacgtcctagtaagttattttagacctaactttaacttattcgtactagtcgtagggtctaccttacgtttcccctcccgttacgtttccgggacgggtacgggaccgtaggggtacggtaaccgttacgaaaccggtacgtcggtacggctacggtcaccgtacttcttcggttacttactaccttccgttccccgtacc

SEQ ID NO: 293745 - DNA, 666 bp, Homo sapiens
  misc_feature: GYAE6OF01CZ0X1.48.1.A01.1.454.CMB.1.raw
  modified_base (396)..(396): a, c, t, g, unknown or other
  misc_feature (396)..(396): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggtatgttagtccctttatagcctggtatcagacaagaaaccaaggggaaacgccccgaagctaccttaattttcgcttgtctcctagtttgacagagtggacgtcccagtcgtcggttcaggcggcgagtggagtcggtggggcaggtacgttcatttccacaccataccaacncgtccttacgacgtacctaggtaaacgttacttttacgaccttaactttacttaagtttcgtacgaggtaccggtaagggttccgtaaccgttaccgtttttaccccccgtaccccgttacggtttccggggaccgggtaacggggtaacccgtaggggggtaccggtaaccggtaaccgaaaaaccggtaccgtgggtcggccgttacggacccaaccgttacgttctttacggttacctttaccgtaaccttcccgtttccccggacc

SEQ ID NO: 293746 - DNA, 553 bp, Homo sapiens
  misc_feature: GYAE6OF01E10Y4.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcaggtggatcgtggggcaggagttcatttctcaccataccaacacgtcccttcacgtcctagtaaagtattttgactaactttactattcgtcagcgagggtgactacgtttcccctccctacgtttccgggcgggtacgggaccgtaggggtcggaacggtcgaaaccgaacgtggtcggctggccacctatcgttcgttcttacacttcctcccgtacc

SEQ ID NO: 293747 - DNA, 653 bp, Homo sapiens
  misc_feature: GYAE6OF01CW8N8.48.1.A01.1.454.CMB.1.raw
  modified_base (348)..(348): a, c, t, g, unknown or other
  misc_feature (348)..(348): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttatagcctggtatcagcaagaaaccagggaaacgccccgaagctcctaattttcgcttgtctccagtttgcagtagtggactcccatccgtcggttcagcggcagtggatcgngggtcagtagttcattctacaccatcaactagcctttcgagccttagaacgttattttacgaccttaactttacttaatttcgtactacggtacgtaggggtcgtacccgttaaccggttttcccccttacccgttaaccggtttttcccggggaccggggtaacggggtaaccccggtagggggttaccgggaaaccggttaaccggaaaaccggtaacgttcggggtacggtccgttacggacccgtaaccctacgtttcctacggtttaccttacctacttccccgtttccccggtaacccg

SEQ ID NO: 293748 - DNA, 567 bp, Homo sapiens
  misc_feature: GYAE6OF01AZF9R.48.1.A01.1.454.CMB.1.raw
  modified_base (268)..(268): a, c, t, g, unknown or other
  misc_feature (268)..(268): n is a, c, g, or t
  modified_base (380)..(380): a, c, t, g, unknown or other
  misc_feature (380)..(380): n is a, c, g, or t
  modified_base (438)..(438): a, c, t, g, unknown or other
  misc_feature (438)..(438): n is a, c, g, or t
tcagagtatacatacacgaccggtgctcgatttagacgtctcatcagggggagtcgagacccagtcaggactcagcatggacatgagggtccccgctcagctcctggggctcctgctgctctggttcccaggttccagatgcgacatccagatgacccagtctccatcttccgtgtctgcttctgtcggagacagagtcactattcacttgtcgggcagccaggatgttagtccttattagcctggtatcagcagaaaccaggaaacncccgaagctcctaattttcgctgtctcctagttgcagagtggacgtcccatctcggttcacggcgcgacgtggaattcgtggggacaggacgttcatttctacacatcaacncgtccttcagtcctaggtaagtatttagactaactttacttattgtctagctagggtntacgtacgtttcccctcccgtacgttttcggaccgggtagggaccgtacgggtcgggaacgtcgaaaacgtacgtggttggacgtcggccacctacgttcgtcgtaccttcgacttccttacccggtcc

SEQ ID NO: 293749 - DNA, 520 bp, Homo sapiens
  misc_feature: GYAE6OF01ES0EO.48.1.A01.1.454.CMB.1.raw
  modified_base (512)..(512): a, c, t, g, unknown or other
  misc_feature (512)..(512): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacctagtctccatcttccgtgtctgcttctgtcggagacagagtcactatcacttgtcgggcgagccaggatgttagtcccttattagcctggtatcagcaagaaaccagggaaacgccccgaagctcctaatttcgctgtctccagtttgcagagtggagtcccatctcggttcagcggcagtggatcgtgggcagagttcattctcacctatccaacacgtccttcagtcctagaagtattttgactaactttactattgtcagctagggtcgactacgtttcccctcccgtacgtttcggcggacgggaccgagggtggacgtacgaaacgactggtgtctgccacatctgtctcntcctccgc

SEQ ID NO: 293750 - DNA, 540 bp, Homo sapiens
  misc_feature: GYAE6OF01EVAL0.48.1.A01.1.454.CMB.1.raw
  modified_base (366)..(366): a, c, t, g, unknown or other
  misc_feature (366)..(366): n is a, c, g, or t
  modified_base (439)..(439): a, c, t, g, unknown or other
  misc_feature (439)..(439): n is a, c, g, or t
  modified_base (511)..(511): a, c, t, g, unknown or other
  misc_feature (511)..(511): n is a, c, g, or t
  modified_base (520)..(520): a, c, t, g, unknown or other
  misc_feature (520)..(520): n is a, c, g, or t
  modified_base (530)..(530): a, c, t, g, unknown or other
  misc_feature (530)..(530): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcaagaaaccagggaaacgccccgaagctcctaattttcgcttgtctccagtttgacaggagtggacgtcccatcgtcggttcagcggcagtggatcgtgggcagagttcattcncaccatacaacacgtcccttcacgtcctagtaagtattttcgactaactttactattcgtacagcgtagggtnaactcgtttaccctacccgtacgtttccgggcggacgggaccgagggtcgacgtacgaaacgacgtgtcggntcgcacctntctgtcttcntccgtccgtc

SEQ ID NO: 293751 - DNA, 660 bp, Homo sapiens
  misc_feature: GYAE6OF01DN377.48.1.A01.1.454.CMB.1.raw
tcagagtatacatacacgaccggtgctcgatttagacgtctcatcgagggggagtcagacccagtcaggactcagcatggacatgagggtccccgctcagctcctggggctcctgctgctctggttcccaggttccagatgcgacatccagatgaccctagtctccatcttcgtgtctgcttctgtcggagacaggaggtcactatccacgttcgggcgggcgagccaggattggttagtcccttatagcctggtatcagcaacgaaaccagggaaagccccgaagcctccttaatttcgcttcgtcctccgtaggttgcgaggtggtggacgtacccatcgtacggttcgaggcggcaggtagacgtcgtggggacaggtagttcgtattcctaccgacctacgttaccaaccgaaccttcccttacgaacgtacccgtaaggtaacgttaacttttacggacccttaaacctttaccttaagtttcgtaccgtaaggtacggtaacgggttacgtaaccgtaaccgttttcccctacccgttacccggtttccggggaccgggtacgggtaccgtaggggttacggtaaccgttaccgaaacggtactgggtacggcttcgacacgtactcggttcgtacttcacttccgtcccgtac

SEQ ID NO: 293752 - DNA, 630 bp, Homo sapiens
  misc_feature: GYAE6OF01ANOKA.48.1.A01.1.454.CMB.1.raw
  modified_base (352)..(352): a, c, t, g, unknown or other
  misc_feature (352)..(352): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcatatcacttgtcgggcgagccaggattgttacgtccctttattacgcctggtatcagcaagaaaccgaggaacgccccgaagctctaatttcgctgtctcctagtttgcagagtggacgtccctatccgtcggttcaggcggcaggtggatcgnggggcaggtagttctattctaccaccataccaactacgtccctttcgacgtaccctaggtaaagttactttttcgaaccttaacttttacgtatttcgtcgtacgcgtaaggggtctaaccgtttcggtttaccccctacccgttacggtttcgggaccgggtacgggaccgtaggggtacgtaacggtaaccgaaaaccgtacggttggtcgggtaccttagccctaaaccgtgttaccgttcgttactttaccaccgtttcccttccccggtaccc

SEQ ID NO: 293753 - DNA, 809 bp, Homo sapiens
  misc_feature: GYAE6OF01D7ZP2.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatctacgttggtcgggcgacgccaggtattggtttacgttccctttaagttacgtccgttggtactcgaagacgaaacggaaaaccggaaggggaaaccgaccccgaagtccttacctttaattttccgcttcgtccttccgtaggtttcgacgtaggtacggtcggtacgtcccctagttccgttccggttacgaggccggtacgtagggtcggtacgtcgggtaggggacctaggtacgttactactttcctaccaaccgtactaccgaactaccgtcccttacgacgtaccttaggtaaacgttacgttttacgaaccttaactttacttacgtttacgtacgtaggtacggtaacgggttcgtaaccgtttacccgttttacccccgtacccgttaacccgggttttaccggggaaccggggttaaccggggtaacccgggttacgggggttaccgggtaaacccggttaaaccggtaaaacccgggttaacggttacgggtaccgggttaccgttaccggtaacccgttaacccgttacgtttacccggtttccgtttaccctttaccgttaacccgtttcccccgttaccccggttaacccg

SEQ ID NO: 293754 - DNA, 540 bp, Homo sapiens
  misc_feature: GYAE6OF01D89C3.48.1.A01.1.454.CMB.1.raw
  modified_base (513)..(513): a, c, t, g, unknown or other
  misc_feature (513)..(513): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctcctaattttcgctgtctccagtttgcagagtggagtcccatctcggttcagcggcagtggatcgtggggcagagttcatttctcaccatacaacagtccttcagcctagaagtattttgactaactttacttattgtcaggctagggtcactacgtttcccctcccgtacgtttcgggcggtagggtaccgagggtcggaccgtacgaaacgacgtggtcggctggccaccgtntctgttcttacacttccgtcccgtacc

SEQ ID NO: 293755 - DNA, 607 bp, Homo sapiens
  misc_feature: GYAE6OF01BB91L.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcagccaggatgttagtccttatagcctggtatcagcagaaaccagggaaacgccccgaagctcctaatttcgctgtctccagtttgcagagtgagtcccatctcggtcagcggcagtggatcgtggggcaggtagttcatttcctacaccataccaacacgtccttcagtcctagagtattttcgactaacttacttattgtacgagtacgaggggtcgacgttacgttttccccctaccccgttaccgttttaccgggaccgggtaacggggtacccgtaggggtacgggtaacgtaccgtaaaaccggtaacgttcggtacgggccgttcggacccaccgtaacgttccgttaggttaccctttacgtaccttccgtttcccccggtaccc

SEQ ID NO: 293756 - DNA, 826 bp, Homo sapiens
  misc_feature: GYAE6OF01BOBVT.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacgttggtcgggcgagccagggtattgttacgtccttagttagccttaggtactcgagacaaagaaaccgaagggaaacgccccgaagtcctaccttaattttcgcttcgttcctccgtagtttcgacgtaggtacggtcggtaacgttccccgtaagttccggtttacgggttacgaacggggtccgggacgtaaggggttcgggtaacgttcgggttacgggggacctaagggttacgtttacctaacgtttaccgtaccaaaccctattaaccaaaccgtaccggtaccctttacgaaccggttacccgttaaaggttaaacggtttacttttaccggaaacctttaaaccgtttacgtttaagtttcggtactaacgggtacgtaagggggtttacctaacccgtttaacccggttttaccccccgtacccggtttaaccgggttttcccgggggaaccgggggttaaccggggtaacccggtaagggggttaccgggtaaacccggttaacggaaaaaccggttacggttcgggtacggtacgtaccggtaccctaaccgttacgttcccgttacggtttacccttaccgttaccctttccccggttccccggtaac

SEQ ID NO: 293757 - DNA, 765 bp, Homo sapiens
  misc_feature: GYAE6OF01CWBPR.48.1.A01.1.454.CMB.1.raw
  modified_base (725)..(725): a, c, t, g, unknown or other
  misc_feature (725)..(725): n is a, c, g, or t
  modified_base (738)..(738): a, c, t, g, unknown or other
  misc_feature (738)..(738): n is a, c, g, or t
  modified_base (751)..(751): a, c, t, g, unknown or other
  misc_feature (751)..(751): n is a, c, g, or t
tcagagtatacatacacgaccggtgctcgatttagacgtctcatcgagggggagtcagacccagtccaggactaccagcatggaccatgagggtaccccgcctcgagctcctcggggtcctcctcgctggctcgtcggttcccgagggttccacgtattcgcggacgactccgagaagtccggacccaaggtcctcccacttcccttccggtgtcctgcttcgtgtcgagacgaggagttcgacgtagtacgaacgttcggtcggggccgacggccgaagggtacttcgttacggtcccttaagttacgtcccgttagggtaaactccgaggaccaacgaaaacccgaacgggaaaaccgccccgtaaacgtccttacgttaaacgttttccggcttcgtccgtcccgtaggtttcggacgtaggagtggtacggtccggtagttaccgtaccggttaccaacggccggtagtaggtacgacgttaccgggtggggaccaaggtacggtttacctacgttaccgacgaccgtactaaccgaacgacgtccgttacgacgtcccgtagtaagttctttacgactaacgtttaaccttagttacgaccgaggtacgtacgggttagtaccggttaaccgttttccccctaccggtttaaaccgttcggggaaccggaacgggtacccgtaaggggtccggaactacggaaaccgtagtgggtaccgngtacgccaacgtntcgtcgtactacncgttcccgtccgac

SEQ ID NO: 293758 - DNA, 524 bp, Homo sapiens
  misc_feature: GYAE6OF01CYDPB.48.1.A01.1.454.CMB.1.raw
  modified_base (510)..(510): a, c, t, g, unknown or other
  misc_feature (510)..(510): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcagccaggatgttagtccttattagcctggtatcagcagaaaccagggaaagccccgaagctcctaattttcgctgctccagtttgcagagtggagtccatctcggttcagcggcagtggatcgtggggcaggattcattctcaccatcaacagccttcagcctagaacgtatttgctaacttactattgtcagcagggtcgactacgtttccctccctacgtttccgggacgggacgggaccgaggggttcggacgtacgaaacgactcggtggctcggcacctatctcgtcttnactcctccgtaccc

SEQ ID NO: 293759 - DNA, 669 bp, Homo sapiens
  misc_feature: GYAE6OF01DOS8S.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctgtcggagacagagtcactatcactttgcggcgagccaggatgttagtccttatagcctggtatcagacaagaaccagggaaacgccccgaagctcctaatttcgctgtctccagtttgcagagtggacgtccatctcggttcagcggcaggtggatcgtggggacaggtacgttcattcctactaccactacaacacgtccttacacgtccctaggtaagtacgttttgaccttaaacgtttaccgttaagtttcggtactaacggtccgtaaggggttcgtaaccgttacgttttaccccccttacccgtaacccgttttcgggggaccgggtacggggtaacccggtagggggtaccgggtaaaccggttaccgaaaaaccggtaaccgttgggttacgggtacccgttcggtaacccgtaacccttacgttacccggtttcggtttaccctttcctaaccgttcccgttttccccccggacc

SEQ ID NO: 293760 - DNA, 692 bp, Homo sapiens
  misc_feature: GYAE6OF01E21NP.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggtcccaggttccagatgcgacatccagatcgacccagtctccatccttccgtgtctgtcttcgtgtcggagacagagtcactatctacgttggcggcgagccgaggtatgttacgtcctttagttacgcctaggtactacgagacgaaacggaaaccggaacggggaaaccgccccgaagtcctacctttaatttccgctacttctacctaggttcgacgagtacgtggtaccgtcctatcggttcggtagacggcggactaggtggaacttcgggtagggtcctaagttacgttacctacgttcctaacccaacctacgtacctaaacgtccgttcccttagtaaccgtccgttaaagtaaacgttttactttcgaaccttaaccgtttaagttacgttcgaccggacgtaccggttaacgggtttcccaaccgttttccccggtttaccccggacccggttacgggttacgggaccggggttacggaacggtacgggacggtacaacgtaaaccgacgtgtccgatcacctacgtacttccgtcttcctactaaccttccccgctacg

SEQ ID NO: 293761 - DNA, 552 bp, Homo sapiens
  misc_feature: GYAE6OF01AOH29.48.1.A01.1.454.CMB.1.raw
  modified_base (416)..(416): a, c, t, g, unknown or other
  misc_feature (416)..(416): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtgggcagagttcattctcacatcaacagccttcagcctgaagtattttgactaacttactattgtcagcaggtnacgtacgtttccctcccgtactttccgggacgtacggggacctaggggtacggacgtacgaaaaccggtacgtggtacggcttacggcctacccgtattccgttcgttccttactacttcccgttccccggtaccc

SEQ ID NO: 293762 - DNA, 547 bp, Homo sapiens
  misc_feature: GYAE6OF01C6YV0.48.1.A01.1.454.CMB.1.raw
  modified_base (301)..(301): a, c, t, g, unknown or other
  misc_feature (301)..(301): n is a, c, g, or t
  modified_base (528)..(528): a, c, t, g, unknown or other
  misc_feature (528)..(528): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtccttatagcctggtatcagcagaaaccagggaacgccccgaagctctaatttcgctgtctcagttgcagngtggagtcccatctcggttcagcggcagtggatcgtgggcagtagttcattctcaccatacaacacgtccttcagcctagtaagtatttcgactaacttacttattgtcagtcgagggtcgtactacgtttcccctcccgtacgtttcgggacgggtacgggaccgtaggggtcggacgtacgaaacggtacgtggtcggctcgctaccgtattcgtcgttaccttntaccttccgttcccgtacc

SEQ ID NO: 293763 - DNA, 541 bp, Homo sapiens
  misc_feature: GYAE6OF01BCO88.48.1.A01.1.454.CMB.1.raw
  modified_base (371)..(371): a, c, t, g, unknown or other
  misc_feature (371)..(371): n is a, c, g, or t
  modified_base (525)..(525): a, c, t, g, unknown or other
  misc_feature (525)..(525): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtgggcagagttcattctacaccatcaacngaccttcagcctagaagtattttgactaacgttactattcgtcagtcagggtgactacgtttccctcccgtacgtttccggcgggacgggtacccgtaggggtcggtacgtaccgaaaacgacgttggtcggctgccacgacttctcgtacttncttccgttcccgtacc

SEQ ID NO: 293764 - DNA, 569 bp, Homo sapiens
  misc_feature: GYAE6OF01C8PQL.48.1.A01.1.454.CMB.1.raw
  modified_base (332)..(332): a, c, t, g, unknown or other
  misc_feature (332)..(332): n is a, c, g, or t
  modified_base (369)..(369): a, c, t, g, unknown or other
  misc_feature (369)..(369): n is a, c, g, or t
  modified_base (540)..(540): a, c, t, g, unknown or other
  misc_feature (540)..(540): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggcgggcagccaggatgttagtcccttattagcctggtatcagcaagaaccgagggaaacgcccgaagcttactaatttcgcttgtctctagtttgcagagtgacgtcccatcgtcgtcagcgnagtgatcgtgggcagtagttcattctcacatacaacncgtcctcagtcctagtaattatttagactaactttacttagttcgtacaagtcgtaagggttacacgttaaccgtttcccctacccgttacggtttaccgggccgggtaacgggtaccggtaggggtcggaaccggttacaaaaccggtacgtggtcgtactcgcaccgtnttcgttcgtactctacctccgtcccgtac

SEQ ID NO: 293765 - DNA, 528 bp, Homo sapiens
  misc_feature: GYAE6OF01BSORD.48.1.A01.1.454.CMB.1.raw
  modified_base (428)..(428): a, c, t, g, unknown or other
  misc_feature (428)..(428): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
  modified_base (513)..(513): a, c, t, g, unknown or other
  misc_feature (513)..(513): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtccttattagcctggtatcagcagaaaccagggaaagccccgaagctcctaatttcgctgtctccagtttgcagagtggagtcccatctcggttcagcggcagtggatcgtggggcaggagttcattctcactatcaacagtcccttcgacgtcctagaacgtatttacgactaacttactattgtcagcgtagggtnactacgttcccctcctacgttcggcggacggacgagggtcgacgtacgaaacgactggnggacngcaccgtatcgtcgtcttacncttccgtcccgtacc

SEQ ID NO: 293766 - DNA, 289 bp, Homo sapiens
  misc_feature: GYAE6OF01A96UB.48.1.A01.1.454.CMB.1.raw
  modified_base (265)..(265): a, c, t, g, unknown or other
  misc_feature (265)..(265): n is a, c, g, or t
  modified_base (272)..(277): a, c, t, g, unknown or other
  misc_feature (272)..(277): n is a, c, g, or t
  modified_base (279)..(289): a, c, t, g, unknown or other
  misc_feature (279)..(289): n is a, c, g, or t
tcagagtatacatacacgaccggtgctcgatttagacgtctcatcaagggaaggaagggcaatggatccgggacagattttcggctcaccatcagcagtctacaacctgaagattttgcaacctacttctgtcaccaggcttacaattcccctcgacgttcggccaagggaccaaggtgaagtcagacgaactgtggctgcaccatctgtcttcatccttcccgcatctgattatgtactactctgaggcggctggactaaggcncagtagnnnnnntnnnnnnnnnnn

SEQ ID NO: 293767 - DNA, 603 bp, Homo sapiens
  misc_feature: GYAE6OF01BKW72.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctgtcggagacagagtcactatcacgttggtcgggcgagccaggtatgttacgtcccttatacgcctggtatcagcaagaaaccgagggaaacgcccgaagcttactaatttcgctcgtctcctagtttgcagtgtgacgtccattcgtcggttcgagcggacgaggtgacgtcgtcgggactagtacgttactacttctacacctactacaaacgcgtaccttcacgtcctaaggtattctttacgactaactttactatttagctaagtcgtagggtactcgtaccgtttcccctacccgtaggttccgggacggtacggaccgtaggggtacgaggtaaccgaacgtaacgttgggtccgtagtacggccctagtaccgtcgtttacgttcctacggtaccttcccgttccccgtacg

SEQ ID NO: 293768 - DNA, 613 bp, Homo sapiens
  misc_feature: GYAE6OF01C22GQ.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttccccaggttccagatgcgacatccagatgacccagtctccatcttccgtgtctgcttctgtcggagacagagtcactatcacttgtcggcgagccaggatgttagtcccttatagcctggtatcagcagaaaccgagggaaacgccccgaagctccttaatttcgctgtctcagtttgcagagtggactcccattcgtcggtcagcggcagtgatcgtgggcagtgtcattcacacctataccaacagtcccttcagtcctagaagttattttcgacctaactttactagtttgtacgacggtcgtagggtcgtaaccgttacgttttccccctacccgttacgtttccgggaccgggtaacggggtaccgtacgggggttacggaaccgtaaccgaaaaccgggtaacgttacggttcgggccttacggaccctaacctacgttaccttggtttacccttaccgtaacttcccgttccccggtaccc

SEQ ID NO: 293769 - DNA, 645 bp, Homo sapiens
  misc_feature: GYAE6OF01DZBO2.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctgtcggagacagagtcactatcacttgtcgggcgagccaggatgttacgtcccttattacgcctggtatcagcaagaaaccagggaaacgccccgaagctcctaattttcgctgtctcctagtttgcagagtggacgtcccatcgtcggttcagcggcagtggatcgtggggcagtgttcattctacaccataccaactacgtaccctttcgacgtcccttagtaaaggttacttttacggaccttaacgtttacttatttcgtacaggtactaagggttcgaacttaccggttttacccctaccccgttacgtttccgggacggggtacgggaccggtacggggtacgggtaacccgtacgtaaaaccggtaacgttacgggtcggtacctcggtacccgtaaccctagttccgttacggtttaccctttacgtaaccccgtttccgtttcccccgtaccc

SEQ ID NO: 293770 - DNA, 283 bp, Homo sapiens
  misc_feature: GYAE6OF01D2XZK.48.1.A01.1.454.CMB.1.raw
  modified_base (268)..(269): a, c, t, g, unknown or other
  misc_feature (268)..(269): n is a, c, g, or t
  modified_base (271)..(273): a, c, t, g, unknown or other
  misc_feature (271)..(273): n is a, c, g, or t
  modified_base (275)..(283): a, c, t, g, unknown or other
  misc_feature (275)..(283): n is a, c, g, or t
tcagagtatacatacacgaccggtgctcgatttagacgtctcatcgaagggaaggaagggcaatggatccgggacagatttcggctcaccatcagcagtctacaacctgaagacttttgcaacctacttctgtcaccaggcttacaattccctcgacgttcggaccaagggaccaaggtgaagtcagacgaactggtggctgcaccatctgtctcatcctcccgcatctgatatgtatactctagagcgggctggacaaggcgcatgnntnnntnnnnnnnnn

SEQ ID NO: 293771 - DNA, 762 bp, Homo sapiens
  misc_feature: GYAE6OF01BDZA6.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtcctcatccttccgtgtctgtcttcgtggtcggagacgaggtacgtaccaacttactctacgttcgggtccgggacgacgaccgaggtattcggttaccgttaccttagttacgccgttaggtactacgagacgaaacggaaaccggaagggtaacccgacccgaagttccttaacctttaacgttttccgacgttcgtccttaccgttagtttcgacgaggttacggtacggtaccgttcccctagttcccgttcggtacacgggccggtacgtagggtcggtacgtcgggtcgggactacggtacgtttcctacgtttccaccaaccgtactaaccgaaccgtaccgttccctacgaccgttaccgtaggttaaactttacgtttacgaaccttaactttacgttagttcgtacaggtacgggtagttaccgtaccgtttacccgttacccctaccgttacgggttacccggggacggtaacgggtacggtacggggtacgaaccgttaaccgaaacggtaccgttgggtccgtaccaccggtacctaccgttagttcccgttcgtttacccttaccgtaccgtttcccgtacccggtac

SEQ ID NO: 293772 - DNA, 535 bp, Homo sapiens
  misc_feature: GYAE6OF01BT99T.48.1.A01.1.454.CMB.1.raw
  modified_base (365)..(365): a, c, t, g, unknown or other
  misc_feature (365)..(365): n is a, c, g, or t
  modified_base (397)..(397): a, c, t, g, unknown or other
  misc_feature (397)..(397): n is a, c, g, or t
  modified_base (431)..(431): a, c, t, g, unknown or other
  misc_feature (431)..(431): n is a, c, g, or t
  modified_base (502)..(502): a, c, t, g, unknown or other
  misc_feature (502)..(502): n is a, c, g, or t
tcagagtatacatacacgaccggtgctcgatttagacgtctcatcagggggagtccagacccagtcaggactcagcatgggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgcttgtctccagtttgcagagtggagtccccatctcggttcagcggcagtggatcgtggggcagagttcatttcncaccatcaacagtccttcagtccctgaagttnttttgactaactttacttattgtcagtcagggtnactcgtttcccctccctacgtttcgggacggtacgggaccgaggggtcgacgtacaaacgtactggtcggntcgcacctatctgttcttcacttcctcccgtac

SEQ ID NO: 293773 - DNA, 320 bp, Homo sapiens
  misc_feature: GYAE6OF01EZCUD.48.1.A01.1.454.CMB.1.raw
  modified_base (282)..(282): a, c, t, g, unknown or other
  misc_feature (282)..(282): n is a, c, g, or t
  modified_base (284)..(285): a, c, t, g, unknown or other
  misc_feature (284)..(285): n is a, c, g, or t
  modified_base (287)..(320): a, c, t, g, unknown or other
  misc_feature (287)..(320): n is a, c, g, or t
tcagagtatacatacacgaccggtgctcgatttagacgtctcatcaagggaaggaagggcaatggatccgggacagattttcggctcaccatcagcagtctacaacctgaagattttgcaacctacttctgtcaccaggcttacaattcccctcgacgttcggccaagggaccaaggtggaagtcagacgaactgtggctgcaccatctgtcttcatcttcccgcatctgattatgtactactctgacgcgggctgggcaaagggccgctaagtacggctgnanncnnnnnnnnnnnnnnnnnnnnnnnnnnnnnnnnnn

SEQ ID NO: 293774 - DNA, 569 bp, Homo sapiens
  misc_feature: GYAE6OF01CQG17.48.1.A01.1.454.CMB.1.raw
  modified_base (390)..(390): a, c, t, g, unknown or other
  misc_feature (390)..(390): n is a, c, g, or t
  modified_base (531)..(531): a, c, t, g, unknown or other
  misc_feature (531)..(531): n is a, c, g, or t
  modified_base (554)..(554): a, c, t, g, unknown or other
  misc_feature (554)..(554): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtccttatagcctggtatcagcaagaaaccagggaagccccgaagctcctaattttcgctgtctccagtttgcagagtggacgtcccattccgtcggttcacggcggcgagtggatcgtggggcagtagttctattctcaccactacaacacgtccttacngcctagtaagtacgttttagacctaactttaactatttgtactacgcgagggttagacgttaccgttttcccctaccccgtaccgtttccgggacgggtacgggaccgagggtacggaccgtacaaacggacgtggtcggntggccacactcgttacgtcttanctccgttcccgtacc

SEQ ID NO: 293775 - DNA, 722 bp, Homo sapiens
  misc_feature: GYAE6OF01A9H6K.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccatcttccgtgtctgtcttcgtggtcggagacgagacgtcactatctacgttggtccgggcgacgccgtaggtattcgtttacgttcccttagttacgtccgttggtactcgaagacgaacggaaaccgaacgggaaaccgaccccggaagtccttaccttaagtttccgcttacgtcctaccgtagtttacgcgtagtaggtggaccttcccagttccgtcggttacgacggccggtagtacgggtagacgtcggtcggggactaggtcgttactcgtttcctacctaacctacgtaccaacgtaccgtcgttacgacggtaccttaggtaaacgttacgtttacgaacttaacgttttactagttacgtacgtacgtacggtaaggtacgtaccgtttaacccgtttccccgttacccgttacgggtttcccggggaccgggtaacgggtacccgggtacgggtaccggtaacgtacgtaaaacggtacggtgggtacgacgtacgaccgttacctagttccgttcgttacttaccgtcccttccgtcccgtaccg

SEQ ID NO: 293776 - DNA, 676 bp, Homo sapiens
  misc_feature: GYAE6OF01CZ5J9.48.1.A01.1.454.CMB.1.raw
  modified_base (654)..(654): a, c, t, g, unknown or other
  misc_feature (654)..(654): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcaactatcacttggtcgggcgagccaggattgttacgtccttattagcctggtatcagcaagaaaccgaagggaaacgccccgaagccttaccttaagttttccgcttcgtcctccgtagtttgacaggtacggtggtacgtacccatccgttacggttcacggcggctagggtggtacgtggtcggggacaaggtacgtttactacgtttcctaccaacctaacttaccaaaccgccgttaccccttacgacggtaccctaaggtaacgttaacttttacgaccttaaaccttttacgttaactttggactacggtacgtacggggttactaaccgttccgttttaccccctacccgttaacggtttccgggacgggtacgggaccgtaggggtacggtaaccgtacgaaaacggtcgtgggtcgtctcgaccaccgtattcgttcgttacccttntacccttcccgttccccgaccg

SEQ ID NO: 293777 - DNA, 742 bp, Homo sapiens
  misc_feature: GYAE6OF01AG87N.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctgtcggagacgagagtcactatctacgttgtcgggcgagccaggtatgttacgtcccttatacgcctggtatcagacaacgaaccgagggaaccgccccgaagtccttaccttaagtttccgcttcgtccgtcgtaggtttcgacgtaggtacggttcggtaccgttcccctagttccggttccggtacgtacgggtccggacgtacgggtggtaccgttcgggtcgggacctaaggttacggtttcctacgtttccacgtaaccacttaaccgaacctacggttccctttaccggacgtacccgtttaagtaaacgtttgttttaacgaaccctttaaccgttttacttacgttcgtacgtacggtcgttaagggtacccttaacgttacccgttttcccccgttaccggtaccggtttccggggaacggtaccgggtaccgtacggggtacgtaaccggtaacgtaaccgtacggttcggtcggtaccttacgacccgttacgttacgtttccgtacccggtttacttaccccggtctttccccggttcccccgtag

SEQ ID NO: 293778 - DNA, 757 bp, Homo sapiens
  misc_feature: GYAE6OF01ED2FO.48.1.A01.1.454.CMB.1.raw
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatcgacccagtcctccatcttccgtgtctgtcttcgtgtcggagacagagtcactatctacgttggtcggcgagccgaggtattgtttacgttaccctttagttacgtccgttaggtatcgagacgaaacgaaaccgaagggaaaccgccccgaagtccttaccttaactttccgcgttcgtccgttacctaggtttcgacgaggtacggtcggtaccgtcccgtagttccgttcgggttaccgacggtccggtacgtagggtacggtacgtcgggtcgggactaggtacgttcgtagtttcccaccgacctactaaccgaaccgtacgttcccgttaccgacggtaccgttaagtaaacgtttacgttttaacaaccgtttaacttttaccgttacgtttcgtacggtacggtacggttacgggggtacttaacccgtttacccgttttcccccgttaccgttaccgggtttaccggggacggggtaacccgggtaacgggttaccgggtacggtaaaccgtaaccgaaacgtaccggttggtcggtacctcgaccctacgttattccgttactttaccgtacccgttcttaccccggtccctaccg

SEQ ID NO: 293779 - DNA, 568 bp, Homo sapiens
  misc_feature: GYAE6OF01EPXVF.48.1.A01.1.454.CMB.1.raw
  modified_base (435)..(435): a, c, t, g, unknown or other
  misc_feature (435)..(435): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgaaacttctgtcggagacagagtcactatcacttgtcgggcagccaggatgttagtcccttattagcctggtatcagcagaaaccagggaaacgccccgaagctcctaattttcgctgtctccagtttgcagagtggagtcccatctcggttcagcggcagtggatcgtggggcagagttcattctcaccatccaacacgtccttacagtccctagaaagtattttgacctaactttacttattgtcagtcgagggtnactacgtttccctccctacggtttccggcgggtacgggaccgaggggtcgaacgtacgaaacggtacgttggtcggcttcggacctacccgtattccgttcgttaccttacctacttcccgttccccgtaccg

SEQ ID NO: 293780 - DNA, 565 bp, Homo sapiens
  misc_feature: GYAE6OF01CF80W.48.1.A01.1.454.CMB.1.raw
  modified_base (358)..(358): a, c, t, g, unknown or other
  misc_feature (358)..(358): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (521)..(521): a, c, t, g, unknown or other
  misc_feature (521)..(521): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggtccagatgcgacatccagatgacccagtctccatcttccgtgtctgcttctgtcggagacagagtcactatctacttgtcgggcgagccaggatggttacgtccttatacgcctggtatcagcaaggaaaccgagggaaacgaccccgaagcctaccttaatttcgcttgtctcctagttgctagagtggacgtccatcgtcgtcagcggcagtgatcgtgggcagntcattcncacatcaacncgtcttcgacgcctagaagtatttcgactaatttactattcgtactaggcgtaggtacgtaaccgtcgtttacccctccgtaccgtttcgggaccgggacgggtaccgaggggtcgaacgtacgaaaaccgtacgtaggcggtacncggtccacctagttcttcggttactacctctcccttcccgtacg

SEQ ID NO: 293781 - DNA, 829 bp, Homo sapiens
  misc_feature: GYAE6OF01EVS5O.48.1.A01.1.454.CMB.1.raw
  modified_base (232)..(232): a, c, t, g, unknown or other
  misc_feature (232)..(232): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccattcttccgtgtctgtcttcgtgtcggagacagagtcactatcacgttggtcgggcgagccgaggtntgttactccttattacgcgtggtatcgagacaacgaaaccgagggaaacgccccgaagtccttaccgtttatttccgtacgttgttacctcccgtagtttcgactaggtaggtacgggtacctacccgtacgttccgttacggttacgacggtccggtacgtagggtacggtacgttccggtacggggtacgtaaggttacgtttaccgtacctttacccgtacctaacccgtaacgttaaccccgaacgtacccgttaccccgtttacgaaccggttacccgttaaggttaaaccgttttagttttacccgtaaaccgttttaaccttttaaaccgttgtttacggtaccgtacggtaacggttacgggtacgtttaaccccgttacccgtttttacccccgggtaccccgtttacggggtttcccgggaacgggtacccgggtaacgggttaccggggtaccgggtaaaccgttaaccggtaaaaccggttacggtttcgggtaccgtccgtaacccggtaccttaacccgggttactttacccggttagttttacccgttaccccttacccgtttccccgttacccggtaaccc

SEQ ID NO: 293782 - DNA, 654 bp, Homo sapiens
  misc_feature: GYAE6OF01EA1BA.48.1.A01.1.454.CMB.1.raw
tcagagtatacatacacgaccggtgctcgatttagacgtctcatcagggggtaggtctagacccagtcaggactcgagcatggacatgaagggtaccccgctacagcctccgtggggtcctccctgctgcgtcgtgggttccccacggttccagagtcgcgaccatccagatggacccaggtctccgactcgttccgtgtctagtccgttcctgtccggagacagagttcactatctactttgttgggcgaggccaggatgttacgtccttagttacgccgtggtactcagccaaggaaaccgaggaaacgccccgaagcctaccttaatttcgctgtctcctagtttgcagacgtgacgtccagtccgtcgtcagcggcagtcgactcgtgggacagtagttcagttccaacgacctattaccaacacgtcccttacgacgtcctagtaacgtactttcgacctaacgttactagttcgtctacgtcgtaagggttcgtacgtaccgtttccctacccgttacgtttccgggacggtacggaccggtagggtcggtacgtaaccgtaaaccggaacgttcggtaccggtaccgtcggtccgtaaccgtagtaccgttacgttcccgttacgaccgttcccgtccccgtacccg

SEQ ID NO: 293783 - DNA, 661 bp, Homo sapiens
  misc_feature: GYAE6OF01CPFG0.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatctacttggtcgggcgagccgaggtattggttacgtcccttattacgccttggtatcagcaacgaaaccagggaaacgccccgaagtcctaccttaatttccgcttcgtccttcctagtttcgcgtaggtagtcggactccctagtcgttcggttcacggcggacgtaggtggtactcggtggggacctaggtacgttctaacgttcctactaccatacctaactacgtaccttcgacgtccgtagtaacgttacttttacgaccttaacgtttacttacgttcgtacgtacgtcgtaagggtaccgtaccttaccggttttacccctacccgttaacggttccgggacgggtacgggtaaccggtgggtacgtacggtaaccgtaaacggtacgtcggtacggtctacggacctaccgtattcgttacgttccttactaccgttcccgtaccgtaccg

SEQ ID NO: 293784 - DNA, 824 bp, Homo sapiens
  misc_feature: GYAE6OF01CGHDD.48.1.A01.1.454.CMB.1.raw
  modified_base (193)..(193): a, c, t, g, unknown or other
  misc_feature (193)..(193): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccattcttccgtgtctgcttcgtgtcgganacagagtcactatcacttggtcgggcagccgtaggtatggttacgtccttagttacgtcctggttactccgagtaccaacggaaaacccgaaggggaaaccgacccccggaaagtccctttaccccttaaaagtttttccccggacgttcggttacccgttaccgtacggttttcggaccgtagggtaacggttacgggtaaccggttaccccctaacgttccggtttaccgggtttacgaggtccggtaccgtaaggttcgggtaacttcgggtaggggtacaggtacggtttacctaacgtttccttaccgaaccctatacccaaaccgtacgtacccgtttaccgaacgttcccgtaggtaaacgttagttttacgacctttaacctttaacgttacgtttacggtaccgtaggtaccggtaacgggtttaccgtaacgtttaccggttttacccccttaccccggttaacggttttacccggggaacggggtaccggggtaaccggtacggggttacgggtaaccggttaaaccgaaacggtacggtacggttccgggtacgttacggtcctaacccgttagttcccgttacggtttacttccgttacccttcccgttcccgtaccg

SEQ ID NO: 293785 - DNA, 623 bp, Homo sapiens
  misc_feature: GYAE6OF01AEP9N.48.1.A01.1.454.CMB.1.raw
  modified_base (305)..(305): a, c, t, g, unknown or other
  misc_feature (305)..(305): n is a, c, g, or t
  modified_base (339)..(339): a, c, t, g, unknown or other
  misc_feature (339)..(339): n is a, c, g, or t
  modified_base (345)..(345): a, c, t, g, unknown or other
  misc_feature (345)..(345): n is a, c, g, or t
  modified_base (355)..(355): a, c, t, g, unknown or other
  misc_feature (355)..(355): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttacgtcccttattacgcctggtatcagcaagaaaccgaggaacgcccgaagctctaatttcgcttgctcagttgcagngtggactccatcgtcgtcagcggcagtggatcgnggcagngtcagttccncacctatacactacgccttacacgcctagaacgttattttcgactaactttactagttcgtaccaggaccgtagggttacgtacgttacccgttttacccctacccggttacgttttaccgggaccgggtaacggggtacccgtaacgggggtaccggtaaccgttacccgaaaaaccggttacggtacggtacgggtaccgttcggaccctaacccgtaagttccgttaacgttccgtttactacccgttcccgttcccccggtacc

SEQ ID NO: 293786 - DNA, 629 bp, Homo sapiens
  misc_feature: GYAE6OF01CWGSF.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttcgtgtcggagacagagtcactatcacttggtcgggcagccaggatgttacgtccttatagctggtatcagcaagaaaccgagggaaacgccccgaaagctacctaattttcgctgtctcgagttgcagagtgacgtccctatcgtacggttcacgcggcaggtggactcgtggggacaggtacgttcattccacacatcgaaactagtcccttacgagtacctaggtaaacttattttacgacttaacgttaacttattgtaccaaggtcgtaagggttctaacgttaaccgtttacccctacccgttacggtttccgggacggggtaacgggtacccgtaagggggttaccgaacggttacgaaaaaccggtaacgttggtcggtacgttacggacctaacctagttcgtacgtttacttacccgtaacgtcccgtttacccgaccg

SEQ ID NO: 293787 - DNA, 668 bp, Homo sapiens
  misc_feature: GYAE6OF01DTC90.48.1.A01.1.454.CMB.1.raw
  modified_base (654)..(654): a, c, t, g, unknown or other
  misc_feature (654)..(654): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggtgccagatgtgacgtccagttcgacccagtctccatccctccctgtctgcatctggtgggagacagacgtccacccctcacgttcggcccgggacaacgtccgacggtccctattttaccaattttcgtttacgccgttaggtactcgagacaacgaaaacccgaacggaaacctaaacctacctaaccaccttcctagtacttactatgatcggtcgtaccgtaggttagaggtacggtccgggcccagtcggaggttcgacgcgggacaggtgacgtacgacgggacaggactttaccaacttcctacaacctctacgacgacctacgacctggtaccgacgtccgtaaggtaacgttacgttttacgaaccttaaccttttacttaacgttacgttaacctaaactttaaccgtttaaactaaccttaacctactaacgtaaccgttccgttaaccggaccgtaacggaccgtaggtaccgaaacgacgtacgtaagtgtcgacgttacactacctactntttcgtctcttacc

SEQ ID NO: 293788 - DNA, 740 bp, Homo sapiens
  misc_feature: GYAE6OF01DMO00.48.1.A01.1.454.CMB.1.raw
tcagagtatacatacacgaccggtgctcgatttagacgtctcatcgagggggagtcaagacccagtcaggactcagcatggacatgagggtccccgctcagctcctggggctcctgctgctctggttcccaggttccagatgcgacatccagatcgacccagtctcattcttccgtgtctgtcttctgtcggagacagagtcatatcacgttggtcggcgagccgaggattgttacgtccttagtacgcctggtactcagacaagaaaccgaggaacgcccgaagctacttatttcgcttgtctccgtagtttcgcaggtacgtacgacgtcccattccgtcggttacacggtccggtactaggtacggcgtcggtagggactagtcgttctacttcgtaccaaccgtactaccgaacgtccgtccttacgacgtaccgtagttaagttacgttttacgacctttaaacctttattacgtttacgtaccgtaacggttacggtacgggttaccgtaaccgtttaacccggtttttcccccgttaccccgtttaaccgggttttaccggggaacccggggttaaccggggtaacccgggttaagggggttacccggttaaaccggttaaccgggaaaaccgttaaccggttccgggtacggtaccgttacggaccctaacccgtacgtttaccgttacggtttacccttaccgttaaccgtttccccgtaccccgttaccg

SEQ ID NO: 293789 - DNA, 517 bp, Homo sapiens
  misc_feature: GYAE6OF01E4FL3.48.1.A01.1.454.CMB.1.raw
  modified_base (292)..(292): a, c, t, g, unknown or other
  misc_feature (292)..(292): n is a, c, g, or t
  modified_base (360)..(360): a, c, t, g, unknown or other
  misc_feature (360)..(360): n is a, c, g, or t
  modified_base (390)..(390): a, c, t, g, unknown or other
  misc_feature (390)..(390): n is a, c, g, or t
  modified_base (423)..(423): a, c, t, g, unknown or other
  misc_feature (423)..(423): n is a, c, g, or t
  modified_base (487)..(487): a, c, t, g, unknown or other
  misc_feature (487)..(487): n is a, c, g, or t
  modified_base (499)..(499): a, c, t, g, unknown or other
  misc_feature (499)..(499): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctntctccagtttgcagagtggagtcccatctcggttcagcggcagtggatcgtggggcagagttcattcncaccatcaacagccttcagtcctagaagtnttttgactaacttactattgtcagcgtagggtnactcgtttccctccctacgtttcgggcggagggaccagggtcggacgtacaaacgactggtcgntgccacatcgtntcttcacttcctcccgtc

SEQ ID NO: 293790 - DNA, 649 bp, Homo sapiens
  misc_feature: GYAE6OF01A3STN.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcagccaggatgttagtcccttattacgcctggtatcagcaagaaaccagggaaacgccccgaagtcctacctaatttcgctcgtctccagtttgcaggagtggacgtcccatcgtcggttcgagcggcaggtggatcggtggggctaggtacgtttcacgtttcctaccacctaagttccaaacgtacgtaccctttacgacgtacccttaggaaacgttattttacgaaccttaaacgttttactagtttcgtaccgtaaggtcgtaaggggttcgtaaccgttaccggttttcccctaccccgttacggttttaccggggaccgggtacgggtaaccggtaggggtacggaaccgttacgaaaaccggtacgttgggtcggacttcgacctaccgtagttcgtacgttaccttactacgttcccgttcccgac

SEQ ID NO: 293791 - DNA, 723 bp, Homo sapiens
  misc_feature: GYAE6OF01EQJXQ.48.1.A01.1.454.CMB.1.raw
tcagagtatacatacacgaccggtgctcgatttagacgtctcatcagggggagtcagacccagtcaggactcagcatggacatgagggtccccgctcagctcctggggctccttctgctctggttcccaggttccagatgcgacatccagatgacccagtctccatcttccgtgtctgcttctgtcggagacagagtcactatcacttggtcgggcgagccgaggtattggttacgttccctttagttacgccgttggtatcgagacaagaaaccgaggggaaacgccccgaagtcctaccttaagttttcgccttggttcccttccgtaggtttgacgtaggtaggtcggtacgtcccctattccgttcggttcgacggcggacaggtcggatcggtggggactaggtacgttctaacttcgtaccacctacttaccaacgtacgtaccctttacgacgtaccgttagtaagtttacttttacgaccttaaaccgttttactacgttttcggacgtacggtcggttaacggggttactaccggtttacccgttttccccccgtacccgtttaccggtttccgggggaaccgggtaacggggtacccggtacgggggttaccggtaaaccgtacgaaaaccggttcgtacgggtcgtccggtacgacctaccgtcttaccgtttacgttcccgttacttaccgttcccgttccccgcgttacg

SEQ ID NO: 293792 - DNA, 773 bp, Homo sapiens
  misc_feature: GYAE6OF01APLCR.48.1.A01.1.454.CMB.1.raw
  modified_base (764)..(764): a, c, t, g, unknown or other
  misc_feature (764)..(764): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtcctccattccttccgtgtctcgtcttcgtggtcggagacagtagtcacttatcctacgttcgggtcgggacgacgaccgaagggtattcggtttacgttacccctttaagttaccgccgttaggttactcgaacggacgaaaacggaaaccggaaggggaaacccgaccccggaacggttaccctttaccgtttaacgttttccggccgtttcgttccttacccgtaggtttcgaaccggtaggtaacggtccgggtaccgttaccccgtacgttccggtttacggttccgaacgggtcccggtagtaacgggttcgggtacggtcggggtacgggggtactacggttacggtttacctaaccgtttcccctaacgtaaacccctacgttaacccgaaccgttaccggtacccttaaccgtacggtacccgttaagggttaaactttacgtttacgtaaccttaacgtttacttagtcgtacgagtcgtacggtactaccgttccgttcccgtaccgtacggttccggacgggtacggtacgagggttacgacgtataaacgtcgtaacggtcgcgtacgtcaccctatctcgttactcttcncttccgtac

SEQ ID NO: 293793 - DNA, 576 bp, Homo sapiens
  misc_feature: GYAE6OF01BP72L.48.1.A01.1.454.CMB.1.raw
  modified_base (269)..(269): a, c, t, g, unknown or other
  misc_feature (269)..(269): n is a, c, g, or t
  modified_base (399)..(399): a, c, t, g, unknown or other
  misc_feature (399)..(399): n is a, c, g, or t
  modified_base (533)..(533): a, c, t, g, unknown or other
  misc_feature (533)..(533): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctcatcttccgtgtctgcttctgtcggagacagatcactatcacttgtcgggcgagccaggtatgttactccttattacgccttggtatcagcagaaaccagggaaacnccccgaagctacctaattttcgctgtctccagtttgcagagtgagtccatctcggttcaggcgacaggtgagtcgtgggcagtagtctattctacacatacaactacgccttcgacgtccttagaacgtntttacgactaactttacgttaattcgtacgagtacgtagggtacacgtaccgtttccccgtcccgtacgtttccgggacggtaacgggaccggtagggtcggtaaccgtacgtaaaaccgtacgtcggtcggtntcgcactacgttcgtcttacttacccagttcccgtccgtaccg

SEQ ID NO: 293794 - DNA, 683 bp, Homo sapiens
  misc_feature: GYAE6OF01B6RES.48.1.A01.1.454.CMB.1.raw
  modified_base (481)..(481): a, c, t, g, unknown or other
  misc_feature (481)..(481): n is a, c, g, or t
  modified_base (586)..(586): a, c, t, g, unknown or other
  misc_feature (586)..(586): n is a, c, g, or t
tcagagtatacatacacgaccggtgctcgatttagacgtctcatcagggggagtcagacccagtcaggactcagcatggacatgagggtcccccgctcagctcctggggctcctgctgctctggttcccaggttccagatgcgacatccagatgacccagtcctccattcttccgtgtctgtcttctgtcggagacagagtcactatcacgtttggtccgggcgacgtccaggtattgtttacggttccccttaagttacgcccgttaggtactcgaagacaacggaaaacccgaagggaaaccggacccccgaagtccttaccttactttcgcttcgtcttccgtagtttcgcgaggtacggtggacgtaccctagttccgtcggttcacggtcggacgtaggtggacgtcggtgggtacgtagtagttcctagttctcccaacgtacacaacgtactcccttcgacgtctaggtaagtntttacgaacctacgtttacttagtttatcgtaggcgtacgggtactaccgttccgttttaccccctcccgttaaccgggtttccgggacgggttaccgggaccgnggggtacggaaccgtaccgtaaaccgtacggttggtccggtactggaccctacttacgttcgttcgttacttcccgtaccttcccgttcccggtacc

SEQ ID NO: 293795 - DNA, 726 bp, Homo sapiens
  misc_feature: GYAE6OF01EJEE3.48.1.A01.1.454.CMB.1.raw
  modified_base (400)..(400): a, c, t, g, unknown or other
  misc_feature (400)..(400): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatcgacccagtcctccattccttccgtgtctgcttcgtaggtcgagacagagtcactatcacttggtcgggcagccgtaaggtattgttaacgtcccttaattacgtcctggtaatcgacgacaaagaaaaccgaaggggaaaccaccccggtaagtcctaccgtttaattttccggacttgtaccttccgtagtttcgagacgtagtcggacgttccagtcgtacgttcagcgacgagtgtattcggnggactagtagttacacgtttcctacaccaattaccaacgtacgtacccttacgaccgtaccgttaagtaacgttacgttttacgtaaccttaacgtttaactttaacgttacgttacgaacggttcggtaacgggttacgaacccgtttaccgtttccccgtacccgttaccggttttaccgggaccggggtaacgggaccgggtagggtacgggtaaaccgtaacggtaaaaccgtacgttacggtacggtacctacggtaccgaaccctaacggtttccgttacgttaccctttaccgtaccgttccccgttccccggtaaccc

SEQ ID NO: 293796 - DNA, 843 bp, Homo sapiens
  misc_feature: GYAE6OF01CSYHG.48.1.A01.1.454.CMB.1.raw
  modified_base (489)..(489): a, c, t, g, unknown or other
  misc_feature (489)..(489): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccatccttccgtgtctgtcttcgtgtcggagacagagtcactatcacgttggtcgggcgagccgtaggtattggttacgtccctttagtacgtccgttaggtatcgagaccgaagaaaaccgaagggaaaccgccccgaagtccgttaccttaagttttccgcttcgttcctaccgtaggtttgaccgtaaggtacggtacgggtacgttaccccgtagttccgttccggttacgacggtccggacgtaacgggtggtaacgtcggtcggggtaccaggttacgttccttaacgtttacccaccgtaaccgtactaccgtaaaccncgttacccgtttacgaccgtcccgttaaggttaacgtttacttttacgaacccgtttaaacgtttccgttaaagtttaccggtactaaccgggtacggtaccggggtttaacgtaacccgttttacccgggtttttaccccccaccccggtttaaccggggttttcccggggaaccgggggttaaccgggtaaccccggggttacggggtaaccggggttaaccccgttaaacggaaaaacccgggttacgttccgggggtaccggtacgttaaccccggtaaccgttaacccgttcgtttccggttaaccgtttcccttaacccgtaccgttccccgttaacccccggtaccg

SEQ ID NO: 293797 - DNA, 750 bp, Homo sapiens
  misc_feature: GYAE6OF01BXNIZ.48.1.A01.1.454.CMB.1.raw
  modified_base (733)..(733): a, c, t, g, unknown or other
  misc_feature (733)..(733): n is a, c, g, or t
tcagagtatacatacacgaccggtgctcgatttagacgtctcatcagggggagtcagacccagtcaggactcagcatggacatgacgggtccccgctcacgcctccgtggggcctcctgctgctctggtcccaggttccagatgacgacatccagatcgacccagtcctaccattccttccgtgtctcgtcttcgtcgtcggagacgaggacgtacactactccgtacggttcgggtccgggacgacggacctagggtacgttacggtttaccgttccccttaagttaccggccgttagggtactacggaacgaaccgaaacggaaacccggtaacggggaaaccgaccccgtaagtccccttaaccgtttaacgtttccgcgttacgtcctacgtagtttcgacgtaggtacggttcggaccttaccgtacgttccgttaccggtacgacggcggagtaggtaggtacgtcggtcggactagtcgtactacgttcaccaactctacgactcgtcttacgactacgtagtacgtttacgtaccgacttaacgtttctagttaccggtacaacgggttacgtacgggttaccttaccgtcccggtttaaccccttaccggtaccgggtttcggggaaccgggttacggtaaccgggtagggtacccggtaacgtaacccgtaaacggttaccgtggtacgtccgtacctacgtctacgttcgttcgtacttacncccgttccgttcctacg

SEQ ID NO: 293798 - DNA, 711 bp, Homo sapiens
  misc_feature: GYAE6OF01CMERU.48.1.A01.1.454.CMB.1.raw
  modified_base (236)..(236): a, c, t, g, unknown or other
  misc_feature (236)..(236): n is a, c, g, or t
  modified_base (669)..(669): a, c, t, g, unknown or other
  misc_feature (669)..(669): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttcgtgtctgtcttcgtgtcggagacaggagttcactatcctagttcggtcgggcgaagccgaagggtnttcggttacgttccctttaagttacgccttggttactcgaggtacaaggaaaccgagggaaaccgaccccgaagtccttacttaacttttcggcttacgtcctctagtttcgacgtaggtacgtaggtacgtcccctagttccggttaccggttacacggtccgggtacgtagggttacgggacgttcgggtcgggtacgtaggtacgttcgtactttaccgactaacctagtaccaacgtactcccgttacgtaacgtccttaaggttaaacgtttacgtttacgaacctttaacgttacgttatacgtcgaaggtacgttaggtaccgtacgttacccgttcccgttacccgttaggtttaccggggaccgtacgggtaaccggtaggggtaaccgtacggtaaacgtaccggtagtacgggtcgtacgtnacccgtcgttacgtcttcgtccttatccttcccgtacgtccg

SEQ ID NO: 293799 - DNA, 579 bp, Homo sapiens
  misc_feature: GYAE6OF01DB4YX.48.1.A01.1.454.CMB.1.raw
  modified_base (190)..(190): a, c, t, g, unknown or other
  misc_feature (190)..(190): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (352)..(352): a, c, t, g, unknown or other
  misc_feature (352)..(352): n is a, c, g, or t
  modified_base (368)..(368): a, c, t, g, unknown or other
  misc_feature (368)..(368): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcgganacagagtcactatcacttgtcgggcagccaggattggttacgtccttattagcctggtatcagcagaaaccagggaacgcccgaagctaccgtaattttcgctgtctccagttgcagngtgagtcccatctcggtcagcgcagtgatcgngggcagagttcncgttctcacatcaacngccttacgagacctagtaacgttattttcgactaaacttactattagtcaggtcagggtctacgtacgtttcccctacccgtaacgtttccgggaccgggtaggggacccgtaggggtacggaaccgttacgaaaacgttaaccgtgggtcggtccgtcgacacccgtaattccttcggttaccttactaacgtttcccgtccccgtaacc

SEQ ID NO: 293800 - DNA, 315 bp, Homo sapiens
  misc_feature: GYAE6OF01CI44Q.48.1.A01.1.454.CMB.1.raw
  modified_base (154)..(154): a, c, t, g, unknown or other
  misc_feature (154)..(154): n is a, c, g, or t
  modified_base (228)..(228): a, c, t, g, unknown or other
  misc_feature (228)..(228): n is a, c, g, or t
  modified_base (243)..(243): a, c, t, g, unknown or other
  misc_feature (243)..(243): n is a, c, g, or t
  modified_base (268)..(268): a, c, t, g, unknown or other
  misc_feature (268)..(268): n is a, c, g, or t
  modified_base (275)..(276): a, c, t, g, unknown or other
  misc_feature (275)..(276): n is a, c, g, or t
  modified_base (278)..(278): a, c, t, g, unknown or other
  misc_feature (278)..(278): n is a, c, g, or t
  modified_base (281)..(315): a, c, t, g, unknown or other
  misc_feature (281)..(315): n is a, c, g, or t
tcagagtatacatacacgaccggtgctcgatttagacgtctcatcgaagggaaggaagggcaatggatccgggacagatttcggctcaccatcagcagtctacaacctgaagattttgcaacctacttctgtcaccaggcttaacaattccccncgacgttcggccaagggaccaaggtgaagtcagacgaactgtggctgcacatctgtcttcatctcccgcattcngatatgtaactactntggagcgggctgggccaaagggtcnctaatgnnangcnnnnnnnnnnnnnnnnnnnnnnnnnnnnnnnnnnn

SEQ ID NO: 293801 - DNA, 696 bp, Homo sapiens
  misc_feature: GYAE6OF01C1E0O.48.1.A01.1.454.CMB.1.raw
  modified_base (174)..(174): a, c, t, g, unknown or other
  misc_feature (174)..(174): n is a, c, g, or t
  modified_base (457)..(457): a, c, t, g, unknown or other
  misc_feature (457)..(457): n is a, c, g, or t
  modified_base (476)..(476): a, c, t, g, unknown or other
  misc_feature (476)..(476): n is a, c, g, or t
  modified_base (543)..(543): a, c, t, g, unknown or other
  misc_feature (543)..(543): n is a, c, g, or t
tcagagtatacatacacgaccggtgctcgatttagacgtctcatcgagggggagtcagacccagtcaggactcagcatggacatgacgggtccccgctcagctccgtggggcctcctgctgctctggttcccaggttccagatcgacgacatccagatcgacccagtcctcctnttccttccgtgtcttcgtccgtttacgtcggtacggaacgaccgacggtacgttccaaccttaacgttccgttacggtttcgggtcggggacgaacggaccgtaggttacgttcggtttaacgttccgtttaagtacggtccgttaagggtactacgacgaaacgaaacggaaaccggaacggaacccgtacccgtaacgtaccttacgttaacgttttccgcttacgttctacgtattcggactggtacgtcgacctcgtatccgtcgtgacggcgtgaggntagtcggtgggatacggtntaccacgttccactaactacacaacgtctcgtacgacgtacgagttagtttctacgtactacgtttntagttcgagacgtagtacggtactaccggtttccctaccggtccgttaacgggtcggcgggaacccggtggtacgggactacgaacgtaaccggtgtcggtcgtgaacctctacgttactccttacgacgtttccacccgtttcgcccgttac

SEQ ID NO: 293802 - DNA, 732 bp, Homo sapiens
  misc_feature: GYAE6OF01C3V63.48.1.A01.1.454.CMB.1.raw
  modified_base (105)..(105): a, c, t, g, unknown or other
  misc_feature (105)..(105): n is a, c, g, or t
  modified_base (186)..(186): a, c, t, g, unknown or other
  misc_feature (186)..(186): n is a, c, g, or t
tcagagtatacatacacgaccggtgctcgatttagacgtctcatcagggggagtcagacccagtcaggactcagcatggacatgagggtccccgctacagctccnggggctcctgctgcgtctggttcccaggttccagatgcgacatccagatgacccagtcctccatcttcgtgtctgcttcgngtcggagacagagtcactagtcactggtcggcagcctaggatgtacgtccttatagcctggtatcacgacagtaaccagggaaacgaccccgagacctacgttaactttccgacgtcggtccgtacctaggtttcgactaacggtagggtggtaacgttcccccaagtccgttacgggttcaacggtcgggtaccaaagggttggaacgtccgttaaggggaccgtaaggacggtttccgaagtttcctaaccgtaacccaacttaacgaaccctaacgggtaccctttaccgacgtacccggtaagtaacgtaacgttttagacctaacgtttaaccgttagttagtcgtaagacgtaaggggtctaacgtacggtttacccctacccgttaaccgttaccgggacgggtaacgggaacccggtacggggttaggtaaccggttaacgaaaccggtaaaccgtcggtaacgggtacgttcggaaacctacccgtaaccgttacgttccggtttaccttacgtaccctccgtttcccccggtaacg

SEQ ID NO: 293803 - DNA, 651 bp, Homo sapiens
  misc_feature: GYAE6OF01CQLN8.48.1.A01.1.454.CMB.1.raw
  modified_base (191)..(191): a, c, t, g, unknown or other
  misc_feature (191)..(191): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctcatcttccgtgtctgtcttcgtgtcgganacagacgtcactatctacgttggcgggacgagccgaggtattcgttacgtccctttattacgtccttggtactcagacaaaggaaaccgagggaaacgccccgaagtccttaccttaattttcgcttacgtcctacgtagtttgcgtagagtcgactccagttcgtcggtacaggcganagtggatcggngggactagtacgttctagttcaccactactacaacgcgtaccttcgacgtcgtagtaacgtttactttacgaccttaacgttacgttactttcggtactagggtacgtaagggttaccgtaacgtttcccgtttaccccttaccggtttaaccgtttcgggaccgggtacgggtaccggtaggggtaccgtacgtaaccgaaacggtcgtaggtacggtcgtacggcctacgtcgttcttcggttccttaccgtcttcccggttctaccg

SEQ ID NO: 293804 - DNA, 678 bp, Homo sapiens
  misc_feature: GYAE6OF01CCBH5.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcacatccagatcgacccagtctccatcttccgtgtctgcttcgtcgtcggagacgagacgtactactactcgtacgttcggtcgggacgacgccgaaggtatttcgttacgttacccttagttacgtccgtggtactcaggacaaacggaaaccgagggaaaccaccccgagtaccttacttaagtttccgcttgtctaccgtagttgacaggtagtcggccgtaccctagttccgtcggttacacggtcgcgtaggtggtacgtcggtgggactagtacgttctacgttcacctaccgtaagtaacctacgtacctcctacgaccgttcgtaagtaactttacgtttacgtaaccttaactttacgttaacgtcgttaacgacggtaggtacggtacctaacccgtttcgttccccccgttacgtacccgggttcggaccgggacggtaccggtaggtaccggaccgtaacgaaacgtcggtgtaccggtcacggtccacgtacgttcgtacttacgttctacccgttctcccgtac

SEQ ID NO: 293805 - DNA, 858 bp, Homo sapiens
  misc_feature: GYAE6OF01BAYE1.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctggtcggagacagagtcactatctacgttggtcgggcgagccgaggtattggtttacgtccctttaagttacggccgttaggttactccgaacgaccgaaacggaaaaacccgaacgggggaaaccgacccccgtaaaggtccctttaaccgtttaactttttccggccttcggttcccgttacccgttaggtttttacggaccgtaagggtacggttacggggtacccgttacccctaagtttccggtttaaccgggttccgaacgggtccgggtacgtaagggtcggtacgtcgggttacggggactaaggtacgttactagtttcctaccaacctagttaccaaaccgtcgtcccctttacgacgtaccgttaagtaagtttactttaccggaacctttaaacggtttactttagttaccggttacgaacggtccgggtaagggttcccgtaaccgttttaccccggttttaccccccgttaccccgttaaccggggtttcccgggggaaacgggtaccggggtaacccgggttaggggggtaaccgtaacccgggtaaaccgtaaaacgggtacccggttagggtccgggttacctcgggaaacccttacccgttagtttccggttacccttacggttttacccaactttttcccccgccccgttaaccgg

SEQ ID NO: 293806 - DNA, 771 bp, Homo sapiens
  misc_feature: GYAE6OF01BOUVJ.48.1.A01.1.454.CMB.1.raw
  modified_base (170)..(170): a, c, t, g, unknown or other
  misc_feature (170)..(170): n is a, c, g, or t
tcagagtatacatacacgaccggtgctcgatttagacgtctcatcgagggggagtcagacccagtccaggactcagcatggacatgacgggtccccgctcagcctccgtggggctcctgctgctcgtggttccgtaggttccagatcgcgactagtccagactacgaccncgtctccattccttcgtgtctcgtcgttgtcggtcggagacgagtagtacacttagtcgtacgttcggccggacgacgccgaaggtacgtttacgttaccgttaccttagttacgtaccgttggtactacgacgacgaaacggaacgaacgggaaccgacccgaggtaccttactttaccggttcgacgtacgttaccttgtacgttcgagtaaggtcggtacgtacctaccgtcgtccggttacggtacgacggccgtagtacgggtacgaggttcgggttacggaccgtaggttacgttactaccgttactaccgaaccttcgaaactacgtactacgtacgtcgtacgtacgtacgtattacgtactacgtacttactacgtacgtacgtacgtaggtaccgtcgacccgtttttttttttacccgaccgttaccggtaccgggtaccgggtaccgggtaacggacggttaccgggtaaccgtaacggtaaaccgtacggtacgggtaccggtaccggtacggttacccggaccgttaacgttaccgttaccggtttaccgttacccgtacccggtttacccgttcccgttaacccgg

SEQ ID NO: 293807 - DNA, 884 bp, Homo sapiens
  misc_feature: GYAE6OF01A0HVL.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtcctccatcttccgtgtctgtcttctgtcggagacagagtcactatctacgttggtcggacgacgccgaaggtattcgttacgtccctttaagttcgtccttggtaactcgagacgaaacggaaaccgaacgggaaaccgaccccgaagtccttaccttaagtttccgacttcgttacctccgtagtttcgacgtaggtacggtacggtaccgtccctaacgttccgtacggtttccgacggtaccgggtccgtaaagggttcggtacggtttacggggtacggggtaccgtaaggggttaacccgtttacttaccggtttacccttaacccgaaacccttaaccggtaacctaaacccgttaccgttaccccctttacgtacccggttacccggtttaagggttaaaccgttttaaccgggtttttaacgtaaaccctttaaaccgtttttaacgtttacgtttaacgggtaccgtaacggtacccgggtttaacgggttacccgttaaccggtttaccccggtttttacccccttaccccgggtttaccggggttttaccgggacccggggtaaaccggggtacccgggtaacggggttaccggtaaaccgttaaccgggtaaaaccgttacgttcgggtacggtacgtaccggaccgtaaacccggtactttcgttaccgtttaccgttaaccgttccctttccccggtacccgttacccg

SEQ ID NO: 293808 - DNA, 775 bp, Homo sapiens
  misc_feature: GYAE6OF01EAKC1.48.1.A01.1.454.CMB.1.raw
  modified_base (313)..(313): a, c, t, g, unknown or other
  misc_feature (313)..(313): n is a, c, g, or t
  modified_base (320)..(320): a, c, t, g, unknown or other
  misc_feature (320)..(320): n is a, c, g, or t
  modified_base (481)..(481): a, c, t, g, unknown or other
  misc_feature (481)..(481): n is a, c, g, or t
tcagagtatacatacacgaccggtgctcgatttagacgtctcatcaggggggagtcagacccagtcaggactcagcatggacatggacgggtccccgctcagctccgtggggctcctgctgctctggttcccaggttccagatgcgacactccagactcgaacccagttcctcctattccttccggtgtctgtcctttcgtggtcggagacaggactcaacttactctacgtttcgggcgggcgacgccgaggtattcgttacgttaccttattacggctaggtatcagacgaacgaaaccgaacgggaaccncccgaanccttacctttagtttccgcttcgttctacgtagttcgactaggtacgtcggacctcctacgttcgtcggtaccacggtccggtatagggtggtacgtcgggtaggggactagttacgttctacttccgtaccactactaaccgaacgttaccgtccttaanaccgggtacttaaggttaacgtttaacgttttccgaaaccttttaacgtttaacttacgtttacggtactaccggggtaacggttacggggttaaccctaaccggtttcccgttttacccccacccgggtttaccgggtttaccggggggaacggggaccggttaaaccgggtacgggttcggtaaaccgttaaccggtaaaaccgggttacgttggggacccgttgtaaccggtcccaaccgggtttattcccgtttacgtttcctaaccccgttctttcccccgtaagtccg

SEQ ID NO: 293809 - DNA, 663 bp, Homo sapiens
  misc_feature: GYAE6OF01BWJ5Y.48.1.A01.1.454.CMB.1.raw
  modified_base (94)..(94): a, c, t, g, unknown or other
  misc_feature (94)..(94): n is a, c, g, or t
  modified_base (191)..(191): a, c, t, g, unknown or other
  misc_feature (191)..(191): n is a, c, g, or t
tcagagtatacatacacgaccggtgctcgatttagacgtctcatcagggggagtcagacccagtcaggactcagcatggacatgagggtccccnctcagctcctggggctcctgctgctctggttcccaggttccagatgcgacatccagatcgacccagtctccatcttccgtgtctgcttctgtcgganacagagtcactatctacgttgcgggcgagccgaaggtattgtttacgtcccttagttacgtccgttggtatcagaccaagaaaacccggaagggaaacgaccccggaacgtaccttaccgttaattttccgtcttacgttctcctagtttgacagtaggtagtacgtccctagttccgtcggttacgacggcggtgtacggtggtacgtgtacggggactagtcgttctactttaccacgtaaccataacctaacgtcctacccttacgactcgtaacgtaagttctttacgaacttaacttcgttaagtcgtcacgtacgtacgggtacttacgtccgtttaccccgtcgtaccggttcgggacggtacggtaccggtaggggacttaacggacctaaacggtacggttcggcggtacctagtccctaccgtactcgttcttccttacctactttccccgttcccgtaccg

SEQ ID NO: 293810 - DNA, 725 bp, Homo sapiens
  misc_feature: GYAE6OF01DUERA.48.1.A01.1.454.CMB.1.raw
  modified_base (512)..(512): a, c, t, g, unknown or other
  misc_feature (512)..(512): n is a, c, g, or t
tcagagtatacatacacgaccggtgctcgatttagacgtctcatcagggggagtcagacccagtcaggactcagcatggacatggagggtccccgctcagctcctggggctcctgctgctctcggttcccaggttccagatgcgacatccagatcgaccctacgtcctcctattccgttccgtgtcctggtcctttcgtcggtcggaacgacgagacgtactactactctacgttggtccgggcgacgcgaggtattcgttacgttccttagttacgtcgtaggtactacgacgacgaacgaaaccgaacggaaaccgacccgtagtccttacttagtttccgacttcgtcctacgtacgtttcgacgtaggtacgtacggtactccgtagttccgtacgtacgacggcggtacgtagggttcgacggttcgggtagggactaggttacgtactacttacacctacctacgtacctacgtacgtccctacgtactcgttaagttaacgtttntttaccgaacctttacgtttacttagttacacgtaggtacggtacggttacctaccgttcccgtttacccgtccggttaccgggttacgggaccgggtaacgggtacggttacggggtaacgtaacccggttaaaggacggttcgtacggtaccacgaccgtaccttacgttcttacgttacctacttacccttcccgtaacccgcgttaacg

SEQ ID NO: 293811 - DNA, 744 bp, Homo sapiens
  misc_feature: GYAE6OF01BX8Z1.48.1.A01.1.454.CMB.1.raw
  modified_base (454)..(454): a, c, t, g, unknown or other
  misc_feature (454)..(454): n is a, c, g, or t
tcagagtatacatacacgaccggtgctcgatttagacgtctcatcagggggagtcagacccagtcaggactcagcatggacatgacgggtccccgctcagctccgtggggctcctgctgctctggttcccaggttccagatgcgacatccagatcgacccagtcctaccatccgttccgtgtctgtcttcgtggtcggagacaggtacgtcactatctagttcgggtcgggcgacgccgaggtattcggttaacgtccctttaattacgccgttaggtactcgagacaacggaaaaccgagggaaaccgccccgaagtcctactttaagttccggcttccggtcttaccgtagtttcgacggtaatagggtacgacgtacctagtccgttacggtacgacggtccggactagggtagggtactccgggtagggctaggtaacgttctacttacncctaaccacttaagaaccctaggtccttacgacgtacctaagggtaactttacgttacgtaacttaacgtttaacttaacgtttcgtaacgtacggacggtagggtaccttaacgtttcccgtttccccggttaccgttaccgttaccgggggacgggtaaccgggtaacggtacggggtaacgaaccgggttaaccgtaaaccggttaccgttacgggtacgtccgttccggacttaccccgtcgttacgttcctacggtttacctccgggttcccccttaccggtacc

SEQ ID NO: 293812 - DNA, 758 bp, Homo sapiens
  misc_feature: GYAE6OF01DD0O5.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttcgtggtcggagacagacgtcaactatctacgtttggcgggcgagccgtaggtattcgttacgttccctttagttacgtccgtggtactcgagaccaaacggaaaaccgaacgggaaaccgacccccgaagtccttacctttaacgttttccggcttcgtccttaccgtaggtttacgcgtaggtaggttacggacgttacccacgttccgttaccggttacgacggtcggtacgtaggtagggtacgttcgggtaggggactaaggttacgttactacgtttcctacaaccgtacttaccaaccgtaccggtaccctttacgaaccgtaccgtttaaggtaaacgtttacttttacgaacctttaaccctttaacgtttacgtttcgtacgtacggtacggttaacgggttcgtaacccgtttaccgtttccccgttaccggttaccggttcgggacgggtaacgggtaccggtagggtacggtaaccgtaacgaaaccgtcggtacgtacggtcctacgaccgtaccttacgttccgttacgttacccttacgtacctttcccgtacccgtaccg

SEQ ID NO: 293813 - DNA, 851 bp, Homo sapiens
  misc_feature: GYAE6OF01EQRZ5.48.1.A01.1.454.CMB.1.raw
  modified_base (99)..(99): a, c, t, g, unknown or other
  misc_feature (99)..(99): n is a, c, g, or t
  modified_base (146)..(146): a, c, t, g, unknown or other
  misc_feature (146)..(146): n is a, c, g, or t
  modified_base (152)..(152): a, c, t, g, unknown or other
  misc_feature (152)..(152): n is a, c, g, or t
tcagagtatacatacacgaccggtgctcgatttagacgtctcatcgagggggagtcagatccagtcaggactcagcatggacagtggacgggtcccccntcagcctccgtgggcctccgtgctgctcgttcggtcccaggtccagntgcacncgtcagacgtaccgaccctatccctacctacgtttcccgttaccgtgtcttcggttcctttcggtcgggtaccggagtaaccgaggtactacctacttaccgtaccttcgggttcgggacgggaccgacggaccggtaaggtcgtttacgtttaccgtacctttagtaccggtcgttagtacaccggaacgaaccggaaacggaaccggggaacgggaacccgtccccgtaagttaccctttaccgttttacgttccggtcttacgtttccgtaccggtttagttaccgacggtaacgtccggtaccggttccgtacccttagttccgggttaccggacgaccgggtaccggagtttacggggtacgttacggcggttaacgggacttaacgttcgttactaccgtcctaacctacctaaccgtaacctacgtaccgttaccgtaacgtccgttacgttaacgttaacgttacgtttaccgtaactttaacttacgtttacgtacgtccggacgtacggtaccggtaccgttacccgttacccggttcccggttaccggttaccggttacccgggcgggtaaccggggtaccggtacgggtaaccgtaaccggttaccggaacggttcggtcggtacgtaccgtaccgtaccgtaacctcggttccttaccgttacttccgttcccgtcccgttacccg

SEQ ID NO: 293814 - DNA, 752 bp, Homo sapiens
  misc_feature: GYAE6OF01EVKFS.48.1.A01.1.454.CMB.1.raw
  modified_base (706)..(706): a, c, t, g, unknown or other
  misc_feature (706)..(706): n is a, c, g, or t
tcagagtatacatacacgaccggtgctcgatttagacgtctcatcagggggagtcagacccagtcaggactcagcatggacatgacgggtccccgctcagctccgtggggctcctgctgctctggttcccaggttccagatgcgacatccagatgacccagtctccatcttccgtgtctgtcttgtggtacggagacagagtcactatctacgttggtcggacgagccgaggtatcgttactcccttaatacggcctaggtactcagactaacgaaaccgaggggaaaccgccccgaaagtccttaacttaagtttcgacttcggtcctacgtagtttcgacgaggagtcggacgtacctaattccgtacggttacgaggcgtacgtaaggtggtacgtcggtggggactagttacgttactaccgttacaacccgtaactaacgtaaccgtaaccgtaccgtttacccgtaacgtacgttaacgtaagttaaacgttttacgttaaccgtaaacctttaacgtttacgttaacgttacgaacgaacggtaccggttaggtaccttaacccgttaacccgttttcccccgtaaccggttaccggggttacgggaaccggggttaacggaaccggtaggggtaacccgtaaacgtaaccgtaaaacgggtcgttaacgggcgttaacgaccctaacgtaacccgttnttaccgtttacgtaccttaacccttacccgtccccgtacctaaccg

SEQ ID NO: 293815 - DNA, 860 bp, Homo sapiens
  misc_feature: GYAE6OF01A7NLH.48.1.A01.1.454.CMB.1.raw
tcagagtatacatacacgaccggtgctcgatttagacgtctcatcagggggagtcagacccagtcaggactcagcatggacatgacgggtccccgctcagctccgtggggctcctgctgctctggttcccaggttccagatgcgacatccagatcgacccagtctcctattcgttccgtgtctgtcttcgtgtcggagacagactcactatctacgttggtcgggacgacgccgtagggtattcggttacgttcccttagttacggtccgttaggtactacggacgacgaaacggaaaccggaaggggtaaaccgaccccggtaagtacccttaccgtttaaagttttccggacgtttccgttaccgttacccgttaggtttaccacggtaacggtacggttacgggtaacccttaccccgttacgttaccgttccgggtttaccgacggtaccggtacggtacgggtagggtaaccggttcggggtacgggggtaactaacgggttaaccgggtttaaccttaccgtttaccctaacccgtaaacccggtaagtaacccgtaaacccggtcgtttaccccgtttacggaaccgttacccggttaaggttaaaacggtttaccttttaccggtaaacctttaacgtttaactttacgggttaccgtaccggtaacgggtcgggttaaccgggtttacttaaccccggtttacccgtttaccccgttaccgttaccgggttacgggtaaccggggacggtacccgggtaggggtaccgtaacgtaccgaaaggttccgtacggtcgtacgtcgaacccgccttaggtccttacggttcctaccttcgtccctcccggtaac

SEQ ID NO: 293816 - DNA, 686 bp, Homo sapiens
  misc_feature: GYAE6OF01CUL5U.48.1.A01.1.454.CMB.1.raw
  modified_base (183)..(183): a, c, t, g, unknown or other
  misc_feature (183)..(183): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgccttntgtcggagacagagtcaactatctagttggtcgggcagccaggatgttacgtcccttattagcctggtaatcagacagaaaaccaggggaaacgaccccgaagtcctaccttaattttcgcttacggtcctccgtagtttcgcgtagacggtggacgtccccagtccgtcggttcaggtcgacgaggtcggagtcgtggggacaggttacgtctaacttcctactaaccgattaccaaaacgtacccggtcccttaacgacggtaacccgtaaggtaacggtttaacttttacggaacctaacttaacctttagttcgtacaccggtagtacggggtactaccgttaacgtttcccccgtaacgttacccggtttcgggacggtaaccggggacccgtaggggtaccggaacgttaaccgaaaacgtaccggttggtaaccggtgtacgtaaccctacgtacttcgttacgttacgttcctaaaccgtccttcccggtaaccc

SEQ ID NO: 293817 - DNA, 704 bp, Homo sapiens
  misc_feature: GYAE6OF01AJNRL.48.1.A01.1.454.CMB.1.raw
  modified_base (194)..(194): a, c, t, g, unknown or other
  misc_feature (194)..(194): n is a, c, g, or t
  modified_base (379)..(379): a, c, t, g, unknown or other
  misc_feature (379)..(379): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatccttccgtgtctcgtcttctcgtcgganacagagtcactatcacgttgtcgggcgagccagggatgttacgtccttatacgccttggtatcagcaagaaaccgagggaacgccccgagctcctaatttcgctgtctcctagtttgcagagtggacgtcccatcgtcggttcagcgcagtggactcgtgggcaggtagtctattcctcacctanacctaacgacgtccctttacgacgtacccttggtaaacgttcttttacggaaccttaacctttaccgttagtttccggtaccgaggtaccggtaagggttaccgtaaccgtttaccccggttttaacccccgttccccggttaaccggttttcccgggggaaccgggtaaccggggttaacccggtacggggggttacggtaacccggtaacgtaaaaacccgggtaacgttacgggtccggtaccggtacgtacccgtacccctaatttcccggttaccgtttccctttaccgtcccgtttcccccgttcccccggtaaacccg

SEQ ID NO: 293818 - DNA, 654 bp, Homo sapiens
  misc_feature: GYAE6OF01D233Z.48.1.A01.1.454.CMB.1.raw
  modified_base (192)..(192): a, c, t, g, unknown or other
  misc_feature (192)..(192): n is a, c, g, or t
  modified_base (609)..(609): a, c, t, g, unknown or other
  misc_feature (609)..(609): n is a, c, g, or t
tcagagtatacatacacgaccggtgctcgatttagacgtctcatcagggggagtcagacccagtcaggactcagcatgggacatgagggtccccgctcagctcctggggctcctgctgctctggttcccaggttccagatgcgacatccagactgacccagtctccatcttccgtgtctgcttctgtcgganacagagtcactatctacttggtcggcgagccaggtattgttacgtcccttagttacgtcctggtatcgagacaacgtaaaccgagggaacgccccgaagtctaccttaatttcgtactgttcctcctacgtttagacgtaggtacgtggtaccgtcctacttccgtccggttcgacggtcggtcaggtggtacgtcggtagggcaacggtctacgtacttccgtacaaccgtactacgaaccacgtcccttacgacgtaccgtaagtaacgttatttcgacttaacgtttacgttacttgtaccacggtacgtacgggtactacccgtaccgttttcccctaccgttaccgggtttccggaccgggtaacggacggtacggggtcgtaaccggtacgaaacgtacgtcgggtcgtancggtccaaccgtgttcgtcttacttaccgtccttccgtcccgtac

SEQ ID NO: 293819 - DNA, 784 bp, Homo sapiens
  misc_feature: GYAE6OF01C62YJ.48.1.A01.1.454.CMB.1.raw
  modified_base (768)..(768): a, c, t, g, unknown or other
  misc_feature (768)..(768): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctcatctccgtgtctgtcttctgtcggagacagagtcactactctacgttggtcgggcgacgaccgtagggtattcggttacgttacccttagttacgaccgttggtaactccgagaccaacggtaaaaccgaacggggaaaccgacccccgaaagtacccttaccttaagttttccgtacttcgtcctaccgtacgtttacggccgtaaggtacggtacggtaccgttcccgagttacccggtacggtttacacggtcggtacgagggttacggtagttcgggtcggggtataacggttacgtttcgtaactttccgtacctaaaccgtattaaccgaaccgtaaccggttcccctttaaccgtaacggtacccgttaaaggttaacggtttaagtttttaaccgggaaccctttaaaccgttttacgttaaacgtttcggtacggtaacggttaccggtacgggtttaacggtacccgtttaacccgtttcccccgtttaccccgttaccgggttccgggacgggtaacgggtaccggtacggggtacgaacccggtacaaaccggtagtcgcggtcgacgtacactagttaccctgttaccgttntacctccgtcccgtac

SEQ ID NO: 293820 - DNA, 824 bp, Homo sapiens
  misc_feature: GYAE6OF01BP1S0.48.1.A01.1.454.CMB.1.raw
  modified_base (141)..(141): a, c, t, g, unknown or other
  misc_feature (141)..(141): n is a, c, g, or t
tcagagtatacatacacgaccggtgctcgatttagacgtctcatcagggggagtcagacccagtcaggactcagcatggacatggacgggtccccgctcacgctccgtggggctcctgctgctctggtcccaggttccagntgcgactatccgagactcgacccagtcctcctacgttcgttccggtgtactcgcgttcgtggtcggaacgacgaggtacgtctaactactaccgtacgttcgggtccgggacgaacgccgtaaggtattcgtttacgttaccctttagtaccgtccgttaggtactcgaacgacgaaacggaaaccgaggggaaaccgccgtaacgtccttaccgtttattccgtcgtccgttaccttccgttaggtttcgacgtaagggtcggtaccggtaaccttccgtaaggtttccgttaccgggttaccggacgggtcccggtaacggttacgggtacgggttagttcccggggtaaggggacctttaaggttaccgtttacctaggttccctaccgaccgttaacgaccgtactaccgttcctacgacgttacgtaagtaacggtttactaccgttaccgttaagttacttacgttagtaccgacgtttaaggtacgggttaccgtaacgttttccccgttacccgttcccgggttacgggttacccggggacgggtaacccggaccgggtacgggtaaccgtaccggtaacgttaaaccgtaggtcggtacgtacgtacccgaacgtaccgtttaccgttcggtttacccgtactttacccgggaccttttccccggtgttacccg

SEQ ID NO: 293821 - DNA, 903 bp, Homo sapiens
  misc_feature: GYAE6OF01CE3XQ.48.1.A01.1.454.CMB.1.raw
tcagagtatacatacacgaccggtgctcgatttagacgtctcatcagggggagtcagacccagtcaggactcagcatggacatgacgggtccccgctcagctccgtggggctcctgctgctctggttcccaggttccagatgcgacatccagatcgacccacgtcctacctacttccttccggtgtctcgttcttcgtggtacggagtaacgagtacgtacctactactacgtacgttcgggcgggacgacgacggaaggtgtttacggttaccgttccttaagttacgtccgtaggtacgtacaacgaacgtaaaacggaaaccgggaagggaacccgtaccccggtaacgtcctttaccggttaacgtttccgtacgttccttccgtaacttcggttacgaggtaaggtcggtacggtacgtacccctagttcccggttcggtacggacggtccggatcggggtagtaggtacgggtacgggtacgtaggtttaccgttcttacttaccacccgtaactaccgtaacgaaccgtaccgtttaccgtacctacggtacggttaacgttaaaggtttccgtttaaccgtaaaccttttaaccgtttaatttaaccggtttacgacggtaaccgggtaacgggtacgggttaaccccgttaaccgttttccccgtttcccccgggttaaccccgtttacggggggttacccgggggttaaccggggtaccggggtaaccgggttaggggttaaacccgggtaaaccgtaaacccgggtaaacccgggttaaccggtttcgggggtacccgtcgggtttacccgaacccgttaccggtttacctttacccggttaccttttaccccggaagtttcccccttaaccccggttacccgttaccccgg

SEQ ID NO: 293822 - DNA, 844 bp, Homo sapiens
  misc_feature: GYAE6OF01BQ96X.48.1.A01.1.454.CMB.1.raw
  modified_base (831)..(831): a, c, t, g, unknown or other
  misc_feature (831)..(831): n is a, c, g, or t
tcagagtatacatacacgaccggtgctcgattttagacgtctcatcgaggggggagtcagacccagtcaggactcagcatggacatggacgggtccccgctcagcctccgtgggccttcctgctgctcgtcggttaccctaggttccagagtgccgacactccagtactcgaccctagtcctcctagttccttccgtagtctcgttcttcgtggtaccggagaacgagtacgtacctacttactaccgtacggtttcgggccgggacgacggacgtggtactttaggtttaccgttaccttagtacgtccgttagtactacgacgtaacgaaaccggaaaccgggaacggaacccgacccggtaataccttaccgtttacgtttccgcgttaccgttacttacgttggttacgacgtagggacggttacgtacgtacctacgttccgtccgtacgacggcgtacgtaggtagtacggtcggtagggtactaacggttacttactacgttaccgtaccacgtacctaccgtacgtacgtacccgtaccgtaacggttcttaaacggttagtttaacgtttacctaaccgttttaaccgttacgttaggttaccgcgttaggtacggttacggtaccgtttaccccgttttccgtttacccccgttacgggtttaaccggggttaccgggaaccggggtttaccgggaaccggggtaccgtttaaacgggacccctaaaacggttaccgtaaccggtgggtccgtaacgtcgttacctaacccgtttccggtttaccttccggtttaaaccctttcccgacccctttaacccnccccgggttaaac

SEQ ID NO: 293823 - DNA, 795 bp, Homo sapiens
  misc_feature: GYAE6OF01B7FL1.48.1.A01.1.454.CMB.1.raw
  modified_base (139)..(139): a, c, t, g, unknown or other
  misc_feature (139)..(139): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagntgcgacactccagactcgacccagtcctccatccgttccgtgtcctgtccttcgtgtcggagacagacgtcactactcacgttggtacgggcgacgccgaggtattacgtttaccgttaccctttagttacgtccgttaggtactacgaacggaccgaaaacggaaaacccggtaacggggaaaacccgacccccggtaaagttaccccttaacccgtttaacgttttccggccgtttaccgttacccgttaccgttaacggtttcggaacgtaacgggaggttacccgggtaaccgttcccctacgttccggtttaccggtcgtaacgggccggtacgtaaggttcggtaaccggttcggggtacgggacgtaacggttacgtttactaactttacccgaccaaccgttactaaccgaaccgtcgttcccgtaacgtacgtacgttaacgtaagtttacgttactaaccgttacttacgttactcgtacagtacgggtaggttacctactttcccgttaccctacccgttacgggttccgggacgggttaccggtacgggtacggtaccggtaacgtaaccgtaacggagttcggacgtccctacggtccgtaccttacgtcttacgttccgtactaccccgttccgtcccgtac

SEQ ID NO: 293824 - DNA, 720 bp, Homo sapiens
  misc_feature: GYAE6OF01CTS96.48.1.A01.1.454.CMB.1.raw
tcagagtatacatacacgaccggtgctcgatttagacgtctcatcgagggggatcagacccagtcaggactcagcatggacagtgacgggtccccgctcagcctccgtcggggctcctgcgtgctctcggttcccaggttccagagtgacgacactccagactcgacccagtctacctattccgttcgtcgtctgtccttcgtaggtcgacgacgagtacgtacactactacgtacgttgggccgggacgtacggaccgaggtatttacggttaccgttaccttagttacgtccgttaggtactacggacgaacgaaaccggaaaccggaaacggggaaacccgaccccggaattaccttaccgtttacgtttccgtccgttcgttccgtacgttagtcgacgagggtacggtacgtcgttaccctgtaccggttcggtacggcgtacggtagtggtagtcggttcgggacgggtaactagttacgttcgtacttacgtaccacaacgtcaacgtacgtcctagaccgtacgtagtacgttacttacgtacttaacttacgtacttagtacgacggtagtaccgtaccgttcctttaacccgtccttacccgggtacgtccgggacggtacggaccgggtaggtaccgtacgtaacgtacggcgttacggctccttacgaccttacgtcgttactcgttactccttccgtccgtctaacg

SEQ ID NO: 293825 - DNA, 776 bp, Homo sapiens
  misc_feature: GYAE6OF01EPONV.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacactccagatcgacccagtctcctatcttccgtgtctgtcttctggtcggagacaggtacgtcaacttatcctacgttcggtccgggcgacgccgtaggtattacggtttacgttaccccttagttacgccgttaggtactcgaacgacaaaccggaaaccgaacggggaaaccggaccccgaacggtaccttacccttttaacgtttccgtacttcggttaccttccgtaggtttcgacgtaggtaggttacggacgtccctacttccggttacggttacgcggacggtacgaggtcggtacgtcgggtacgggacgtaggttcgttacctagttaccctaccgtacctaacgtaacccgtaactaccggttacccttacggtaccgtacgttaaggttaaacgtttactttaacgaaaccgtttacctttaactttagttacgtacgtacggtacggtacggtaccgttacgtttacccgtttccccttaccggtttaaccgggtcggggtaaccgggtaccgggtaacgggtacggggtaaccgtacggtaaacgtaaccggtacggttcgggtctacggtacgactacccgtattcgttcttaccgttactccttccccgtcgtaaccc

SEQ ID NO: 293826 - DNA, 967 bp, Homo sapiens
  misc_feature: GYAE6OF01C4AG4.48.1.A01.1.454.CMB.1.raw
tcagagtatacatacacgaccggtgctcgatttagacgtctcatcagggggagtcagacccagtcaggactcagcatggacatgagggtccccgctcagctccgtggggctcccgtgcgtcgtctcgttccggttacccgtcggttaccagtcgtcggacgaacctactaccgaagtacgtaccgaacccgtcgtcctacctcgttccgttccgtcgtcgttcgttcttcgtcggtacggaacgacgtagtacgtacctactacgtaccttacggttcgggccggtacgacgtaccgtagttacgttacgttaccgttacgttagtacgttccggttagttacacggtaacgaaccgaaaccggtaaaacggaacgggtaaaccccgcccggtaattccccgtttaacttttacggtttccgtacgttcgttacccgttagtttcggtacgaccggagggtttacggtacggttacccctaacttccgtttaccgggttaccgtacgggaccggttcgggtaaccgttagggttaccggtaccggttccgggggtaagggtacccgtaaagggttttaccctttacccggttaactttaccccggaaccttaaccggaaccctttaaacgtacccgtacccgttaccccgttaacgaccgttacgttaaaggtttacgtttaacgtttacgtaaacccgttttattaacgttttccgaaccggtacggtaaccggttcgggtaaggtttaccccttaaccggttttcccccgttaccccttaaccgggtttaccgggtacggggaaccggaccggttaacggggtaccgtaaccgggtaaacccgtaaacgggtaccggtttacgggtcgggtaaccccgttacgtacgaaacccccttagtttaaccggtttcccgttcccggttttaactaacccccgtttccgttacccccgtttccgaacccg

SEQ ID NO: 293827 - DNA, 850 bp, Homo sapiens
  misc_feature: GYAE6OF01EDV88.48.1.A01.1.454.CMB.1.raw
tcagagtatacatacacgaccggtgctcgatttagacgtctcatcaggggggagtcagacccagtcaggactcagcatggacatgagggtccccgctcagctcctggggctcctgctgctctgggttcccaggttccagatgacgacatccaagtactcgaccctagtcctacctacttccccgtccctgttctcgctacgttcgtgggtagggacgacgaggtacgtaccaaccgttcgtaccgttcgggcccggggtacgacggtacggaacgggtaccttaaactttaaaccgttaagttttaacggttttaccggtaccgtttagggttaactaccggaacgaccgaacggtacctaaccggttaacccggtaaaacggggtttaaaacccgtttacccgtaaacggttcccctttaccgttacggtaactttaccgttaacgttccggtactccggtaccctactttacccgtacgtttacgaccgtaacggtacccggtaccgggtacccttacgttccggttacggttacggagggttccggggtacggtaaggtacgttacgggtacgggtacgtaaggtaccttacgtacccttcgaaccaccttagaccgcgacgtccgtacgtcgacgtaccgtgtaaggacttgtacgtacgtactttaacttagtaacgtataaacgtaacgttccgttaacccttaccggttcccaaccccgttacgtcccggtaacccggttggaaaccccgggtaactaccgggtaactagggttaaacgtaaacgttaacccggttaaacggttacgtccgggtaacgccctacgtaaccccgtcgtttaccg

SEQ ID NO: 293828 - DNA, 870 bp, Homo sapiens
  misc_feature: GYAE6OF01EWF53.48.1.A01.1.454.CMB.1.raw
  modified_base (419)..(419): a, c, t, g, unknown or other
  misc_feature (419)..(419): n is a, c, g, or t
tcagagtatacatacacgaccggtgctcgatttagacgtctcatcagggggagtcagacccagtcaggactcagcatggacatgagggtccccgctcagctcctgggctcctgctgctcttggttcccaggttccaggatgcgacatccagactcgacccagtcctcctattcctttccgtgtctcgtctttcgtggtacgggagacaggatactactactactacgtttcgggtccgggacggacggaccggaggtatttgtttacgttaccctttaattacggtaccgttaggtactcgacgacgaaacgaaaaccggacgggaaaccgaccccgtaatccgttacctttaagtttccgcgttcgttcctaccgtagtttcgacgaggtagttacggcttccagttccgtcggtcgnggtacgagaggttgtacggtcggtagggagtacgttacgttactaccgttccctaaccaccttacgtaaccctacgtacccgtttaccctacgtaccgtacgttacgttaacggtttacttttaacggtaacctttaaacgttttacccttaaggttccgtttaaagtacccgggtacggtttaaacgggttcccgtttaacccgtttacccccggttttaccccgtttacccccggttaaccggggttttccggggggaaaccggggtaaacccgggggttaacccgggtacgggggtttaacggaaaccccgggttaaacgtaaaacccgggttagggtttcccgggttagacccggttaccgttaccccgggtaacctttacggtttaccggttacccggtttacccttaccccgggttaacccgttcccggttcccccttaaaccgg

SEQ ID NO: 293829 - DNA, 495 bp, Homo sapiens
  misc_feature: GYAE6OF02HZQ5C.48.1.A01.1.454.CMB.1.raw
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtgggcagagttcattctcacatcaacagccttcagcctgaagatttgacaacttactattgtcagcagggtgacagtttccctcctactttcggcggagggaccgagggtggacgtcaacgaactgtggctgcacatctgtcttcatcctccgc

SEQ ID NO: 293830 - DNA, 503 bp, Homo sapiens
  misc_feature: GYAE6OF02GWPFS.48.1.A01.1.454.CMB.1.raw
  modified_base (416)..(416): a, c, t, g, unknown or other
  misc_feature (416)..(416): n is a, c, g, or t
  modified_base (502)..(502): a, c, t, g, unknown or other
  misc_feature (502)..(502): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtgggcagagttcattctcaccatcaacagccttcagcctgaagtatttgactaacttactattgtcagcagggtnactagtttccctccctactttcggcggtacgggacctagggtcgacgtacaacgactgtggctgccacatctgtcttcattctccnc

SEQ ID NO: 293831 - DNA, 493 bp, Homo sapiens
  misc_feature: GYAE6OF02GY1R3.48.1.A01.1.454.CMB.1.raw
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagatttgctaacttactattgtcagcagggtnactagtttccctccctactttcggcggagggaccagggtgacgtcaacgactgtgctgcacntctgtctnatctccgc

SEQ ID NO: 293832 - DNA, 509 bp, Homo sapiens
  misc_feature: GYAE6OF02G99NJ.48.1.A01.1.454.CMB.1.raw
  modified_base (430)..(430): a, c, t, g, unknown or other
  misc_feature (430)..(430): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtggggcagagttcattctcaccatcaacagtccttcagcctgaagtatttgctaacttactatttgtcagcagggtgctacgtttcccncctacgtttcggcggagggaccgagggtggacgtacgaacgactggtggctgcacatctgtcttcacttcctcccgtcc

SEQ ID NO: 293833 - DNA, 509 bp, Homo sapiens
  misc_feature: GYAE6OF02HKXNC.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagtatttgactaacttactattgtcagcagggtgactacgtttccctccctacgtttcggcggtacgggaccgagggtcggacgtacaacgactgtggctgcaccatctgtcttcactctcccgtc

SEQ ID NO: 293834 - DNA, 518 bp, Homo sapiens
  misc_feature: GYAE6OF02FX8TX.48.1.A01.1.454.CMB.1.raw
  modified_base (417)..(417): a, c, t, g, unknown or other
  misc_feature (417)..(417): n is a, c, g, or t
  modified_base (505)..(505): a, c, t, g, unknown or other
  misc_feature (505)..(505): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtgggcagagttcattctcaccatcaacagccttcagcctgaagtatttgactaacttacttattgtcagcagggtnactacgtttccctccctacgtttcggacggtacgggaccgagggtcggacgtacaacggaactggtcggctgccacatctcgtcttcncttcctcccgtcc

SEQ ID NO: 293835 - DNA, 523 bp, Homo sapiens
  misc_feature: GYAE6OF02F8U4S.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcgcagtggatcgtgggcaggagttcattctcaccatcaacagccttcacgcctgaagtatttgctaacttacttattgtcagcgagggtgactacgttccctccctacgtttccggcggtacgggaccgtagggtgacgtacgaacgaacgtggtggctgccacctagtctgttccttcacttccttcccgtcc

SEQ ID NO: 293836 - DNA, 519 bp, Homo sapiens
  misc_feature: GYAE6OF02IC0V5.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagtcggcagtggatctggggcagagttcattctcaccatcaacagcctttcagccctgaagtatttgcaacttacttattgtcagcagggtgacagtttccctcccacgttttccggcggtagggacccgagggtcggacgtccaaacgacgtggtggctgaccaccatctagtccttcattcctcccgtacc

SEQ ID NO: 293837 - DNA, 504 bp, Homo sapiens
  misc_feature: GYAE6OF02FWTBS.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtgggcagagttcattctcacatcaacagccttcagtcctgaagtattttagactaacttacttattgtcagcagggtgactagttccctccctacgtttcggcggagggacagggtcgacgtacaacgactgtggctgcaccatctgtcttcactctcccgc

SEQ ID NO: 293838 - DNA, 531 bp, Homo sapiens
  misc_feature: GYAE6OF02GJ41W.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtggggcagagttcattctcaccatcaacacgcctttcagtcctagaagtatttgctaacttactattgtcagcagggtgactacgtttccctccctacgtttccggcggtacgggaccagggtacggacgtacaacgacttggtcggcttggccacctatcgtcgttccttcacttccttccccgtacc

SEQ ID NO: 293839 - DNA, 525 bp, Homo sapiens
  misc_feature: GYAE6OF02FW5HT.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtggggcagagttcattctcaccatcaacagccttcagccctgaagtattttgctaaactttacttaattgttcagcaggtgactacgtttccctccctacgtttcggcgggacgggaccgagggtcgacgtacaacggactggtggacttggccaccatcgtgtccttcattccttcccgtcc

SEQ ID NO: 293840 - DNA, 530 bp, Homo sapiens
  misc_feature: GYAE6OF02HCBZH.48.1.A01.1.454.CMB.1.raw
  modified_base (515)..(515): a, c, t, g, unknown or other
  misc_feature (515)..(515): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtgggcagagttcattctcaccatcaacacgcctttcacgtcctagaagtatttcgactaacttacttattgtcagcagggtcgactcgtttcccctccctacgttccgggcggtacgggaccgagggtcggacgtaccgaacgacgtggtggcctgccaccagtcttgtccttnacttcctcccgtacc

SEQ ID NO: 293841 - DNA, 512 bp, Homo sapiens
  misc_feature: GYAE6OF02HE7PR.48.1.A01.1.454.CMB.1.raw
  modified_base (510)..(510): a, c, t, g, unknown or other
  misc_feature (510)..(510): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtggggcaggagttcattctcaccatcaacagcctttacagcctagaagtatttgactaacttactatttgtcagcagggtgtacagtttcccctcctacgtttcggcggaggccgagggtcggacgtacaacgactggtggctgcacagtctcgtctctactcctcccncc

SEQ ID NO: 293842 - DNA, 648 bp, Homo sapiens
  misc_feature: GYAE6OF02J0LCW.48.1.A01.1.454.CMB.1.raw
  modified_base (222)..(222): a, c, t, g, unknown or other
  misc_feature (222)..(222): n is a, c, g, or t
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
tcagagtatacatacacgaccggtgctcgatttagacgtctcatcaggggagtcagacccagtcaggactcagcatggacatgagggtcccgctcagctcctgggctcctgctgctctggttcccaggttccagatgcgacatccagatgacccagtctccatcttccgtgtctgcttctgtcggagacagagtcactatcactttgtcgggcagccaaggntgttagcccttattacnctggtatcagcagaaaccagggaaagcccgaagctcctaatttcgctgtctcacgtttgctagagtgagtcccatctcggttnagcgcagtggatcgtgggcctagagttcgattcctcaccattccaatacgctttcaagtcctgaagtacttttgactaaacttaccgttaatgttacgtaacgacgacggggtttacggacgttacggttttaccctccccgttaaaccgtttttccggggaccggttacggggaaacccgttacgggggtacgggttaaccggttaaccggtaaaccggaaccggttttaacgggcgggtaacccgtttgggtacccgaaaccctacgttccccgggtttaatcccgttttacgggtaaaccctttccttttaccccccgggacc

SEQ ID NO: 293843 - DNA, 537 bp, Homo sapiens
  misc_feature: GYAE6OF02HUNQ4.48.1.A01.1.454.CMB.1.raw
  modified_base (371)..(371): a, c, t, g, unknown or other
  misc_feature (371)..(371): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaccagggaaagccccgaaagctcctaattttcgctgtctccagtttgcagagtggagtcccatctcggttcagcgcagtggatcgtggggcagagttcattctcaccatccaacngtccttcagcctgaagtatttgactaacttacttattgtcagctagggtgactagtttcccctcctacgtttcgggacggtacgggtaccgagggtcggtacgtacgaaacgtaccgtggtggaccttgcctaccgtatcgtgttccttcgacttcctacccgtcc

SEQ ID NO: 293844 - DNA, 505 bp, Homo sapiens
  misc_feature: GYAE6OF02H7AE8.48.1.A01.1.454.CMB.1.raw
  modified_base (477)..(477): a, c, t, g, unknown or other
  misc_feature (477)..(477): n is a, c, g, or t
  modified_base (486)..(486): a, c, t, g, unknown or other
  misc_feature (486)..(486): n is a, c, g, or t
  modified_base (503)..(503): a, c, t, g, unknown or other
  misc_feature (503)..(503): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctcagtttgcagagtggagtcccatctcggttcagcggcagtggatcgtgggcagagttcattctcaccatcaacagccttcagcctgaagtattttgctaacttacctatttgtactagcagggtcgactacgtttccctcccacgtttcggcggacgggaccagggtgacgtcgaacgactgnggctgcacntctgcttcattcctccncc

SEQ ID NO: 293845 - DNA, 543 bp, Homo sapiens
  misc_feature: GYAE6OF02GQ84L.48.1.A01.1.454.CMB.1.raw
  modified_base (525)..(525): a, c, t, g, unknown or other
  misc_feature (525)..(525): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtgagtcccatctcggttcagcggcagtggatcgtggggcaggtagttcattccgtcacctatccaacacgtcccttacacgtccctaggtaaagtacgttttgacctaaacttaacttatttacgtctagtctaggggtcaactcgtttcccctcccgtacgtttccggcggtagggaccgtagggtcggacgtacgaacgacgtggtgctgccacntctgtctcattcctccac

SEQ ID NO: 293846 - DNA, 532 bp, Homo sapiens
  misc_feature: GYAE6OF02I0P1G.48.1.A01.1.454.CMB.1.raw
  modified_base (307)..(307): a, c, t, g, unknown or other
  misc_feature (307)..(307): n is a, c, g, or t
  modified_base (359)..(359): a, c, t, g, unknown or other
  misc_feature (359)..(359): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctcctaattttcgctgtctcagtttgcagngtggagtcccatctcggttcagcggcagtggatcgtgggcagagttcattcncaccatcaacagtccttcacgcctagaagtattttgactaacttacttattgtcagcgtagggtcgactacgtttcccctaccttacgttcgggcggacggtacggacgggtacgacgtaacgacgtaggtgcggtcncgccacgtntcgttcgttctctacttccgtccctc

SEQ ID NO: 293847 - DNA, 598 bp, Homo sapiens
  misc_feature: GYAE6OF02JKORD.48.1.A01.1.454.CMB.1.raw
  modified_base (268)..(268): a, c, t, g, unknown or other
  misc_feature (268)..(268): n is a, c, g, or t
  modified_base (329)..(329): a, c, t, g, unknown or other
  misc_feature (329)..(329): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggtcggcgagccaggatgttacgtccttatagcctggtatcagcaagaaaccgagggaancccgaagctaccttaatttcgctgtctcctagttgcagagtggactccatctcgtcagcgnagtggatcggtggcagagttcattcgcaccatacaactacgtccttacgacgtaccgtagtaagttacttttagaccctaaactttaccttaagttcgtacgtacggtcgtagggtacgtacgtacgtttcccctacccgttacgtttccgggaccgggtaggtacccggagggttaccggtacgtaacgaaacggtaacgtcggttacggctacggaccctaccgtattacgttggtacccttacgtaccgttcccgttccccgtacg

SEQ ID NO: 293848 - DNA, 523 bp, Homo sapiens
  misc_feature: GYAE6OF02HD5RQ.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtgggcagagttcattctcaccatacaacacgccttcacgcctagaagtatttcgactaacttacttattgtcagcgaggtgactacgtttaccctcccgtacgttcgggcggacgggaccgaggtaggacgtacaacgactaggcggctgcctaccatctgtccttactctttcccgctacg

SEQ ID NO: 293849 - DNA, 516 bp, Homo sapiens
  misc_feature: GYAE6OF02F0BC2.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtggggcagagttcattctcaccatcaacagccttcagcctgaagtatttgactaacttacttattgtcagcagggtgactacgtttccctcctacgtttcggcggtacgggaccgagggtcggacgtacaacgactggtcggctcgcaccatctgtcttcacttcctcccgtcc

SEQ ID NO: 293850 - DNA, 564 bp, Homo sapiens
  misc_feature: GYAE6OF02GRRXF.48.1.A01.1.454.CMB.1.raw
  modified_base (423)..(423): a, c, t, g, unknown or other
  misc_feature (423)..(423): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaatttcgctgtctccagtttgcagagtggagtcccatctcggttcagcggcagtggatcgtggggcaggagttcattctcaccatcaacacgcctttacagcctagaatatttgactaacttacttattgtacagcagggtnacgtacgtttcccctccgtacgtttccgggacgggtacgggtaccgagggtacggacgtaccgaaacggtaacgtggtacgggcctcggaccaccgtattccgtacggttccttccgtaacttcccgttaccccggtaccc

SEQ ID NO: 293851 - DNA, 384 bp, Homo sapiens
  misc_feature: GYAE6OF02IETH4.48.1.A01.1.454.CMB.1.raw
  modified_base (209)..(209): a, c, t, g, unknown or other
  misc_feature (209)..(209): n is a, c, g, or t
  modified_base (313)..(313): a, c, t, g, unknown or other
  misc_feature (313)..(313): n is a, c, g, or t
  modified_base (319)..(319): a, c, t, g, unknown or other
  misc_feature (319)..(319): n is a, c, g, or t
  modified_base (324)..(324): a, c, t, g, unknown or other
  misc_feature (324)..(324): n is a, c, g, or t
  modified_base (326)..(327): a, c, t, g, unknown or other
  misc_feature (326)..(327): n is a, c, g, or t
  modified_base (330)..(330): a, c, t, g, unknown or other
  misc_feature (330)..(330): n is a, c, g, or t
  modified_base (332)..(332): a, c, t, g, unknown or other
  misc_feature (332)..(332): n is a, c, g, or t
  modified_base (338)..(384): a, c, t, g, unknown or other
  misc_feature (338)..(384): n is a, c, g, or t
tcagagtatacatacacgaccggtgctcgatttagacgtctcatcaagggaaggaagggcaatggatccgggacagatttcggctcaccatcagcagtctacaacctgaagattttgacaacctacttctgtcgaccaggcttacaacttcccctcgaccgttcggccaagggaccctaaggtggaactccagtaccgaactgtgggcnggccaccgattccgtgtcttcaacttccttcccgcctatcctagatatgtaacttcctcgtggaaggtccgggactcggaaccgtaacgggccacgtaagtcgnctgacngcttncnnaancnttaacnnnnnnnnnnnnnnnnnnnnnnnnnnnnnnnnnnnnnnnnnnnnnnn

SEQ ID NO: 293852 - DNA, 684 bp, Homo sapiens
  misc_feature: GYAE6OF02FF050.48.1.A01.1.454.CMB.1.raw
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
tcagagtatacatacacgaccggtgctcgatttagacgtctcatcagggggagtcagacccagtcaggactcagcatggacatgacgggtccccgctcagctccgtgggctcctgctgctctggttcccaggttccagatgcgacactccagactcgacccntcctctacttccttcgtntctgtcttcgtgacgagacagactctactacgtcgtacgtcggccggacgacgtccgtaggttacttacgttaccgttccttagtacgtcgttagacacgaacgaaccgaaaccgaaccggacggaacccgtacctaacgttcctttacttacgtttcgcgttctacgttcgtagtcgacgtacggtacgtaccgtacctaccgtagttccggtaggacggacggcgtaagtccggtacggtacgttcggggactactacgtctactacctaccgaccactacgtacaccgttcgacctagaacttacgtacgtactttacgttacacgttaacttgtcgtacgtacgacggttacggttcctaccgtttaccgttccccgtacggacgtttaccgggagggtaacggtacggaaccttaacggggcttaaccgagttacgcgttacggaccgtcaccgttacagtttccttccttaacgtacctcctacccgttactcgtaac

SEQ ID NO: 293853 - DNA, 541 bp, Homo sapiens
  misc_feature: GYAE6OF02I4G81.48.1.A01.1.454.CMB.1.raw
  modified_base (361)..(361): a, c, t, g, unknown or other
  misc_feature (361)..(361): n is a, c, g, or t
  modified_base (379)..(379): a, c, t, g, unknown or other
  misc_feature (379)..(379): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctcctaatttcgcttgtctccagtttgcagagtggatcccatctcggttcagcggcagtggatcgtggggcaggagttcattcncaccatcaacagtccttnacgcctagaagtatttgactaacttactatttcgtcagcagggtgactcgtttcccctaccctacgtttccgggacgggacgggtaccgaggggtcggacgtacgaaacgtacgtggtaggcctggcctacctagtctgtaccttcgacttcctcccgtacc

SEQ ID NO: 293854 - DNA, 534 bp, Homo sapiens
  misc_feature: GYAE6OF02GAWZX.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcggaaaccagggaaagccccgaagctcctaattttcgctgtctccagtttgcagagtggagtcccatctcggttcagcggcagtggatcgtggggcagagttcattctcacatcaacagccttcagcctagaagtattttgactaacttactattgtcagcagggtgacgtacgtttccctcccgtacgttttccggcgggtacgggaccgtacggggtcggacgtacgaaacgtacgtggtaggcgtgcgtaccatcgtgtcttcactccttcccgctacg

SEQ ID NO: 293855 - DNA, 664 bp, Homo sapiens
  misc_feature: GYAE6OF02HN4ST.48.1.A01.1.454.CMB.1.raw
  modified_base (410)..(410): a, c, t, g, unknown or other
  misc_feature (410)..(410): n is a, c, g, or t
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaagcccgaagctacctaatttcgcttgtctccagtttgcagagtggacgtccatctcggttcaggcggcaggtggtatcgtggggacaggtacgttcattcctcaacctatccaaactcgtccctttacgacgccgttagtaaagtnttttacgaacttaactttacttagtttcgacctagtaccgaagggttacgaaccgttaccggttttaccccttacccgtaacggttttccgggaaccgggtacggggtacccggtaaggggtcgggtaaccgtaccgtaaaaccggtaccgtttacgggtacgggtaccgttcggtaaccccgtaaccgttaacgttcccgttttacgggtcccttttaacggaccgttttcccccgttaccccccgtaacccg

SEQ ID NO: 293856 - DNA, 559 bp, Homo sapiens
  misc_feature: GYAE6OF02GERI1.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttacgtcccttattagcctggtatcagcagaaaccagggaaagccccgaagctcctaatttcgctgtctccagtttgcagagtggagtcccatctcggttcagcggcagtggatcgtggggcaggagttcattcctcaccatcaacagtcccttcagcctgaagtatttcgactaactttctattgtcagcgagggtcactacgtttccctaccctacgtttccgggacggacgggtaccctaggggtcgaccgtacgtaaacgacgttggtacggcctggacctaccgtagttccgttggttccttaccacgtttcccgttccccgtacccg

SEQ ID NO: 293857 - DNA, 588 bp, Homo sapiens
  misc_feature: GYAE6OF02GMZMT.48.1.A01.1.454.CMB.1.raw
  modified_base (431)..(431): a, c, t, g, unknown or other
  misc_feature (431)..(431): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactactcacttggcgggcagccaggattggttacgtccctttattagcctggtatcagcagaaccaggaaagccccgaagctctaattttcgctgtctccagtttgcagagtggagtcccatctcggttcagcggcagtggatcgtggggcagagttcattctacaccatcaacagccttcacgtcctgaagtacttttagctaaacttacttaattgtacagtacgagggtnaccgttaacgtttcccttaccccgtacgtttccggaccgggtacggggtaaccgaggggttcggtaacggtaccgaaacgtaaccgtaggttacggcgttcggccgtaccgtaacgttccttacggttcctttctaccgttccttacccccgtaccc

SEQ ID NO: 293858 - DNA, 525 bp, Homo sapiens
  misc_feature: GYAE6OF02FHA6O.48.1.A01.1.454.CMB.1.raw
  modified_base (334)..(334): a, c, t, g, unknown or other
  misc_feature (334)..(334): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagcctcctaattttcgctgtctccagtttgcagagtggagtcccatctcggttcagcggnagtggatcgtgggcagagttcattctcaccatcaacagccttcagtcctgaacgtattttgcaactttacttaattgtacagcgaggtgactacgtttccctccctacgtttcggacggtacgggaccaggggtgacgtcgaacgaacgtgtggctgccaccgattctcgttcttcacttccttcccgacc

SEQ ID NO: 293859 - DNA, 701 bp, Homo sapiens
  misc_feature: GYAE6OF02IU1YT.48.1.A01.1.454.CMB.1.raw
  modified_base (378)..(378): a, c, t, g, unknown or other
  misc_feature (378)..(378): n is a, c, g, or t
tcagagtatacatacacgaccggtgctcgatttagacgtctcatcagggggagtcagacccagtcaggactcagcatggacatgagggtccccgctcagctccgtgggctcctgctgctctggttcccaggttccagatgcgacatccagatgacccagtctccattcttccgtgtctgcttctggtcggagacagagtcactatcacgttggtcgggcagccagggtatgttacgtcccttattagcctaggtatcgtagacaagaaaccgaagggaaacgaccccgaagctaccttaatttcgctgtctcctagtttgcagtagtggtacgtcctatcgtcggttacaggtcggccgaggtgagttacggtcgggntaggtacgttcgtacttccgtacaccgattaccaacgtcgtaccctttacgacgtaccgttagaacgttacgtttacgaccgttaaacctttacgttaatttacggttactacggtacggtaacgggttacgtaaccgttaacccggttttccccttaccccgttaaccggttttccccgggaacgggtaccggggtaaccggtaacgggtacggtaaccggtaacgtaaaccggtacgttacggtcggtacctacggttaccaacccgtacgttccgttacgtttccgttacccgtaacgtttccccgttccccgttacccg

SEQ ID NO: 293860 - DNA, 617 bp, Homo sapiens
  misc_feature: GYAE6OF02HFQSF.48.1.A01.1.454.CMB.1.raw
  modified_base (366)..(366): a, c, t, g, unknown or other
  misc_feature (366)..(366): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttacgtcccttattagccttggtatcagcagaaaccgagggaaacgccccgaagctaccttaattttcgctgtctcctagtttgcagagtggacgtcccatctcggtcagcggcagtggatcgtgggcagagttcattcncaccatcaacacgtccttacgacgtccctaggaaagtttacttttagaccttaaactttacttattcgtacaggcgtagggtcgtaccgttaccgttttcccctacccgttacgtttccgggacggggtacgggtaccggtagggttacggtaccgttaaccgaaaccgtacggttacggtccggtacgtcggtaccgaacccttagttccgttacgtttccttaccgtaactttcccttccccggtaacc

SEQ ID NO: 293861 - DNA, 528 bp, Homo sapiens
  misc_feature: GYAE6OF02IX3M0.48.1.A01.1.454.CMB.1.raw
  modified_base (336)..(336): a, c, t, g, unknown or other
  misc_feature (336)..(336): n is a, c, g, or t
  modified_base (427)..(427): a, c, t, g, unknown or other
  misc_feature (427)..(427): n is a, c, g, or t
  modified_base (510)..(510): a, c, t, g, unknown or other
  misc_feature (510)..(510): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctccttaattttcgcttgtctcctagtttgcagagtggactccatctcggttcagcggnagtggatcgtgggcagagttcattctacaccatcaacacgtccttacagcctgaagtatttgacctaacttactaattgtcagcgagggtnacgtcgtttcccctccctacgtttcgggcggacgggacgagggtacggacgtacgaaacgacttggtcggctgcaccatcgtnttctcacttcctcccgac

SEQ ID NO: 293862 - DNA, 716 bp, Homo sapiens
  misc_feature: GYAE6OF02I5UMU.48.1.A01.1.454.CMB.1.raw
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (291)..(291): a, c, t, g, unknown or other
  misc_feature (291)..(291): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatcgacccagtctccatcttccgtgtctgcttctggtcgagacagagtcactntacncttggcggcgagccaggtattcggttacgtccctttaagttacgtcctggtatcacgacaacggaaacccgtaaggggaaacnccccgaagtcctaccttaatttccgctcgtctacctaggttcacgagtcgtggtacgttcccgtattccggtcggttacacggcggtacgtaggttcggagttccgggtgggactaaggttacgttctaccgttcgtaccgaaccattaccgaaactaccggttacccttagaccgttccgtaagtaaacgtttagtttacgaacctttaaacgtttactaacgtttcggtaccgaggtaccgttaaggggtccttaaccggtttaccctttcccccccgttaacgtaccgggtttccggggtaaccgggaaacgggtacccggtttagggaacccgtacgggttaaacaaaccgggtcgttgaagggtttccaacgtcccgtacgtaatttcgcgtttaccttacggcctccccgtttaaccgc

SEQ ID NO: 293863 - DNA, 529 bp, Homo sapiens
  misc_feature: GYAE6OF02H1LS0.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctctaatttcgctgtctccagttgcagagtggagtcccatctcggttcagcggcagtggatcgtgggcaggagttcattctcaccatcaacagtccttcagcctgaagtatttgactaactttacttattgtcagcgagggtcgactacgtttccctacccgtacgtttcgggcggtacgggtacgacgggtcggtacgtacaacgacgtgtggtctggcaccgatcgtcgttcttacacttccttccgtacc

SEQ ID NO: 293864 - DNA, 652 bp, Homo sapiens
  misc_feature: GYAE6OF02G72ES.48.1.A01.1.454.CMB.1.raw
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccaggaaagcccgaagctctaatttcgactgtctccagtttgcagagtggagtccatctcggttcagcggcagtggatcgtgggcaggtacgttcatttcgtccacctactacaaacgacgtaccctttacgacggacccttaggaaaggttacttttacggaccttaaaccgttttaacttaacgtttacgttacgtaaggacgtaaggggttacgacgtaccggttttaccccgtaccccgttaccgttttaccgggccggttaacggggtaacccgtaggggtaccgggaacgttaaccgaaacggtaaaccgttcgggtacggaccttacggaccctaccgtacgttaccgttacgttacctttccgtaacttcccgtttaccccgacccg

SEQ ID NO: 293865 - DNA, 809 bp, Homo sapiens
  misc_feature: GYAE6OF02I6GT1.48.1.A01.1.454.CMB.1.raw
  modified_base (214)..(214): a, c, t, g, unknown or other
  misc_feature (214)..(214): n is a, c, g, or t
tcagagtatacatacacgaccggtgctcgatttagacgtctcatcagggggagtcagacccagtcaggactcagcatggacatgagggtccccgctcagctccgtgggctcctgctgctctggttcccaggttccagatgcgacatccagatcgacccagtcctccacttcttccgtgtctgtcttcgtgtacggagacagacgtcactagtcncgttggcgggcgagccgaggtattgttacgtccttagtacgtccgtggtactcagactaagaaaccgagggaacgcccgaagccttaccttaacgttttcgcgttcgttacctacctaggtttcgcgtaggacggttagggacctccctacgttccgttacggttcgacggtcggtccgaaggttggtacgttcgggtacgggactaggtacgtttaaccgtactttccgtaccgtaacctacgttaccgaaaaccgtcgttaccctttacgaacccggtacccgttaaaggtaacgtttcgttttaacggaacctttaaaccgtttacctttaaggtttccgtacgtaacggtacgtaacgggttacgtaaacccggtttaccgttttaccccctaccccggttaacgggtttcccggggaccggtaacccggggttaaccggtacgggtttaaccggggaacccgtttaaccggaaaccgggtttaaccggtcgggtttaaccgggtaccgttacgggtaacccgtaaccggttacgttaccggttcgtttacccggtacgtttaccgtttcccccgttaccccgttaaccgg

SEQ ID NO: 293866 - DNA, 648 bp, Homo sapiens
  misc_feature: GYAE6OF02GS2GL.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatctacttggtcgggcgagccagggtattgttacgtccctttattacgccttggtatcagacaacgaaaccgagggaaacgcccgaagctacttaatttcgcttgtcctcgtagttgcagagtggacgtccatcgtcggtcagcggcgagtggagtcggtgggactaggtacgttctattccgtacacctatacctaactacgtccttacgtacgtacctagtaacgttagtttacgtacctaacctttaacgttatttacgttacgtacgtacgtagggtacgtacgttaccgtttaccccttacccgttaccgttccgggtacgggtacgggtaccggtacgggtacggtacgtaccgtaacgtaacgtacggtcggtacgtacgaccgtttttttaccgacgttcgttcgttccgtttccgtaccgttcccgttacccgtaccg

SEQ ID NO: 293867 - DNA, 566 bp, Homo sapiens
  misc_feature: GYAE6OF02H3YTI.48.1.A01.1.454.CMB.1.raw
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacgttgcgggcgagccaggatgttagtccttatacgcctggtatcgagcaagaaaaccgagggaacgacccgagctacttaatttcgntgtctcctagttncagagtggacgtccatcgtcgtcagcgcagtgactcggtgggacagngttctagttcacgacatcaaactcgtccttcacgcctagtaagtattacgactaactttactattgacagcgtaggactacgtacgttcccgtaccttacgttcggacgggtacgacggtagggtacgacgtaacgaacgtacgtgggtacgtccgtacggacctaacctcgtttcttacggttccttaccgactttaccccggttccctaacg

SEQ ID NO: 293868 - DNA, 614 bp, Homo sapiens
  misc_feature: GYAE6OF02F6AKC.48.1.A01.1.454.CMB.1.raw
  modified_base (224)..(224): a, c, t, g, unknown or other
  misc_feature (224)..(224): n is a, c, g, or t
  modified_base (373)..(373): a, c, t, g, unknown or other
  misc_feature (373)..(373): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggntgttacgttcccttattagcctggtatcagcaagaaaccagggaaacgccccgaagcctacctaattttcgcttgtctccagtttgcagagtggacgtcccatctcgttcgagtcggctagtgatcggtgggcagtagttcactttccncacctataccaactacgtcccttacacgtccttagtaaactagttttacgactaaactttacttatttgtacagtcgtagggtcgtacgtacgtttcccctcccgttacgtttcgggaccgggtacgggaccgtaggggtcggtaaccgtacgaaccggtaccgttaggtccggtctccggacctaacccgtcttaccgttcgttcccgtttaccgtaacgtttcccgttccccggtaacc

SEQ ID NO: 293869 - DNA, 619 bp, Homo sapiens
  misc_feature: GYAE6OF02FTDQW.48.1.A01.1.454.CMB.1.raw
  modified_base (315)..(315): a, c, t, g, unknown or other
  misc_feature (315)..(315): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggtcgggcgagccaggatgttagtcccttattagcctggtatcagcaagaaaccgagggaaacgcccgaagtctaccttaattttcgctgtctcctagtttgcaggngtggacgtcccatcgtcgttcacggcggctaggtggactcggtggggcagtagtttctattctacaaccataccaaactacgtcccttacacgtcctagtaacgttatttagaaccttaactttaacttagttacgttacacggtacgtacgggtacgtaccgttaccgtttccccttacccgtaccgtttccgggacgggtaccgggaccggtacgggtacggtaaccggtacgaaaccgtacgtaggtcggtctacggtaccaccgtatcgttcggttccttcgtacttaccgtcccgtacc

SEQ ID NO: 293870 - DNA, 537 bp, Homo sapiens
  misc_feature: GYAE6OF02FZL5F.48.1.A01.1.454.CMB.1.raw
  modified_base (429)..(429): a, c, t, g, unknown or other
  misc_feature (429)..(429): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcaagaaaccagggaaagccccgaagctcctaattttcgctgtctccagtttgcagagtggacgtcccatctcggttcagcggcagtggatcgtggggcaggagttcatttctcaccatcaacacgcccttcacgcctagaagtatttacgctaaacttacttattgtcagcagggtnactacgttccctcctacgtttcggcggtagggaccgagggtgtacgtacgaacgtacgtggtcggctgaccaccgtagttctcgttcttactacttccttcccgtacc

SEQ ID NO: 293871 - DNA, 620 bp, Homo sapiens
  misc_feature: GYAE6OF02G1JH7.48.1.A01.1.454.CMB.1.raw
  modified_base (360)..(360): a, c, t, g, unknown or other
  misc_feature (360)..(360): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaagccccgaagcctcctaattttcgctgtctccagtttcgcagagtggacgtcccatctcggttcagcggcaggtggatcgtgggcaggtagttcnttctcaccataccaacacgtccctttacacgtcctacgtaaagtacttttacgacctaaactttaccgttatttcgttactaggtacgtaaggggtacgtacgtaccgttttcccccttacccgtacgtttccggggacgggtacgggacccggtagggtcggtaaccgtacgaaaccgtacgttacgggtcggaccgttaggccgtaaccctagttcccgttacgttcctttacctaccgtttccctaccccggtaccc

SEQ ID NO: 293872 - DNA, 591 bp, Homo sapiens
  misc_feature: GYAE6OF02FNW4N.48.1.A01.1.454.CMB.1.raw
  modified_base (386)..(386): a, c, t, g, unknown or other
  misc_feature (386)..(386): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcaagaaaccagggaaacgccccgaagcctacctaattttcgcttgtctccagtttgcagagtggacgtcccatccgtcggttcaggcggcagtggatcgtgggcaggtagttcatttctcctaccataccaacncgtccttacgacgcctagtaagtacttttgacctaacttacttagttcgtcgagtacgtagggtactacgttaccgtttcccctacccgtacgttttccgggaccgggtacgggacccggtagggtacgacgtacgaacgtacgtcggtggtactcggcctaccgtagttccgtcgttccttaccgactttcccgttcccgtacc

SEQ ID NO: 293873 - DNA, 340 bp, Homo sapiens
  misc_feature: GYAE6OF02GRKTQ.48.1.A01.1.454.CMB.1.raw
  modified_base (270)..(270): a, c, t, g, unknown or other
  misc_feature (270)..(270): n is a, c, g, or t
  modified_base (290)..(290): a, c, t, g, unknown or other
  misc_feature (290)..(290): n is a, c, g, or t
  modified_base (293)..(294): a, c, t, g, unknown or other
  misc_feature (293)..(294): n is a, c, g, or t
  modified_base (296)..(296): a, c, t, g, unknown or other
  misc_feature (296)..(296): n is a, c, g, or t
  modified_base (298)..(299): a, c, t, g, unknown or other
  misc_feature (298)..(299): n is a, c, g, or t
  modified_base (302)..(302): a, c, t, g, unknown or other
  misc_feature (302)..(302): n is a, c, g, or t
  modified_base (304)..(305): a, c, t, g, unknown or other
  misc_feature (304)..(305): n is a, c, g, or t
  modified_base (310)..(310): a, c, t, g, unknown or other
  misc_feature (310)..(310): n is a, c, g, or t
  modified_base (312)..(340): a, c, t, g, unknown or other
  misc_feature (312)..(340): n is a, c, g, or t
tcagagtatacatacacgaccggtgctcgatttagacgtctcatcaagggaaggaagggcaatggatccgggacagattttcggctcaccatcagcagtctacaacctgaagatttttgcaacctacttctgtcacccaggcttacaacttcccctccgacgttccggccaaggggacccaagggtcggaagtcagacgaactggtggctgcaccatctgtcttcatccttcccgccattctgactagtgtatactctggacgcgggtcnggtccaaaggccgcaagtancgnntnannganannactantnnnnnnnnnnnnnnnnnnnnnnnnnnnnn

SEQ ID NO: 293874 - DNA, 716 bp, Homo sapiens
  misc_feature: GYAE6OF02FXEIP.48.1.A01.1.454.CMB.1.raw
  modified_base (283)..(283): a, c, t, g, unknown or other
  misc_feature (283)..(283): n is a, c, g, or t
  modified_base (385)..(385): a, c, t, g, unknown or other
  misc_feature (385)..(385): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggtcgggcagccaggattggttacgtcccttagtacgcctggtatcagcaaggaaaccagggaaacgccccgaancctcctaattttcgctgtctcctagtttcgacagagtggacgtccctatcgtcgttcacgtcggcaggtggagttcggtgggacagtacgttctactttccnccgaacctattaccaaactacggtccctttacgacgtacccgtaggtaaacgttacttttacgaccgttaaactttaccgtttaagtttacggtaccgtacggtacggttaagggtaccgttaaccgttaccgtttccccgttacccgttacgttttaccggggaccgggtaacggggttaacccgtgggggttaaccggtaaccggttaaccggaaaccggtaacgggttacggttacggggtaccccgttaggaccccgtaaacccgtcgtttacccggtcggttttacccttaacccgtacccgtttaccccttacccccggtaaccc

SEQ ID NO: 293875 - DNA, 635 bp, Homo sapiens
  misc_feature: GYAE6OF02JBXD8.48.1.A01.1.454.CMB.1.raw
  modified_base (616)..(616): a, c, t, g, unknown or other
  misc_feature (616)..(616): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagacgtcactatcacttggtcgggcgagccagggacttggttacgtccctttagttacgcctggttatcgagtcaagaaaccagggaaacgccccggaagcctaccttaaagttttccgactcgttcctcctaggttttgctaggagtcggacgtcccattcctcggttcaggcgcagtggactcgtgggctaggtagttcgtacttcctacctaccgtatccaaacgacgtcccttcacgtcccgtagaagttacgtttcgaccttaaactttcttaatttcgtactacggtacgtagggtacgtaacgttaccgtttccccgtaccgttaccgtttcgggccgggtaacggtaccggtagggtcggaccgttaccgaacggtagtcggtggtacctggacctacgtagttcctggttacctntccgttacctcccgtaccg

SEQ ID NO: 293876 - DNA, 538 bp, Homo sapiens
  misc_feature: GYAE6OF02HBXGH.48.1.A01.1.454.CMB.1.raw
  modified_base (183)..(183): a, c, t, g, unknown or other
  misc_feature (183)..(183): n is a, c, g, or t
  modified_base (377)..(377): a, c, t, g, unknown or other
  misc_feature (377)..(377): n is a, c, g, or t
  modified_base (383)..(383): a, c, t, g, unknown or other
  misc_feature (383)..(383): n is a, c, g, or t
  modified_base (412)..(412): a, c, t, g, unknown or other
  misc_feature (412)..(412): n is a, c, g, or t
  modified_base (416)..(416): a, c, t, g, unknown or other
  misc_feature (416)..(416): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttcngtcggagacagagtcactatcacttgtcgggcgagccaggatgttagtcccttatagcctggtatcagcaagaaaccagggaaacgccccgaagctccttaattttcgacttgtctcctagtttgacagagtgagtcccatcgtcggttcagcggacagtggatcgtggggcagagttcattcacacatcaacngtcttnatctagaatatttgactaacttatattgntagntaggtgactacgtttaccctaccctacgtttcgggacggtaagggaccgagggtacgacgtacaacgtacgtgtcggtctgaccaccgattcgtcgttctaccgtattcccgttacccgacg

SEQ ID NO: 293877 - DNA, 312 bp, Homo sapiens
  misc_feature: GYAE6OF02GX5LO.48.1.A01.1.454.CMB.1.raw
  modified_base (263)..(263): a, c, t, g, unknown or other
  misc_feature (263)..(263): n is a, c, g, or t
  modified_base (269)..(270): a, c, t, g, unknown or other
  misc_feature (269)..(270): n is a, c, g, or t
  modified_base (272)..(277): a, c, t, g, unknown or other
  misc_feature (272)..(277): n is a, c, g, or t
  modified_base (280)..(312): a, c, t, g, unknown or other
  misc_feature (280)..(312): n is a, c, g, or t
tcagagtatacatacacgaccggtgctcgatttagacgtctcatcaagggaaggaagggcaatggatccgggacagattttcggctcaccatcagcagtctacaacctgaagatttttgcaacctacttctgtcacccaggcttacaattcccctcgacgttcggccaagggaccaaggtggaagtcagacgaactgtggctgcaccatctgtctcatctcccgcatctgatatgtatacttctgagcgggctggacaggcanagtagnnannnnnncannnnnnnnnnnnnnnnnnnnnnnnnnnnnnnnn

SEQ ID NO: 293878 - DNA, 754 bp, Homo sapiens
  misc_feature: GYAE6OF02HZZY4.48.1.A01.1.454.CMB.1.raw
tcagagtatacatacacgaccggtgctcgatttagacgtctcatcagggggagtcagacccagtcaggactcagcatggacatgagggtccccgctcagctcctggggcctcctgctgctctggttcccaggttccagatgcgacatccagatcgacccagtcctccatcttccgtgtctgcttcgtgtcggagacagagtcactatctacgttggtcggcgagccgaggtattgttacgtccttattacgcttggtatcagcaacgaaaccgagggaacgcccgaagtcttaccttaatttcgcttcgtcttccgtagtttcgacgtagtaggtcggtacgtccctagttccgttcggttacacggccggtacgtaggtcggtagttcggtaggggtctaaggtacgtttaccgtactttaccgtacctaaccgtaacgtaaccctaaacgtaccgttcccgttacgtacgtacccgttaagttaaacgttacgtttacgaacctttaaaccgtttactttaacgtttacgtacgaacggtaccgggtaacgggtaccgtaaccgtttacccggttttaccccctaaccccgtttaccgggttttcccggggaacggggttaacccggggtaaccggttaggggaaccggtaaccgtaaccgtaaaccgtacggttcgggtacgtccggtacgtaacctacccgttagttccgttacgtttacctccgttaccgttccccgttacccgtaccg

SEQ ID NO: 293879 - DNA, 679 bp, Homo sapiens
  misc_feature: GYAE6OF02FXCX0.48.1.A01.1.454.CMB.1.raw
  modified_base (175)..(175): a, c, t, g, unknown or other
  misc_feature (175)..(175): n is a, c, g, or t
  modified_base (190)..(190): a, c, t, g, unknown or other
  misc_feature (190)..(190): n is a, c, g, or t
  modified_base (349)..(349): a, c, t, g, unknown or other
  misc_feature (349)..(349): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtcctccatcttccgtntctgcttctgtcganacagatcactatctacttggcgggcagccaggtatgttacgtccttatacgcctggtatcacgcaacgaaaccgaagggaaacgaccccgaagcttacctaattttcgcttgtctcctagtttgacagtgtggactccatctcggttcagcgcaggtgntcgtgggcagtacgttcacttcctacgtacccagtaccaacgtacgtccgtttacacggtcctagtaaagttagttttacgaacctaactttaacttagttacgttcgtaaggaccgtagggttacgtaacctttaccggtttaccccttaccccgttacggtttaccgggaccggggtaaccggggtaaccggtacgggggttaccggaaccgggttaccgtaaaccggtacggttacgggtaccggtccgtacggtaacccgtaccttaccggttacgtttccggtttccttacccgtttaaccttccccgttaccccgttaacccgg

SEQ ID NO: 293880 - DNA, 579 bp, Homo sapiens
  misc_feature: GYAE6OF02FU4HE.48.1.A01.1.454.CMB.1.raw
  modified_base (545)..(545): a, c, t, g, unknown or other
  misc_feature (545)..(545): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctcctaattttcgctgtctccagtttgcagagtggacgtcccattctcggttcaggcgcagtggatcgtggggcaggtacgttcattcctcaccataccaactacgtccttacacgtcctagaacgttatttcgactaacttacttagttctacgacgtcgtagggtacgtaacgttacgtttcccctacccgtacgtttcgggcgggtaacggggacctaggggtcgaccgtacgaaccgacgtcggtcggtctacggcctaccgtntcgttcgttccttacacgttcccttcccgtaccc

SEQ ID NO: 293881 - DNA, 772 bp, Homo sapiens
  misc_feature: GYAE6OF02GPZ23.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttacgtcccttattacgcctggtatcagcaagaaaccgagggaaacgccccgaagcctacctaattttcgcttgtctcctagtttcgacgagagtcggactcccgtatcgttcggttcacggcggactaggtaggtatcggtggggctaaggtacgtttctaactttcccgtacctaacccgtaactaccaaaccgtaacgttcccctttacgaacgttacccgtaggtaaacgttacgttttacggaaccctttaaaccttttaaccgttaagttttacggttaccgaacgggttaccggttaaggggtaccgttaaccggtttacccggttttaccccccgttaccccggtttaaccgggtttttcccgggggaccggggttaaccgggggttaacccggtaacgggggttaaccgggtaacccggtaaccgtaaaccgggttaaccgttacggggtaccgggtaccttaccgggtaccctaaccggttacgttacccgttcggtttacccgtttacgtaacctttcccgtttcccgtaacccg

SEQ ID NO: 293882 - DNA, 555 bp, Homo sapiens
  misc_feature: GYAE6OF02G15XR.48.1.A01.1.454.CMB.1.raw
  modified_base (430)..(430): a, c, t, g, unknown or other
  misc_feature (430)..(430): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctcctaatttcgctgtctccagtttgcaggagtggagtcccatctcggttcagcggcagtggatcgtgggcagagttcattctcacctatcaacacgcctttcagtccctagaacgtatttcgactaacctttactatttgtcagtcagggtntaccgtacgtttcccctacccgttcgttccgggacggacgggacgtagggtacgaccgtacgaacgtacgtggtggtctcgacctacctacttcgttcgttccttctacccttccgtaccctacc

SEQ ID NO: 293883 - DNA, 610 bp, Homo sapiens
  misc_feature: GYAE6OF02HZ0ZT.48.1.A01.1.454.CMB.1.raw
  modified_base (304)..(304): a, c, t, g, unknown or other
  misc_feature (304)..(304): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagcttcctaattttcgctgtctccagtttncagagtggagtcccatctcggttcagtcggcagtggatcgtggggcaggagttcattctcaccatccaacacgcctttcacgtcctgaaagtactttgacctaactttactaatttgtcagtcgagggtgtaacgtaccgtttccctcccgtacgttttccgggacgggtacggggtaaccgtaggggtacggaacggttaccgaaacgtacggttacggtacgggtcccgttacggaccctaacccgtaacgttccttcgggttaccctttaccgtaccgttttccccgttaccccggtaccccg

SEQ ID NO: 293884 - DNA, 708 bp, Homo sapiens
  misc_feature: GYAE6OF02GMDOP.48.1.A01.1.454.CMB.1.raw
  modified_base (96)..(96): a, c, t, g, unknown or other
  misc_feature (96)..(96): n is a, c, g, or t
tcagagtatacatacacgaccggtgctcgatttagacgtctcatcagggggagtcagacccagtcaggactcagcatgggacatgagggtccccgntcagctcctggggctcctgctgctctggttcccaggttccagatgtgacatccagatgacccagtctccatcttccgtgtctgcttcgtggtcggagacagagtcactatcacgtttggtcggcgacgccaggatagttacgtccttattacgccttggtatcgagcaacgaaaccgagggaaacgcccgaagtccttaccttaattttcggacttcgtcctaccgtagtttcgctaggagttcggacgtcctattccgttcggttacgacggcggtactacgggtaggacgttcgggtacggggactaagggttacggttactacgtttcctacgtaacctagtaccgaactaacggtccctttacgacgtccgtaaggtaacgtttacgtttagaacccttaactttaccgttaagtttcgttacgacggtacgtagggtcctaaccgtttccgtttaacccctcccggtttaacgtttccggggacggaaccggtaccggtacggggtaaccggtaccgtaaccggtaaccgtacgttcggtacggaccgttacggaccttaacgtcgtacgtttccggttctacccggttacttcccgtaccctaccg

SEQ ID NO: 293885 - DNA, 548 bp, Homo sapiens
  misc_feature: GYAE6OF02FS7K3.48.1.A01.1.454.CMB.1.raw
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgcccgaagctacctaatttcgctgtctccagtttgcagagtgacgtccatctcgttcagcggcagtgatcgngggcagagtcattcncacatcaacagccttcacgtcctagaaagttatttcgactaactttactaattcgtacagacgtagggttcgacgttaccgtttcccctacccgtacgtttccgggacgggtacgggaccgagggttacggaccgtacgaacgacgtggtacggctcgacctacgattctgttccttcacttccctcccgtac

SEQ ID NO: 293886 - DNA, 804 bp, Homo sapiens
  misc_feature: GYAE6OF02IX4PS.48.1.A01.1.454.CMB.1.raw
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccgagatcgaccctgtcctccatcttccgtgtctgtcttcgtgtacggagacagacgtcacttatcgtacgttcggtccgggacgacgaccgagggtacttggttacgttcccttaagtcgtccgtaggtactacgtagacgaacgaaaaccggtaacgggaaaacccgccccggaaaagtccttacccgtttaaacgtttccggtacttcggttccttacccgtaaggttttcgacgtaacgggtagttacgggaccgttacccgtacgttccggttaccggttacgaacggtcggaccgttaggtgggtacgttcggtacggggacgtacggtagttacctacgtttacctaccgtaacctaacgtaacctaccgacggttacccttagacccggtactaagtaaagtttacgttacgtaaccttaacgtttacttacgttagttacacgaacggttaggtaccggttaccgttacccgttacccgtaccgttaccggggtacggtaccggggtaacgggtacccggttaacgggaccggttaaccggtaaccgtaacgtacgggttcggtaacggttcaaccggtacctacggttttaacgtttccgttacccgttaacgttccccgtttaccccgtcccgttaacgttcccgg

SEQ ID NO: 293887 - DNA, 667 bp, Homo sapiens
  misc_feature: GYAE6OF02GYFDO.48.1.A01.1.454.CMB.1.raw
  modified_base (437)..(437): a, c, t, g, unknown or other
  misc_feature (437)..(437): n is a, c, g, or t
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtctccatcttccgtgtctgcttctgtcggagacagagtcactatctacttgtcgggcgagccaggatgttacgtcccttattacgccttggtatcgagcgaagaaaccgagggaaacgcccccgaagccttaccttaacttttccgcgttcgttcctccgtagttttcgctaggtagtaggacgtccctacgtcgttcggttacgcggcggacgaggtgggattcggtgggacaggtcgttctagttcctacaccgtataccgaactacgcccgtttanaacgtccgttaggtaagtaacgttttaggaccttaactttattacttgttccagtacgtagggtcctacgttccgtttacccttcccgttacggtttccgggtacgggacgggtaaccggtggggttaccgaaccgggtacgtaaacccgtagtttacgggtcggtacgttacgccgtaaccgttacgttccgttcggttccttacggtttacctcccttcccgtacccg

SEQ ID NO: 293888 - DNA, 588 bp, Homo sapiens
  misc_feature: GYAE6OF02GPRA0.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgccccgaagctacctaattttcgctgtctcctagtttgcagagtggacgtccatctcggtcagcgcagtggatcgtgggcaggagttcattctacgaccatcaacgtacgtccttacacgtcctagaagtatttcgactaacttacttattcgtacgagcgagggtcacgttacgtttcccctcccgttacgtttaccgggcgggtacgggtaacccgaggggttacggaaccgtaccgaaacgtacgtcgggtacggacgttcggacctacccgtagttccgttacgttaccttaccgtacttcccgttaccccgtacc

SEQ ID NO: 293889 - DNA, 617 bp, Homo sapiens
  misc_feature: GYAE6OF02IO9LA.48.1.A01.1.454.CMB.1.raw
  modified_base (165)..(165): a, c, t, g, unknown or other
  misc_feature (165)..(165): n is a, c, g, or t
  modified_base (599)..(599): a, c, t, g, unknown or other
  misc_feature (599)..(599): n is a, c, g, or t
tcagagtatacatacacgaccggtgctcgatttagacgtctcatcagggggagtcgagacccagtcaggactcagcatggacatgagggtcccgctcagctcctgggctcctgctgctctggttcccaggttccagatgcgacatccagatcgacccagtctccntcttccgtgtctgcttctgtcgagacagagtcactatcactttggtcggcgagccagggacttggttagtccctttaagttcgtccgttggtaattcgagcgaacgaaacccggtaggaaagcccccgaagtctacccttaagttttccgacgttcgttctaccgtagtttcgcgtaggtacggttggacgttcccatccgttggtacctagggccgacgtaacgttggacgtggtcgggtacaggttacgtcaagtttcaccgactctacaacgcgtacctcgacgctgtaatcgtttgctaattacgttatgtcaagtgaggtctaacgttcgtcccttcccgtaagttccgggaggtacggaccggttagggtccgtaacgtacgaacgtacgtgggtacgtgcaccgaacttacgcttacgttctaaccncgttttacccgtccaccg

SEQ ID NO: 293890 - DNA, 666 bp, Homo sapiens
  misc_feature: GYAE6OF02I4JYP.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggtcgggcgagccaggatgttacgtcccttattacgcctggtatcagcaagaaaccagggaaacgccccgaagctcctaatttcgctgtctctagtttgcagagtggacgtcccatctcggttcagcggcagtggatcgtggggcagtagttcacgttctaccgaccacttacaaactacgtccctttacgacgtcctaggtaaagttagttttacgactaaacctttacgttaatttcgttacgacgtacgtaaggggttctaacgttaccgttttaccccgttaccccgttaccggtttccggggaccggggtaacggggtaaccgtacgggggttacgggtaaccgttaacccgaaacggtacgttcgggttaacgggtaccttacgggaccctaaccgttacgttaccgtttacggttaccctttcctaaccgtttcccttaccccggtaaccc

SEQ ID NO: 293891 - DNA, 538 bp, Homo sapiens
  misc_feature: GYAE6OF02IZ52F.48.1.A01.1.454.CMB.1.raw
  modified_base (365)..(365): a, c, t, g, unknown or other
  misc_feature (365)..(365): n is a, c, g, or t
  modified_base (507)..(507): a, c, t, g, unknown or other
  misc_feature (507)..(507): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaacgcccgaagctctaatttcgctgtctccagtttgcagagtggagtcccatctcggttcagcggcagtcggatcgtgggcagtagttcattctcacctntacaacagtccttcacgcctagaattagtttacgacttaacttacttattacgtcagcgagggtcactaccgtttcccctccgtacgtttcgggacgggtacggacgtacgggtacgtacgtacaaccgacgtggtcggtcncgactacactctcgtcttcacttcctccgcc

SEQ ID NO: 293892 - DNA, 670 bp, Homo sapiens
  misc_feature: GYAE6OF02HRAO1.48.1.A01.1.454.CMB.1.raw
  modified_base (174)..(174): a, c, t, g, unknown or other
  misc_feature (174)..(174): n is a, c, g, or t
  modified_base (190)..(190): a, c, t, g, unknown or other
  misc_feature (190)..(190): n is a, c, g, or t
  modified_base (312)..(312): a, c, t, g, unknown or other
  misc_feature (312)..(312): n is a, c, g, or t
  modified_base (396)..(396): a, c, t, g, unknown or other
  misc_feature (396)..(396): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtntctgcttctgtcgganacagagtcactatcacttgtcgggcagccaggtatgttacgtccttattagctaggtatcagcaagaaccgaagggaaacgaccccgaagcttaccttaattttcgctgtacctctagtttnacgagtaggtggtacgtacccattcgtcggttacaacggcgctaggtggaactcggtaggggacaggtacgttactatttaccnctaacactacaactaccgtccttaccgacgtacctaggaaattacgtttacgaaccttaaacttttaacttagtttacctcgtaacgtacggtaagggtacgtaacgttccggtttaccccttacccgtacgtttccggggacgggtaaccgggtaaccgtaggggtaacgggtaaccgttacgaaaacgtacgttggggtacgtaccgtacggtacctaaccgtacgttcttttaccgtacgtttcccttaacttccccttacccggtaaccc

SEQ ID NO: 293893 - DNA, 552 bp, Homo sapiens
  misc_feature: GYAE6OF02JFDM1.48.1.A01.1.454.CMB.1.raw
  modified_base (274)..(274): a, c, t, g, unknown or other
  misc_feature (274)..(274): n is a, c, g, or t
  modified_base (401)..(401): a, c, t, g, unknown or other
  misc_feature (401)..(401): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgctttctgtcggagacagagtcactatcacttgtcgggcgagccgaggatgttacgtcccttattacgcctggtatcagcaagaaaccagggaaacncccgaagctacctaatttcgctgtctccagtttgctagagtggagtcccatcgttcggttcagcggcaggtggatcgtgggcagtagttcattctacaccatccagcacgcctgcagcctagaacgnttgttcgaacttactttacttactgtaactaaagttctactactttccacccctatccctaccgttccgggaccaaacgggccacggtacgtaggacgtaagttaaacgacgttggacgtcgtcgacctacgtactcgttacgttcttacg

SEQ ID NO: 293894 - DNA, 703 bp, Homo sapiens
  misc_feature: GYAE6OF02GCX3B.48.1.A01.1.454.CMB.1.raw
  modified_base (316)..(316): a, c, t, g, unknown or other
  misc_feature (316)..(316): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtcctccatcttccgtgtctgtcttctgtcggagacagagtcactatcacgttggtcgggcgagccgaggatgttacgtccttattacgcctggtatcagcacgaaaccgagggaaacgccccgaagctaccttaatttcgctgtctcagtttgcagngtgacgtcccatctcgttcagcggcagtgatcgtgggcagtgttctacttctaccacctacgtacctaacgacgtaccctttacgtacgtccgttacggtaaagtttaacgtttttcgtaacccgttaaaaccttttaccgtttaatttcggttccgtaaggtaccgtaggggtttaccgaaccgtttaccgtttccccccgttaccccggtttaccgttttacccgggggaccggggtaaccggggtacccgggtaacggggttacgggaaccgggtaacccgtaaacggttaacgtacgggttcgggtaccgttacggtacccgacccgttacgttccgtttaccgtttcctttaccgtccttttacccccgtaccccgttaccg

SEQ ID NO: 293895 - DNA, 856 bp, Homo sapiens
  misc_feature: GYAE6OF02HV9E8.48.1.A01.1.454.CMB.1.raw
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatcgacccagtctccatcttccgtgtctgcttcgtgtcggagacagagtcactatcacgttggtcgggacgagccgaggattgttacgttaccctttattacggccgttaggtactacgagacaaacggaaaccgaagggaaccgaccccgaacgtaccttaaccttaacgttttccgcgttacgttcctaccgttaggtttcgacgtaggtacggttcgggacccgttacccgtacgttccggtttaccggttacgacggtaccggacgtaggggttcggtacggttcgggtacggggacgtaacgggtacgtttacccgacctttacccgtaaccctaaccgtaccgttaccgaacgtacccgtaccggtaccgttacggacccgtaacggttaccgttaagggttaaacgttttacgttttacggtaaaccttttaaaccgtttttacctttaacgttaccgttaaaccttaaacccgttttaaaccgtttttaaacccttaaaccccgtttaaccctaacgttaaaccgttaacccggttaccccggggtttacccgggaaacccgggtaaaccggggtaaccgtaacgggttaaccggtaaaccgacggtaaccggtaacggttacggtacgtccgttacccgacgttacccgtacgtttaccgttaccggttttaccttaccgttaccgtttacccccg

SEQ ID NO: 293896 - DNA, 595 bp, Homo sapiens
  misc_feature: GYAE6OF02GUVP1.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacgttggtcgggcgagccaggtatgttacgtcccttattagcctggtatcagcaagaaccagggaacgccccgaagctcctaatttcgctgtctcagttgcagagtggatcccagtctcggttcacgcgactggtgactcgtgggctagtacgttactattcctacgaccataccgaacacgtcctttcgaacgtccgtagtaaagttactttgacccttaaactttacttaattcgtacaggtacgagggtcacgttccgtttcccctcccgttacgtttcgggaccgggtaagggaccgtagggtacgaaccgtacgaaacgtacgtaggtcgggaccttgaccctacgtacttcgttacgttcctttactcccgttcccgtccttacg

SEQ ID NO: 293897 - DNA, 623 bp, Homo sapiens
  misc_feature: GYAE6OF02I7WB7.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgcgggcgagccaggatgttacgtcccttattagccttggtatcagacaagaaaaccagggaaacgcccgaaagcctaccttaaattttcgcttgtcctcctagtttcgacagagtggacgtccagtcctcggttcaggcggcaggtgactcgtaggggcagtagttcattcgtacaaccatacaaactacgtcctttacacgtcctaggtaagtattttagactaaactttacttaagttcgtcacgacgtagggtacgaacgttacgttttccccgtaccctacgtttaccgggaccggtaaggggaacccgtaggggttacgggaacgttacgaaacgtacgtaggtcggtaccttacggaccgtaacctacgttcgttacgttacctttacgtaccttccgttccccgtacc

SEQ ID NO: 293898 - DNA, 772 bp, Homo sapiens
  misc_feature: GYAE6OF02HTP2M.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccatcttccgtgtctgtcttctggtcggagacagagtcactatctacgttggtcggcgagccgaggtattcgttacgttccctttaagttacgccgttaggtactacgagacgaaacggaaaccgaacggggaaaccgacccccgaagtacccttaccttaacgttttccgcttacgttccttaccgttaggttttcgacgtaaggtacggtacggtaaccgttccccgtagttccggttccggttaccgacggtcggacgtagggttcgggtagttccgggtagggtacgtaaggttacgtttacctaacttttcctaccgaaaccctaacgttaccaaaccgtaccgttccctttacgacggttaccgttagtaaacgttttacgtttacggtaacccttaaactttaaccgtttagtttcggtaaccgtacggtacggtacggttaccgttaaccgtttacccgttttcccctacccggttacggttacggggaccgggtacggtaccggtagggtaccggtaacgtaccgtaaacggtcgtcggtcgtaccgtcgacccgttacgacgttcttcgttaccttaccgtacctttcccgtccgtacg

SEQ ID NO: 293899 - DNA, 556 bp, Homo sapiens
  misc_feature: GYAE6OF02H4YPE.48.1.A01.1.454.CMB.1.raw
  modified_base (226)..(226): a, c, t, g, unknown or other
  misc_feature (226)..(226): n is a, c, g, or t
  modified_base (346)..(346): a, c, t, g, unknown or other
  misc_feature (346)..(346): n is a, c, g, or t
  modified_base (355)..(355): a, c, t, g, unknown or other
  misc_feature (355)..(355): n is a, c, g, or t
  modified_base (422)..(422): a, c, t, g, unknown or other
  misc_feature (422)..(422): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatctacttggtcgggcgagccaggntgttagtcccttattagcctggtatcagaccagaaaccgagggaaacgccccgaagcctccttaatttcgctgtcttccagtttgcagagtgacgtccatctcggttcaggcgcaggtgntcgtcgggnagtgtctatctcaccatccacacgtccttacagtcctaggaattactttgactaacttactagtttnacgagtcgagggtgacgtacggtttcccctaccgtccgtttcggcggtacgggtaccggtaggtacggacgtacgaaacgtacgtggtcgctaggcctaccgattccgtgttccttctacttccgtcccgtacc

SEQ ID NO: 293900 - DNA, 738 bp, Homo sapiens
  misc_feature: GYAE6OF02GS1UP.48.1.A01.1.454.CMB.1.raw
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatgacccagtctccatcttccgtgtctgcttcgtgtcggagacagagtcactatctacgttggtcggcgacgccagggtattggttacgtccctttaagtacgcctaggtatcagtcgaacgaaaaccgagggaaacgccccgaagcctaccgttaactttcgcgttcgtctcctagtttcgcgaaggtagtcggacgtcccattcgtcggttcaggcggagaggtggactcggtggggactaggtacgttcgtacttccgtaccacctaactaccgaaacctacgtacccttacgacgccgttaaggtaaagttacgttttacggaaccttaaaaccgtttacttaacgtttcggtaacctaacggtaccgtaaaggggtttacgtaacccttaccggttttacccccttacccgtttaacggttttcccggggaacggggttaaaccgggtacccgggtaagggtacccgggtaaccgtaacccggtaaacggtaaccggttcgggtcggtaccgttcggacccgtaacgttacctttaccggttccgtttaccgttccgtaccgtttcccgtaccccgttaccg

SEQ ID NO: 293901 - DNA, 861 bp, Homo sapiens
  misc_feature: GYAE6OF02JYU7T.48.1.A01.1.454.CMB.1.raw
  modified_base (160)..(160): a, c, t, g, unknown or other
  misc_feature (160)..(160): n is a, c, g, or t
  modified_base (175)..(175): a, c, t, g, unknown or other
  misc_feature (175)..(175): n is a, c, g, or t
tcagagtatacatacacgaccggtgctcgatttagacgtctcatcagggggagtcagacccagtcaggactcagcatggacatgagggtcccgctcagctcctggggctcctgctgctctggttcccaggttccagactgcgacagtccagatcgacccngtctccatctccgtntctgcttctgtcggacgacagtacgtcacttatcgactttcggcgggctaacggccaagggtactttcggtttacgtaccccttttagttacgtaccgttgggtacttaccgaaggtccgaacgtaaaaacccggaacgggaaaaccggtacccccggaaaacgtccttaaccccgtttaacgtttttacccggaccgttcggtttaccgttacccgtttaaaggtttttccggaccggtaacggtttaaggtttccgggaaccggttaccccgtacggttttacccggttcccgggtttagttaccggacccggttagacggttacgggtacgttcggggtttacggggaccagggttaaccttcgtaccgttacctttacccgaaccgtacttacctaaccgtaccgttacccgtttaccgaaccggtacccgttaaggtaaaccggtttacgtttacggtaaacccttttaacggttaaactttacggtttacgtacggtcggttaaggtaaccgggttccggtaaccgttaaccgtttcccgtaccccgtttacgggttaccgggtacgggtaccggggaacggttacgggtacggtaccgtaacgtaacccgtacgtcggtacgttacgcgtacctactacttaccggtcttccgttaccacgtttaccctaccgttaccg

SEQ ID NO: 293902 - DNA, 726 bp, Homo sapiens
  misc_feature: GYAE6OF02GD3UV.48.1.A01.1.454.CMB.1.raw
  modified_base (185)..(185): a, c, t, g, unknown or other
  misc_feature (185)..(185): n is a, c, g, or t
  modified_base (192)..(192): a, c, t, g, unknown or other
  misc_feature (192)..(192): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtcctccatcttccgtgtctgcttcngtcgganacagagtcactatctacttggtccgggcgagccgaggtattggttacgttacccctttaagttacggcccttggtactacgacgaccgaaacggaaaaccgaacggggaaaaccggacccccggaagtacccgttacctttaacgtttttcccgacttcgttcctacctaggttttacgaccgtaaggtaggtcgggacgttcccctagttccggttccggttcgacggtccggtactacgggtaggtacgtcgggtaggggacgtaacggtaggtttacctacgtttccgtaccaacctactacaaccgtacgtcccttacgacgtaccgtagtaagttacgtttagacctaaacctttacttacgttactcgacgtacgtagggtactacgttaccgttcccctacgttaccgtttcgggacgggtaccgggtacggacgggttacggaccgaacgtaacggtacgttcggtgaccgtacgacccgtactagttcgtcgttccttaccgtaccgttacccgttcccggtacc

SEQ ID NO: 293903 - DNA, 543 bp, Homo sapiens
  misc_feature: GYAE6OF02FPG8X.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggtatgttacgtcccttattagcctggtatcagcagaaccaggaacgcccgagctactatttcgctgtctctagttgcagagtgagtccatcgtcgtcagcgcagtgatgtgggcagtatcattcacaccatcaactacgtccttcacgtcctagtaacgttatttacgacctaacttacttattcgtacagtcgagggtcacgtcgtttccctacctacgttccggcggtacgggaccgtagggtcgacgtacgaacgtacgtggtcggacgtcgccgtacctacgttcgttcgttccttactacttcccgtacccgtacc

SEQ ID NO: 293904 - DNA, 740 bp, Homo sapiens
  misc_feature: GYAE6OF02FR9IW.48.1.A01.1.454.CMB.1.raw
  modified_base (174)..(174): a, c, t, g, unknown or other
  misc_feature (174)..(174): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtntctgtcttctgtcggagacagatcactatctacgttgtcgggcacgccaggattgttacgtccctttatacgcctggtatcgacgacaacgaaaccgagggaaaccgccccgaaagtccttaccttaactttcgcttcgtcctccgttagttcgactaggtagtcggacgtccattccgtacggttacaggcggtacgtaggtcggagttccggtggggtactaacggtagttccgtactttaccgaccaacctaacgtaccaaacgtacgtcccttacgacgtacccgttaaggtaaagtttacggtttacaaccgttaaccttttaactacgtttacggtccgtaaggtacgtacggggttaaccgttaacccgttaccgtttacccccggttaacccgtttaccgggtttaccggggcccgggtaacggggtaaccggtaacggggtcgtaaccggttaaccgtaaccgtaaccggttagggtccggtaacgttaccgtacccgaaccgtacgttccgttacgtttacccgttactttacccgtttaccccggctttaaccgg

SEQ ID NO: 293905 - DNA, 800 bp, Homo sapiens
  misc_feature: GYAE6OF02HABDY.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccattcttccgtgtctgcttctggtcggagacaggagtcactactctacttggtcggcgagccgaggattgttacgtccctttatacgtccgttggtatcgagacaacggaaaaccgagggaaacgccccgaagcctaccttaattttcgcgttgtctaccgtagtttcgactaaggtggtacggacgttaccctacgttccggttaccgggtttccacgggtccggtacgtaacggggttcggtaacgttcgggtacgggggtactaagggtacgttttccgaacttttccctaccgtaacccgtaacgtacccgaaaccgtacggttaccctttacggaccggttacccgttaagggtaaacgtttacgttttaacggaaccctttaaaacgttttaacgttacgttttacggtaaccgtacgggtaaccgtaaggggttccgttaaacccgtttacgttttccccccgttacccggttaccggtttaccggggacccggggttaacgggtaaccggtaggggttacgaacccggttaacgaaaccggtacggtttcgggcggtaccgtagtacccgtaaccgtcggttaccgttacggttacccgtttaacgtaccgttcccgttacccgaccg

SEQ ID NO: 293906 - DNA, 647 bp, Homo sapiens
  misc_feature: GYAE6OF02G94M9.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctggtcggagacagagtcactatcacgttggtcgggcgagccaggtattggttacgtccctttagttacgccgttggtatcgagacaacgaaaccgaagggaaacgaccccgaagtcctaccttaactttcgctgtctcgtagttgctagagtggacgtccatcgtcggttcaggcgcgtaggtggagtcgtgggacgtaggtagttctaattccaccacctataccgaacgtacgtaccttacgacgtaccgtagtaacgttactttacgacttaaacgtttacttagttacgtacgagtcgacgggttactaccgttaccgtttacccctacccgttacggttccgggaaccgggaacgggtacccggaagggtaccgtaacggtaaccgtaacgtacgtacgggtgccgtacggcctaaccgtattccgttacgttccttacgtacgttcccttacccgtacg

SEQ ID NO: 293907 - DNA, 653 bp, Homo sapiens
  misc_feature: GYAE6OF02GK4VN.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtcctccatcttccgtgtctgcttctgtcggagacagagtcactatcacttggtcgggcgagccaggatgttacgtccctttattagcctggtatcagcaagaaaaccgagggaaacgccccgaagcctccttaattttcgctgtctccagtttgcagagtggacgtccatctcggttcagcggcaggtgatcgtggggcaggtagttcatttcctacacccataccaaacgtagtccctttagacgtccgttagtaaagttattttacgacctaaactttacttaagtttgtacacgtcgtaagggtacgaaccgttacgtttccccgtaccctaccggttttccgggtacgggtacggggtaacccgtaacggggttcgggaaccggttacccgaaaacggtacgttacgggttacgggaccttacgggaccctaccgtaacgttccgttcggtttacccgttaccgtaacgtttcccgttcccccggtaccc

SEQ ID NO: 293908 - DNA, 733 bp, Homo sapiens
  misc_feature: GYAE6OF02F6PMM.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatccttccgtgtctgcttcgtgtcggagacagagtcactatctacttggtccgggcgacgccgaaggtacttggttacggttccccttaagttacggtccgttggtactcgacgacgaaagaaaccgagggaaaccgccccgaagtctaccttattttcgcttgtcctacgtagtttcgatacggtgtcggtaccgttccctaacgttccgttacggttcgacggtcggacgtaggttacggtagttcgggtcgggacgaaggtacgttctacgtttcctactacctacgtacctaaccgacgtccctttacgaacggtccgttaaggtaaacgttacgttttaacgaccctttaaacgtttaccgtttatttaccggtacggttaacgtacggagggttaacgtacccttaccggttttcccccttacccggttaccggtttcggggaccgggtaccggggtaaccgtacggggtacgtaaccgttaacgtaaccgtacggtcgggttacggaccttacggaccctactaccgttcttcggttacctaccgtcgttaccctcccgacc

SEQ ID NO: 293909 - DNA, 996 bp, Homo sapiens
  misc_feature: GYAE6OF02GRNV8.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagactcgacccagtctccatcttccgtgtctgtcttcgtggtcggagacacgagtacactatctacgttggcgggacacgccaaggtacttcgttacgttacccttagttacgtccgttggtactcgaacgtacgaacggtaaaaccggaagggtaaaccggacccccgtaaaggtcccttaaccgtttaaacgtttttccggaccgttcggttacccgtttacccgttacgggttttcgaccgtaagggtaacggttaccggtaccggttacccctaacggtttccgttaccgggtttacgaaccggggtcggtaaccgttacggggttacgggaacgtttccggggtacgggggttaccgtaaacgggtttaccgtttaaccggttaaactttttcccgtaaacccggttaaacccctttaacggtttaaaccccctaaaacccgggttccgtttaacccccgtttaaccggaaaccggttcccggttaaacgggttaaaaacgttttcgttttaaaccggtaacccgtttaaaacttttaaacccgtttaacggtttcggtttaaacccggaacgggttacccggttaagggggtttaacccttaaacccgggtttaccgtttttccccctaacccgttttaaaccggggtttcgggtaacccgggggtaacggttaaacccggggtaggggggtttacctaaaacccgggggtttacgtaaaaccggttaacccggtttcgggtaaccggttacccggttacgaaccccgttaaaccgttcgttaaccgggtttccttaacccggtttacccgttacccgtttaccccggttaccccgtaaccc

SEQ ID NO: 293910 - DNA, 593 bp, Homo sapiens
  misc_feature: GYAE6OF02IIY85.48.1.A01.1.454.CMB.1.raw
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (380)..(380): a, c, t, g, unknown or other
  misc_feature (380)..(380): n is a, c, g, or t
  modified_base (412)..(412): a, c, t, g, unknown or other
  misc_feature (412)..(412): n is a, c, g, or t
  modified_base (525)..(525): a, c, t, g, unknown or other
  misc_feature (525)..(525): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacgttggtcgggcgagccaggattgtttacgtcccttaattacgcctggtatccgagcaagaaaccgagggaaacgcccccgaagcctaccttaattttcgctcgtctccgtagtttgactgagtggacgtcccatcgtcggtcaggcgcgagtgatcgngggcagtnttcattcncacatacacgctccttcagtcctagtaacgtntttcgacttaaacttacttagtttcgactaggcgtaggtgaacgttaccgtttccctacccgtacgtttccgggacgggacggtaccggagggttacggaccgtaagaaccgngttacggtcggtacgtcgaaccgtaccgtagtcttcgttaccttccgtacttcccgttacccgtaccg

SEQ ID NO: 293911 - DNA, 789 bp, Homo sapiens
  misc_feature: GYAE6OF02HHFKP.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggtcccaggttccagatcgcgacatccagatcgacccagtctaccattccttccgtgtctgtctttcgtggtccggagacgagagtccacgtatcctacgtttcgtcgtcgggacgacgacccgaagggtacttacggtttaccgtttccccgttaagtttacggtcccgttagggtactcgagaccgtaaacggaaaacccggaagggaaaccgacccccggaagtcccttaaccctttaagttttccgtcttcgttcctacccgttaggtttcgacgaaggtacggtcgggtaccgtcccgtacgttcggttcggttaccgaggtcccgggtagtacgggtcggtagtttccgggtggggactagggtaactttctacgtttcctaccaacccgttactaccgaaacctaccggttaccccttaccggtaacgtacccgttaaggttaaacgtttacttttacggaaccttaacgtttacttagttcgtacgacggtacgtagggttactaccgtttaccgtttccccgtacccgttacgggttccgggaacggggtaccggtacggtagggtaccgtacgtacgaacggttacggtggtacggtcccgcgtaccgttaccgtagtttcctccgtttacccgtacttacccgttccgttaaccccg

SEQ ID NO: 293912 - DNA, 607 bp, Homo sapiens
  misc_feature: GYAE6OF02GE5ZI.48.1.A01.1.454.CMB.1.raw
  modified_base (225)..(225): a, c, t, g, unknown or other
  misc_feature (225)..(225): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
  modified_base (383)..(383): a, c, t, g, unknown or other
  misc_feature (383)..(383): n is a, c, g, or t
tcagagtatacatacacgaccggtgctcgatttagacgtctcatcatgggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggntgttagtcccttattagcctggtatcagcaagaaaccagggaaacgccccgaagctcctaattttcgctgtcctcctagtttgcgagagtggagtcccatctcggttcagcggcngtggatcgngggcagagttcattctcacatcaacacgtccttnacgtctagtaacgtattttacgactaactttaacgtatttcgtacagtccgagggtacgtaccgtacgtttacccctacccgtacgttttccggggaccgggtaacgggtacccggaaggggttacgggtaaccgttaccgaaaaccggtaacgttcgggtacgggcctacgaccgtaaccacgttcctttcggttacccttcgtaccttcccgttaacccccg

SEQ ID NO: 293913 - DNA, 743 bp, Homo sapiens
  misc_feature: GYAE6OF02GOSMQ.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttcgtgtcggagacagagtcactatcacttgtcggcgagccaggatgttagttcccttattacgcctggtatcagcaagaaaccgaggaaaccgacccgaagccttaccttaatttcgcttcgtcttcctagtttcgactaggagtacggacgtccctactcgtcgttcgacgcgcgtagtggacgtcgtgggctagtacgttcgtaacttcgtaccaccgtactaccgaacgacgtaccgttacctacggtacccgtagttaacgttacttttacgaccttaaacgtttaaccttaagtttacgtacttacgggtacgtaacgggtttacgtaacccgttaccggttttaccccgttaccccgtttaaccgtttcccggggtaaccgggtaacccggggggtaaacccgttaacgggggttaaccggtacccgttaaacggtaaacccgggttaaccgtttcggggtaacggtaccgttaccgggtaacctaacccgttacgtttaacccgggttcctttaccgtttaccgttaaccgttttccccgttacccccgttacccg

SEQ ID NO: 293914 - DNA, 657 bp, Homo sapiens
  misc_feature: GYAE6OF02IRGVA.48.1.A01.1.454.CMB.1.raw
  modified_base (369)..(369): a, c, t, g, unknown or other
  misc_feature (369)..(369): n is a, c, g, or t
  modified_base (629)..(629): a, c, t, g, unknown or other
  misc_feature (629)..(629): n is a, c, g, or t
tcagagtatacatacacgaccggtgctcgatttagacgtctcatcagggggagtcagacccagtcaggactcagcatggacatgagggtccccgctcagctcctgggctcctgctgctctggttcccaggttccagatgcgacatccagatgacccagtcctccattcttccgtgtctgtcttcgtgtcgggagacagtagtcactatcactttggccgggcgagccaggtattgttacgttcccttagttacgtctggtatcagacaagaaaccgaagggaaacgaccccgaagccttaccttaatttcgcttcgttccttccgatttgacgaggtgtaggtactcctatccgtcgttcacggcgtanaggtgattcgggtcgggctaggtacttctacgttccacaacctataccaacgtcctacccttacgacgtacctaggtaaagttatttcggtaacttaaacgtttacttaacgttgtactaggtacgtagggtacgtaacttcccggtttaccctcccggttacgtttaccgggaaccgggtacgggtaaccggtagggtaacggtaccgttaacgaaccgggtacgtggttccggcttacgggaccctaccgtattcgtntaccgttccgaccgtttccgacccctag

SEQ ID NO: 293915 - DNA, 664 bp, Homo sapiens
  misc_feature: GYAE6OF02I4FLR.48.1.A01.1.454.CMB.1.raw
  modified_base (417)..(417): a, c, t, g, unknown or other
  misc_feature (417)..(417): n is a, c, g, or t
  modified_base (612)..(612): a, c, t, g, unknown or other
  misc_feature (612)..(612): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatgacccagtctccatcttcgtgtctgtcttctgtcggagacacgagtcacttatcctacgttcggtcggggcgacggccaggtagttcggtttacgtcccttttaatacggtccgttggtactcgagacaacgaaaccgaagggaaaccgacccgtaagtccttaccgttaacgttttcgctcgttcctccttagtttcgacgaggtagtagggactacccgtattcgttccggttacgacggcggacgtaggtggtattcgggngggtacgagttagttctacgttctaccacgaatccaactcgtacctacgacgtactagtaacgttgtttaacgaccttacctttagtacttgactagcgtacggtcgtaccgttaccgttcccgtaccgttacgtttaccgggacgggtacgggaacggtacgggtcgtaaccgtacggaacgtacggttacggngtaccttacgaccaccgttctcgttcgttcctactcgtttacccgtccgtac

SEQ ID NO: 293916 - DNA, 638 bp, Homo sapiens
  misc_feature: GYAE6OF02GDMK5.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatctacttggtcgggcgagccgaggattgttacgtcccttagtacgccttggtatcgagacgaaacgaaaaccgaaggggaaaccgcccccgaagtccttaccttaagttttccgtccttgttccctaccgtagtttcgacgtaggagtcggactcccgattccgttcggttacacggccggactaggtcggagtcggtgggacgtagtacgtctacttctacacctatacgaacgacgtcctacgacgtcgtagtaagtttactttacgaccttaacttacgttattacgtacgacgtcgtacgggtctaccgttaccgtttccctccgtcgtttaccgggacgggtacggacgtgggtacgtacgtacgtaacgtacgtggacgtcgtcgacccgtactacgtcgttcttaccgttctacgttccctaccgtccg

SEQ ID NO: 293917 - DNA, 853 bp, Homo sapiens
  misc_feature: GYAE6OF02INIP2.48.1.A01.1.454.CMB.1.raw
tcagagtatacatacacgaccggtgctcgatttagacgtctcatcagggggagtcagacccagtcaggactcagcatggacatggagggtccccgctcagctcctggggctcctgctgctctggttcccaggttccagatgcgacatccagatcgacccagtctccattcttccgtgtctgtcttcgtcggtcggaagacagtacgtctaacttatcctacgtttcgggcgggacgaacggaccgaaggtatttaccggttacgttaccccgttttaattaccggtcccgttaggttaactaccgaacggaccgaaaaccggaaaacccggtaaacgggggaaaaccccgtaccccccgggtaaaacggttcccctttaacccgttttaaacgtttttcccgggtacctttcgttacccgttacccgttaggttttacgaccgtaaggtaacgggttaccggacgttaccccgtagtttcccggtacggttacacggggccgtacgtagggtcgtacggtcggtaggggactaggtagttccgtatttacccgtaccgtactacgtaaccaacggtccgttacccgttagacggtacccttagggtaaaccgtttcttttaaccgggtaaccttaaaccttttaccggttattttaccggaaacgtacggttaccggaacggggtttaacttacccggtttaccccgtttacccctaccggtttaccgttacgggggaccggtaacgggtaaccgggtaggtaggtaaccctaacggaacgtaaccgttggtaacgtccgtaacgacgttaccagtttccgacttaccttcggtacccttcccgtaccgtacg

SEQ ID NO: 293918 - DNA, 594 bp, Homo sapiens
  misc_feature: GYAE6OF02FKXUE.48.1.A01.1.454.CMB.1.raw
  modified_base (254)..(254): a, c, t, g, unknown or other
  misc_feature (254)..(254): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttacgtccttatagcctggtatcagcanaaaccagggaaagcccccgaagctacctaattttcgctgtctccagtttgcagacgtggagtcccatctcggttcagcggcagtggatcgtggggcagagttcgaattctcacctataccaacacgccctttcgacgtccctagaaacgtacttttagcctaaactttaacgttaaatttcgtacaggtaccgtaggggtcacgttaccgtttccccttacccgtaccgttttccgggacgggtaacgggacccgtaaggggttacggacgttaaccgaacggtacgtgtcggtacctgtaccgaccagttctacgttccttcacttcctccccgtaccc

SEQ ID NO: 293919 - DNA, 638 bp, Homo sapiens
  misc_feature: GYAE6OF02FMDLC.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttggtcgggcgagccaggtatgttacgtcccttattagcctggtatcagcaagaaaccgaagggaaacgccccgaagccttaccgtaattttccgctctctccgtagtttgcaggaggtggacgtccattccgtcggttcgacggtcggactaggtggacttcgtcggggctaggacgttcgattccgtacaccgtactacgtaacacgtccttaccacgtacccgttagtaagttacttttcgaccttaaacgtttaaccttatttacggttccaagtcgtagggtacgtaaccgttacgtttccccgttaccgttaccgtttacgggtaccgggtacgggtaccgaggggtcggaccgttaacgtaacgtacggtggtcggctcgacctacgacttcgtcgttcttaccgtacgttcccttcccgtaccg

SEQ ID NO: 293920 - DNA, 812 bp, Homo sapiens
  misc_feature: GYAE6OF02JX3TO.48.1.A01.1.454.CMB.1.raw
  modified_base (141)..(141): a, c, t, g, unknown or other
  misc_feature (141)..(141): n is a, c, g, or t
  modified_base (150)..(150): a, c, t, g, unknown or other
  misc_feature (150)..(150): n is a, c, g, or t
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagagtatacatacacgaccggtgctcgatttagacgtctcatcagggggagtcagacccagtcaggactcagcatggacatgacgggtccccgcgtcagctccgtgggctctgctgctcgtgtccaggtcagatgcganatccagacncgacccagtctaccagtccttaccgtgtcctgtcttgtcggtacggacgtanacgtacgttcaaccgtatacgtacgttgggtccggacgtacgcgaggtaagttcggttacttccctttaagtcgtaccgttggtactanacggacgaaccgggaaacccgtaaccgggtaaacccgaccccgggactaccgttaccgtttaaactttcccgtcgttaacgtcgttaaacccgtaggtttaccgacggtacggttaaccggttacggaacccgttccccgtttaacgttcccgttaaccgggtacgttaccggtaaccggtcccggtaggacggttaccgttcgggaccgggttactaccggtacgtttacccgttatttaccccgacgtaaccctaagttaacccgaaccgtaccgttaccttacggtaccgtacgtagtactttaaggttcctaacgtaacttaccgttagttacgtcgaacgttacgtaggtaccgttaccgttaccgtttacccgtccgtaccggttaaccggtcccggggtaactacccggggagtacggttaacccgacggtaacgtagcggttcggaacgtaccgtacgtaccgtagtttccgttaaccgttacgttaccgttaaccttccccgtacttaccgg

SEQ ID NO: 293921 - DNA, 854 bp, Homo sapiens
  misc_feature: GYAE6OF02G7XFH.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatccttccgtgtctgtcttcgtaggtcggagacagtacgtcactatcctacgttcggtcgggcgacgccgaggtattagtttacgttaccctttaagttacgtccgttaggtactcgagtaccgaacggaaaccgaagggtaaaccgacccgaacgtaccttaccgttaacgttttcggacttcgttacctaccgttagtttcgacgtacggtaggtcggtacgtaccctacgtttccggttaccggttaccgacggtaccggacgtacgggttacggtaacgttcgggtacggggtactaagggttacgtttccgttaaccgtttacccgttacccgaaacccttaacgtaacctaaacccggtccgtttacccgtttaacccgaccggtttacccggttaaacgggtttaaaccgttttaggttttaacccgaaacccgtttaaactttaccgtttaaacggtttcgttaacccgtacgggtaacggttacgggtaacgttacccgtttaccgtttaccccccgtaccgtttaccggttaccggggtaaccggtacggggttaacccggtaacgggtccgtaaccgtaacgaacccgtaggttaccgggtcggtacttaacggaccctaacgttaggttcccgtttaacgttcctaccgtttaacccggttcccccgtacccgtaccg

SEQ ID NO: 293922 - DNA, 763 bp, Homo sapiens
  misc_feature: GYAE6OF02FJCG0.48.1.A01.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
  modified_base (267)..(267): a, c, t, g, unknown or other
  misc_feature (267)..(267): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatgacccagtctccatcttccgtgtctgtcttctggtcgganacagagtcactntctacttggtcgggcgacgcgaggtattggttacgttccttagttacgcctggtactcgacncaacgaaaccgtacgggaaacgccccgaagccttaccgttaattttccgcttgtacctcgtagtttcgactaggagttcggacttcctacgttcgttcggtcgaggccggtacgtacggttacgggtacgttcgggttacgggggaccgtaaggggtactttaccgtacgttttacctacccgtaacctacgtaacccgtaaccgttacccgtacctttaaccgtacgtcccgttaaagttaacggtttacgttttaccgaaccgtttaaacgtttaaaccgttacggtttacgttacggtaaggtacggttaacggggtaccgttacctttaaccgggtttaccccttacccggttacggttcgggtaccgggtaaccggggtacgtaacggggtaccgtaaccggtaacgttaaccggacggttacggcggtaccgttcgaacccgtcgtaacgttcttacggttccgttactacccgtttccgcccttaaccg

SEQ ID NO: 293923 - DNA, 887 bp, Homo sapiens
  misc_feature: GYAE6OF02GYNG4.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgtcttctgtcggagacagacgtcactatctacgttggtccgggcgagccgaggtacttgttacggttaccctttagttacgtccgttggtatcgagaccaacgaaaccggaagggaaacgccccgaagtccttacctttaacttttccggacttcgttccttaccgtaggtttacgacgtaggtaggtcgggtacctaccccgtattccggttccggttacgaacgggtccggtaccgtaggggttcggaacgttccgggtacgggggtacctaagggttaacggtttacctaacgttttaccccttaactaaccccgttaaacgtacccgtaaaccggtaccggttacccctttacgaacggttaccccgttaaaggtaaaccgtttagttttaaccggaacccttaaacgttttaaccttaacgtttcggttaaccgtacggtaaccggttaacggggttaccgtaacccgtttacccggttttaccccccttacccgggtttaaccggtttacccgggggaaccggggttaacccgggtaaccgggttacgggggttaaccgggtaacccggttaacgtaaacccgggttacggttaccggggttcgggaccccgtttacggaacccgtaacccgttacgtttcccggtttaccggtttaccctttaacccgttacccgggtttaccccttacccccggttaacccg

SEQ ID NO: 293924 - DNA, 897 bp, Homo sapiens
  misc_feature: GYAE6OF02FYOKF.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgaccctagtctcctatccttccgtgtcgtgtcctttctgtcggagacagagtcactatctacgttcggtcgggcgacgccgaaggtacttggttacgttccttattcgtccttggtactcgacgcgaaagtaaacccggaaggggaaaccgcccccggaaagtcccttaacccgtttaaactttttccggactttcggttaccgttccgttaggttttcggaccgtaagggtaccgggttcgggtaacccgtttaccccgtacgtttacccggttacccgggtttcccgaaacgggggttaccggtcgggttaacgggggttacgggttaacggttcccggggtttcgggggaacgttaacggggttaccgttttaccgtaaccgtttttaccccggtacctaaacccgtacttaacccgtaaaaccggaccgtttcccgtttacgaccccggttacccggttaaggtaaaaccggttttagtttttaacccggaacgttaaaacccttttttaacggttgttttaaccggttcgtaccggtacggggttacgggtttaccgtaacccggtttttccgttacccccctttacccggttttccggggttccggggtaaccgggtacgggtaacccggtaggggttacgggaacccttaacggtaaaccggtacggtcgggttcgtaccggtcggaacccttccgtgttccgttcttacgttcccgttacttccccgtcccgttacg

SEQ ID NO: 293925 - DNA, 841 bp, Homo sapiens
  misc_feature: GYAE6OF02FJ4RY.48.1.A01.1.454.CMB.1.raw
  modified_base (817)..(817): a, c, t, g, unknown or other
  misc_feature (817)..(817): n is a, c, g, or t
tcagagtatacatacacgaccggtgctcgatttagacgtctcatcaggggggagtcagacccagtcaggactcagcatggacatgagggtccccgctcagcctcctggggctcctgctgctcgtggttcccagggttccagatgcgacatccgagatcgaccctagtcctcacttccttccggtgtctgtcttcgtgtcggataacgagacgttacacgtaacctctacggttcgggtccgggcgacgtccggaaggtactttcggttacgttacccttaagttcggtccttaggtattacgacgtaacgaaacgtaaaccgggaacgggtaaacccggaccccggtaaacggtacccttacccgtttaaacttttacccggtccgtttacgtcccgtttaaccgttacgggttttacaccgttaacgggtggtaaccgggttacctaccccgttaagttccgggtttccgttaacggaaggttacccggtaacgtaggttaccgggtagttaccggggtgggtaacgtacgttacgttaccgtacctttaccgtacctaaccgtataacccgtaacgtcccgtacctacggaccgttaccgaaggttaaccgtttagttacccggtaccttaaagtttaacctaggtttaccgttacgaccggtaacggttaacgggttacgtaacccgtttacccgtacccgttacccgttaccgggttcggaaccggggtacggtaaccggtcggttaaccgggaccgtaaacggtaccgaggttacgtcggtcaacgtacgtacgttacgttctacccggttnttaccgtaccgtccctcggtaacc

SEQ ID NO: 293926 - DNA, 743 bp, Homo sapiens
  misc_feature: GYAE6OF02F5P8H.48.1.A01.1.454.CMB.1.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (226)..(226): a, c, t, g, unknown or other
  misc_feature (226)..(226): n is a, c, g, or t
  modified_base (705)..(705): a, c, t, g, unknown or other
  misc_feature (705)..(705): n is a, c, g, or t
tcagagtatacatacacgaccggtgctcgatttagacgtctcatcgagggggagtcgagacccagtcaggactcagcatggacatgagggtccccgctcagctcctggggctcctgctgctctggttcccaggttccagatgcgacatccagatcgaccctagtcctccatcttccgtgtctgctttcngtcgganacagntcactancncttgcggcacgcaggntcgttacgtcccttatacgccttggtactcagtacaacgtaaaaccgacgggaaaccgcccggaaagtccttaccgttaactttttccggtcttcggttccttccgtaaggttttcgaccgtaaggacggttcgggacggttcccctaattccggtttaccggtttccgaacggtccgggcctagggttaggacttcgggttggggactaagggtacggtttaactacgtttcccggtactacccgtaattacccaacgtaccgtacccttacgacggtacccgtagtaaccgtttagtttccaacttaaccgttactttagtcgtacgtacggtacgtacggggttaccaaccgtttcccggtttacccctccccgtttacgggtttacccgggaaccgggttaccggggtaccggtacggggttccgggaaccgtttaccgaacgttacgttggtcggccttacgggcctacccgtnttacgttcgttccttcacccgtttccgtccccgtaacg

SEQ ID NO: 293927 - DNA, 807 bp, Homo sapiens
  misc_feature: GYAE6OF02JJ6TK.48.1.A01.1.454.CMB.1.raw
  modified_base (121)..(121): a, c, t, g, unknown or other
  misc_feature (121)..(121): n is a, c, g, or t
  modified_base (139)..(139): a, c, t, g, unknown or other
  misc_feature (139)..(139): n is a, c, g, or t
tcagagtatacatacacgaccggtgctcgatttagacgtctcatcagggggagtcagacccagtcaggactcagcatggacatggagggtccccgctcagctccgtggggctcctgctgcnctcggttccaggttcagntggcgacactccagactcgaccacgtcctcctacttccgttccgtgtctgtcctttcgttaggtcggaagtacgagtacgtctaactagtactacgttggacgggcgacgccgaggtacgttgtttaacgtccctttaagtcgtccggtagttactcgacgacgaaaccgaaacggtaagggaaaccgacccgaacgtccttacttacgtttaccgtcttacgtccttaccgtacgttacgacgtagcggtacggtaaccttccctacgtttccggttacggttacgacgggtaccgtacggtaggtaccgggcgttacgggttcggtagtacgttacgtcgtttaaaccgttaccgacctacgtacgttaacgtaaccgtcccgtttaaccggttcggaaccttacggttaacgttaagggtttacctttacgaaccctttaccggtttaacttaggttactaacggtacggtacgggttacggttaaccgttaccggtttaccctttcccgttaacccgtttacgggttaccggggtaccggggttaaccggaacgggtcggggttaaccgtaccggtaacctaacgggttcggacggtttcgaccgtcgtaaccctcgtaaaggtccctttgttacccggtactacccgttaccttaccgtaccg

SEQ ID NO: 293928 - DNA, 749 bp, Homo sapiens
  misc_feature: GYAE6OF02HVO3Q.48.1.A01.1.454.CMB.1.raw
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatcgacccagtctccattcttccgtgtctgtcttctggtcggagacagagtcactatctacttggtcggcgagccaaggtatgttacgttcccttattacgccttaggtatccagaccgaaggaaaccgaggggtaaaccgaccccggaagtaccttacctttaacgttttccgacttcggttccttccgtagtttcgcgtaggtacggtcggtacgtacccgtattccgtcgggttacacggcggtaccgtaaggtcggtacgttcgggtacggggactaaggttaccgtttactacgtttacctacccgtaaaccgtacttaacccgtaaactcccggtttaacccgtttaccgaacggtcccgtttaaggttaaacgtttaacgtttaccggaaacctttaaactttaccgtttagttcggtactacggtagtacgggtacctaacgtttcccgtttacccttacccgttacgttcgggacgggtacgggtacccggtagggtaccgtaaccgtaaccgaacggtcgtgggtccgtccgtagacccttaacgtcttcgttacgttaccttaccgtactttccccggtaacctaccg

SEQ ID NO: 293929 - DNA, 815 bp, Homo sapiens
  misc_feature: GYAE6OF02HGIEN.48.1.A01.1.454.CMB.1.raw
tcagagtatacatacacgaccggtgctcgatttagacgtctcatcagggggagtcagacccagtcaggactcagcatggacatgagggtccccgctcagctccgtggggctctgctgctctggttcccaggttccagatgcgacatccagatcgacccagtcctacctatccttccgtgtcctgtccgtttctggtacggagactaggacgtcctaacttagtctaccgtttggtaccgggacggtaacggccgaagggttacttaggtttaccgttaccccttttaagttaccggtacccgtttaggtaacgtaccgaacggaccaaaacgggaaaacccggaacgggggtaaacccgacccccgggaaagtacccctttaaccgttaaacgttttccggacctttcgttaccttccgtaaggtttcgactacggtacggtacggtaccgtaccgtagttccgtcgggttaccacgggtcggtactacggttacggtagtccgggtacgggtacgtaggtacggttctacgttccaaccgtaacctaactaaccgtaaacgtcccgtacccgttacgaacccgtacgtacgtaaaggtttacgtttaccgtaaccttaaacctttacgtttacgtacgttaaccggagtacggtacgttacgtaaccgtttaccctttccccgtaccgttacgggttccgggaccgggtaacggtaccggtagggtaccggtacggtaaccacggtaccgttggacgtacggtcgaacccttacgtacgttcgtacgttcctaccggttaactcgtccctaacg

SEQ ID NO: 293930 - DNA, 720 bp, Homo sapiens
  misc_feature: GYAE6OF02F7IVP.48.1.A01.1.454.CMB.1.raw
  modified_base (224)..(224): a, c, t, g, unknown or other
  misc_feature (224)..(224): n is a, c, g, or t
  modified_base (333)..(333): a, c, t, g, unknown or other
  misc_feature (333)..(333): n is a, c, g, or t
  modified_base (355)..(355): a, c, t, g, unknown or other
  misc_feature (355)..(355): n is a, c, g, or t
  modified_base (362)..(362): a, c, t, g, unknown or other
  misc_feature (362)..(362): n is a, c, g, or t
tcagagtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttcgtgtctgcttctgtcgagacagagtcactatcacgttgtcgggcgacgccaggntgttacgtccctttagttacgccgttggtatcgagctaagaaaaccgagggaaacgaccccgtaagccttaccttaattttccgcttcgtctccgtagtttcgcgtagngtggactcccgatcgtcggtcngcggtanaggtggctcggtcgggctaggtacgtttcgtattcgtacaaccgtactacaaacctagtcccttagacgtcccggttaagtaacgtttagttttacgaaccttaaaccttttacgttaagtttcgtacgaacggtacgttaaggggttaccgtaccgtttaacccggtttaccccgttaccccgttaacggtttcccggggaccgggtaaccgggtaacccggtagggggttacccgtaacggttaccgaaaccggttacgttacgggtacgggtaccgttaccgtacccgaaccgtttacgtttacccgtaggtttacctttcccgtacgttttacccccgtttacccgtaaccccg

SEQ ID NO: 293931 - DNA, 685 bp, Homo sapiens
  misc_feature: GYAE6OF02GLYEL.48.1.A01.1.454.CMB.1.raw
  modified_base (286)..(286): a, c, t, g, unknown or other
  misc_feature (286)..(286): n is a, c, g, or t
tcagagtatacatacacgaccggtgctcgatttagacgtctcatcagggggagtcagacccagtcaggactcagcatggacatgagggtccccgctcagctccgtggggctcctgctgctctggttcccaggttccagatgcgacatccagatgacccagtctcatcttccgtgtctgcttctgtcggagacagagtcacgtatctacgttggtcgggcacgccgaggtattgttacgtcccttagttacgccgttggtatcgagcaacggaaaccgagggaaacnccccgaagtccttaccgttaatttcgacttcgtcctaccgtagtttcgcgtaaggtcggtacggtacgtccccgtaagtttccggtccggttacgacgggccggtaccgagggttacggacgttcgggtaggggaccagggtacgttctaacttccggtccaacctataccaacgtacgttcccttagacgtccgtagtaacgtttatttcgaacttacttattagttcgaacgacggtacgagggttactaaccgttccgttaccccgtaccgttaccgttcggggccgtaacgggtccgtagggtcgtaacgtaccgtaacgtcggttcggtcggtaccgtcgacccgtacgtacttcgttacgttaccgttcctaccgtttcccgtacccgtaccg

SEQ ID NO: 293932 - DNA, 295 bp, Homo sapiens
  misc_feature: GYAE6OF01B55H6.21.75.G09.1.454.CMB.1.raw
  modified_base (292)..(295): a, c, t, g, unknown or other
  misc_feature (292)..(295): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccgccctcctcctcgtctctactgagcgggctggcaaggcgcatagnnnn

SEQ ID NO: 293933 - DNA, 300 bp, Homo sapiens
  misc_feature: GYAE6OF01AHL4G.21.75.G09.1.454.CMB.1.raw
  modified_base (292)..(300): a, c, t, g, unknown or other
  misc_feature (292)..(300): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccaccctcctcctcgtctctactgagcgggctggcaaggcgcatagnnnnnnnnn

SEQ ID NO: 293934 - DNA, 296 bp, Homo sapiens
  misc_feature: GYAE6OF01B9CX7.21.75.G09.1.454.CMB.1.raw
  modified_base (291)..(296): a, c, t, g, unknown or other
  misc_feature (291)..(296): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccgccctcctcctcgtctctactgagcggctggcaaggcgcatagnnnnnn

SEQ ID NO: 293935 - DNA, 357 bp, Homo sapiens
  misc_feature: GYAE6OF01BT04N.21.75.G09.1.454.CMB.1.raw
  modified_base (304)..(305): a, c, t, g, unknown or other
  misc_feature (304)..(305): n is a, c, g, or t
  modified_base (308)..(312): a, c, t, g, unknown or other
  misc_feature (308)..(312): n is a, c, g, or t
  modified_base (315)..(357): a, c, t, g, unknown or other
  misc_feature (315)..(357): n is a, c, g, or t
tcagtcgtcgctcgcacgaccggtgctcgatttagtatagacatcaagggggctctggagtccccagtcgcttctctggattccaaagatgcttcggccaatgcagggattctcctcatcctctggcctccagtctgagggactggaggctgactattactgtatgatttgggcacagcgcttatgtcttcggaactgggaccaaggtcaccgtctaggtcagcccaaggccaaccccatgtcactctgttcccacctcctcctcgctctactgacgccgggctcgggcaagggcgacactagnngtnnnnnagnnnnnnnnnnnnnnnnnnnnnnnnnnnnnnnnnnnnnnnnnnn

SEQ ID NO: 293936 - DNA, 342 bp, Homo sapiens
  misc_feature: GYAE6OF01A47GT.21.75.G09.1.454.CMB.1.raw
  modified_base (309)..(310): a, c, t, g, unknown or other
  misc_feature (309)..(310): n is a, c, g, or t
  modified_base (312)..(342): a, c, t, g, unknown or other
  misc_feature (312)..(342): n is a, c, g, or t
tcagtcgtcgctcgcacgaccggtgctcgatttagtatagacatcgagggcgtctgggagtccccaggtcgcttctctggatccgaaagatgcttcggccaatggcagggattctcctcatcctctggcctccagtctgaggatggacggctgactattactgtatgatttggccacagcgcgttatgtcttcggaactgggaccaaggtcaccgtcctaggtcagcccaaggcccaaccccactgtcactctgttcccgaccctcctcctcgtcctcgtactgagcggactggcaaggccgacatagnntnnnnnnnnnnnnnnnnnnnnnnnnnnnnnnn

SEQ ID NO: 293937 - DNA, 296 bp, Homo sapiens
  misc_feature: GYAE6OF01EYPKQ.21.75.G09.1.454.CMB.1.raw
  modified_base (292)..(296): a, c, t, g, unknown or other
  misc_feature (292)..(296): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccgccctcctcctcgtctctactgagcgggctggcaaggcgcatagnnnnn

SEQ ID NO: 293938 - DNA, 302 bp, Homo sapiens
  misc_feature: GYAE6OF01CSI0G.21.75.G09.1.454.CMB.1.raw
  modified_base (291)..(302): a, c, t, g, unknown or other
  misc_feature (291)..(302): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttccaccctcctcctcgtctctactgagcgggctggcaaggcgcatagnnnnnnnnnnnn

SEQ ID NO: 293939 - DNA, 299 bp, Homo sapiens
  misc_feature: GYAE6OF01DLSDN.21.75.G09.1.454.CMB.1.raw
  modified_base (285)..(285): a, c, t, g, unknown or other
  misc_feature (285)..(285): n is a, c, g, or t
  modified_base (291)..(299): a, c, t, g, unknown or other
  misc_feature (291)..(299): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagccaaggccaacccactgtcactctcgttcccgccctcctcctcgtactctactgagcggctggcaaggcncatagnnnnnnnnn

SEQ ID NO: 293940 - DNA, 334 bp, Homo sapiens
  misc_feature: GYAE6OF01BLTPT.21.75.G09.1.454.CMB.1.raw
  modified_base (291)..(293): a, c, t, g, unknown or other
  misc_feature (291)..(293): n is a, c, g, or t
  modified_base (295)..(297): a, c, t, g, unknown or other
  misc_feature (295)..(297): n is a, c, g, or t
  modified_base (299)..(334): a, c, t, g, unknown or other
  misc_feature (299)..(334): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgacggatgaggctgactattactgtatgatttggcacagcgcttatgtcttcggaactgggaccaaggtcaccgtcctaggtcagccaaggccaaccccatgtcactctgttcccaccctcctcctcgtactctactgacgcggactggcagcgcatagnnngnnncnnnnnnnnnnnnnnnnnnnnnnnnnnnnnnnnnnnn

SEQ ID NO: 293941 - DNA, 479 bp, Homo sapiens
  misc_feature: GYAE6OF01BHS5C.21.75.G09.1.454.CMB.1.raw
  modified_base (236)..(236): a, c, t, g, unknown or other
  misc_feature (236)..(236): n is a, c, g, or t
  modified_base (318)..(318): a, c, t, g, unknown or other
  misc_feature (318)..(318): n is a, c, g, or t
  modified_base (326)..(326): a, c, t, g, unknown or other
  misc_feature (326)..(326): n is a, c, g, or t
  modified_base (335)..(335): a, c, t, g, unknown or other
  misc_feature (335)..(335): n is a, c, g, or t
  modified_base (340)..(340): a, c, t, g, unknown or other
  misc_feature (340)..(340): n is a, c, g, or t
  modified_base (342)..(342): a, c, t, g, unknown or other
  misc_feature (342)..(342): n is a, c, g, or t
  modified_base (344)..(345): a, c, t, g, unknown or other
  misc_feature (344)..(345): n is a, c, g, or t
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (381)..(381): a, c, t, g, unknown or other
  misc_feature (381)..(381): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (411)..(412): a, c, t, g, unknown or other
  misc_feature (411)..(412): n is a, c, g, or t
  modified_base (414)..(415): a, c, t, g, unknown or other
  misc_feature (414)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(424): a, c, t, g, unknown or other
  misc_feature (423)..(424): n is a, c, g, or t
  modified_base (426)..(426): a, c, t, g, unknown or other
  misc_feature (426)..(426): n is a, c, g, or t
  modified_base (429)..(429): a, c, t, g, unknown or other
  misc_feature (429)..(429): n is a, c, g, or t
  modified_base (433)..(434): a, c, t, g, unknown or other
  misc_feature (433)..(434): n is a, c, g, or t
  modified_base (436)..(436): a, c, t, g, unknown or other
  misc_feature (436)..(436): n is a, c, g, or t
  modified_base (439)..(439): a, c, t, g, unknown or other
  misc_feature (439)..(439): n is a, c, g, or t
  modified_base (442)..(442): a, c, t, g, unknown or other
  misc_feature (442)..(442): n is a, c, g, or t
  modified_base (446)..(446): a, c, t, g, unknown or other
  misc_feature (446)..(446): n is a, c, g, or t
  modified_base (450)..(450): a, c, t, g, unknown or other
  misc_feature (450)..(450): n is a, c, g, or t
  modified_base (461)..(461): a, c, t, g, unknown or other
  misc_feature (461)..(461): n is a, c, g, or t
  modified_base (469)..(469): a, c, t, g, unknown or other
  misc_feature (469)..(469): n is a, c, g, or t
  modified_base (471)..(471): a, c, t, g, unknown or other
  misc_feature (471)..(471): n is a, c, g, or t
tcagtcgtcgctcgcacgaccggtgctcgatttagtatagacatcagggcgtcgtggagtccccagtcgcttctctggatccaaagatgcttcggccaatgcagggacttctcctcatctctggcctccagtctgaggatgtaggctgactattactgtatgatttggcacagcgcttagtgtcgttcggaactcgggacaggtcaccgtcgtaggtcagcccaaggcccaacccnctcgctactctcgtcccaccgtcctccgtcgtctctacgtgacgcgggtctcgggcctaagggccgtcgaacgtagacgtanagtcgagnctcacagtntgagngnanncgtactcncgcacncgtacgacacgtacgtcacacncncgagacgacgacacgacacgacatnctnnannangnanannanacncganngngtnctngtgngcgngagacgcacanacgtctanancgcgtgcg

SEQ ID NO: 293942 - DNA, 296 bp, Homo sapiens
  misc_feature: GYAE6OF01E0UAY.21.75.G09.1.454.CMB.1.raw
  modified_base (283)..(283): a, c, t, g, unknown or other
  misc_feature (283)..(283): n is a, c, g, or t
  modified_base (290)..(296): a, c, t, g, unknown or other
  misc_feature (290)..(296): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttgcacagcgtcttatgtcttcggaactgggaccaaggtcaccgtctaggtcagcccaagccaacccatgtcactctcgttcccgccctcctcctcgtcctctactgagcggctggcaaggcncatacgnnnnnnn

SEQ ID NO: 293943 - DNA, 661 bp, Homo sapiens
  misc_feature: GYAE6OF01CH5G8.21.75.G09.1.454.CMB.1.raw
  modified_base (125)..(125): a, c, t, g, unknown or other
  misc_feature (125)..(125): n is a, c, g, or t
  modified_base (247)..(247): a, c, t, g, unknown or other
  misc_feature (247)..(247): n is a, c, g, or t
tcagtcgtcgctcgcacgaccggtgctcgatttagtatagacatcaacacgacaaaggggagtctcagtcaggacacagcatggacatgagggtccccgctcagctcctggggctcctgctactntggctccgaggtgccagtatgtgactatccagatcgaccctagtcctccactccctccctgtctgactagtccgagtaggacgacagacgtccaccatcacgttggcggacaacgccagacnctattaccaattattagaattgtaactacgtaacgttaaaccgagggaaacctacccctaaactccgtagtactctagtcgctacgactactcctagttcgacgtaagggtcggtactacgacgtactaaacgttcgaaggttcggaccggtaggtacttacggtaggtaactaggttactttacaccttctaccgtaactacgtactaccgttcgtagtttcaccgtaacgtagttactactttcgaacctaacttacctactacgtaaccgtaagtacgttaccgttacgtccgttaccctgttaccggtaccggtccggaaccggaacgggtaccgaaggtaaccgtaacgtaacgtaacgtacggttcgaggtaaccctgtaccctacgtacgttcgtcgttccgtaccg

SEQ ID NO: 293944 - DNA, 308 bp, Homo sapiens
  misc_feature: GYAE6OF01AWFDH.21.75.G09.1.454.CMB.1.raw
  modified_base (281)..(281): a, c, t, g, unknown or other
  misc_feature (281)..(281): n is a, c, g, or t
  modified_base (289)..(292): a, c, t, g, unknown or other
  misc_feature (289)..(292): n is a, c, g, or t
  modified_base (294)..(308): a, c, t, g, unknown or other
  misc_feature (294)..(308): n is a, c, g, or t
tcagtcgtcgctcgcacgaccggtgctcgatttagtatagacatcagggctctggagtccccagtcgcttctctggatccaaagatgcttcggccaatgcagggattctcctcatctctggctccagtctgaggatgaggctgactattactgtatgatttggcacagcgcttatgtcttcggaactgggaccaaggtcaccgtctaggtcagcccaaggcccaacccactgcactctcgtcccaccctcctcctcgtctctactgagcggctggcaggcncgactagnnnngnnnnnnnnnnnnnnn

SEQ ID NO: 293945 - DNA, 375 bp, Homo sapiens
  misc_feature: GYAE6OF01DHZAX.21.75.G09.1.454.CMB.1.raw
  modified_base (338)..(338): a, c, t, g, unknown or other
  misc_feature (338)..(338): n is a, c, g, or t
  modified_base (345)..(375): a, c, t, g, unknown or other
  misc_feature (345)..(375): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatggaggctagactattactagtatgtatttggacagagcgtcttagtgtccttcggaacgtcggaaccacggtccaccgtccgtacggtcacgacccgaacgaccccaacccatcgtactacctccgttccgtccccaccccttcctaccggacggtccgaacgtactcgggacggcgggtctcgggaaccgaagggccganaatcgannnnnnnnnnnnnnnnnnnnnnnnnnnnnnn

SEQ ID NO: 293946 - DNA, 329 bp, Homo sapiens
  misc_feature: GYAE6OF01C5R0Z.21.75.G09.1.454.CMB.1.raw
  modified_base (298)..(298): a, c, t, g, unknown or other
  misc_feature (298)..(298): n is a, c, g, or t
  modified_base (301)..(329): a, c, t, g, unknown or other
  misc_feature (301)..(329): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgtctttagtgtcttacggactgggaccagggtcaccgtcctaggtcacgcccaaggcccaaccccatgtcactctcgtcccacccttcctcgagcgacactgagcgggctggcgaaggtcgctagagnagnnnnnnnnnnnnnnnnnnnnnnnnnnnnn

SEQ ID NO: 293947 - DNA, 858 bp, Homo sapiens
  misc_feature: GYAE6OF01EH3H1.21.75.G09.1.454.CMB.1.raw
  modified_base (151)..(151): a, c, t, g, unknown or other
  misc_feature (151)..(151): n is a, c, g, or t
  modified_base (165)..(165): a, c, t, g, unknown or other
  misc_feature (165)..(165): n is a, c, g, or t
  modified_base (212)..(212): a, c, t, g, unknown or other
  misc_feature (212)..(212): n is a, c, g, or t
  modified_base (257)..(257): a, c, t, g, unknown or other
  misc_feature (257)..(257): n is a, c, g, or t
tcagtcgtcgctcgcacgaccggtgctcgatttagtatagacatcaaacacacaaagggggagtctcagtcaggacacagcatggacatggacgggtccccgctcagcctcccgtggggccttcctgcctactcgtggcctccggaggtcnccagtatgtagacntaccagactcgacccagttcctaccctacttccctccgtgtccgtcncctactacctaaggtacggacgaacgtacggtacctaccaacctnttacctacggttccgggaccggacaacggcgaagtactacgttaaccttaaccgtaatttagtttagtaagttcgtacttaacgtaacggttaaaccggaacggtaaccctaaccccgttaactcgtagtaccttagtacgccgttacgtacctaccgttactttaccgttaacggttaccggtaaaggttaccggggttaccggttaccaaacggtaaccttaccgttaaaggtttccgacggtttacggacggtttgtaccggttacgggtacggtacttacgtttaaccttcgacccttaccgaacacgttactacgtacgttacgtttacgtaaccacgttacgttaccggttagtttacccgtttaactaaccgtttacctttaacgaccgttacgtacccgtaacgggttacccggtttccgttcccggtacctcccgttaccggggttacgtaaccccggggttaggaaccggttaaacccggggtagtaaaccgggtaaactaaacccgggttacttaaacgggtcggttaaccgggtcctaccgttaaaccgaccctttagtacccggtttccttccggttaccttaacccg

SEQ ID NO: 293948 - DNA, 739 bp, Homo sapiens
  misc_feature: GYAE6OF01DGSJ1.21.75.G09.1.454.CMB.1.raw
  modified_base (339)..(339): a, c, t, g, unknown or other
  misc_feature (339)..(339): n is a, c, g, or t
tcagtcgtcgctcgcacgaccggtgctcgatttagtatagacatcaacacacaaacccggggagtctcagtcaggacacagcatggacatgacgggtcccgctcagctccgtggggctcctgctactcgtgcctccggaggtcgccagtgtgacgactactccagtactcgaccctagtcctcctacttccctcccgtgtacctgactacgttaccaggtacgacgtacgaacggtactccaactactctacgttggcgggacacgcgagcatactacctattgttagagttcgtactacgtaacgttaacggaacgaacctacctaactctagtactntagtcgctgtacctacgtcgttacgttgtaacgtagggtcggtacttacgagtaacctaacttcggtacggtccggtacggtacgttacgttgggaaccggtattaacggttcttccgtaacttctaacccgtacgacgtaaccgtctacgttaacggtaccaacgtaccgttacgttaaccgtttctttaacgtaacctttaaccttacgtttactaacgtaccggtaacgtaccgttacggttaccgtccgttaccgtacgttccgggtacccggttaacgggaaccggttaaaccgggaacgttacggggaaaacttaaccgggtacttaaacgggtccggttagggacgcccgttacgtaacccgttacgtactttccggttactcccgttaaccg

SEQ ID NO: 293949 - DNA, 314 bp, Homo sapiens
  misc_feature: GYAE6OF02F5XH4.21.75.G09.1.454.CMB.1.raw
  modified_base (290)..(314): a, c, t, g, unknown or other
  misc_feature (290)..(314): n is a, c, g, or t
tcagtcgtcgctcgcacgaccggtgctcgatttagtatagacatcagggctctggagtcccagtcgcttctctggatccaaagatgcttcggccaatgcagggattctcctccatctctggcctccagtctgaggatgaggctgactattactgtatgatttggcacagcgcttatgtcttcggaactgggaccaaggtcaccgtcctaggtcagcccaaggccaacccactgtcactctgttcccacctcctccgagcgacgactgagcgggctggcaaggcgcatagnnnnnnnnnnnnnnnnnnnnnnnnn

SEQ ID NO: 293950 - DNA, 296 bp, Homo sapiens; identical to SEQ ID NO: 293937
  misc_feature: GYAE6OF02G7H94.21.75.G09.1.454.CMB.1.raw
  modified_base (292)..(296): a, c, t, g, unknown or other
  misc_feature (292)..(296): n is a, c, g, or t

SEQ ID NO: 293951 - DNA, 299 bp, Homo sapiens
  misc_feature: GYAE6OF02JVEIQ.21.75.G09.1.454.CMB.1.raw
  modified_base (292)..(299): a, c, t, g, unknown or other
  misc_feature (292)..(299): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtctaggtcagcccaaggccaacccactgtcactctcgttcccgccctcctcctcgtctctactgacgcgggctggcaaggcgcatagnnnnnnnn

SEQ ID NO: 293952 - DNA, 311 bp, Homo sapiens
  misc_feature: GYAE6OF02FKOOY.21.75.G09.1.454.CMB.1.raw
  modified_base (299)..(311): a, c, t, g, unknown or other
  misc_feature (299)..(311): n is a, c, g, or t
tcagtcgtcgctcgcacgaccggtgctcgatttagtatagacatcagggtctctggagtccccagtcgcttctctggatccaaagatgcttcggccaatgcagggattctcctcatctctggcctccagtctgaggatgaggctgtactattactgtattagatttggcacagcgcttatgtcttcggaactgggaccaaggttcaccgtcctaggtcagccccaaggccaaccccactgtcactctgttccccaccctcctccgagcgacgactgagcgggctggcaaggcgcatagnnnnnnnnnnnnn

SEQ ID NO: 293953 - DNA, 315 bp, Homo sapiens
  misc_feature: GYAE6OF02IL0GL.21.75.G09.1.454.CMB.1.raw
  modified_base (237)..(237): a, c, t, g, unknown or other
  misc_feature (237)..(237): n is a, c, g, or t
  modified_base (278)..(278): a, c, t, g, unknown or other
  misc_feature (278)..(278): n is a, c, g, or t
  modified_base (293)..(293): a, c, t, g, unknown or other
  misc_feature (293)..(293): n is a, c, g, or t
  modified_base (301)..(315): a, c, t, g, unknown or other
  misc_feature (301)..(315): n is a, c, g, or t
tcagtcgtcgctcgcacgaccggtgctcgatttagtatagacatcagggcgtctggagtccccagtcgcttctctggatccaaagatgcttcggccaatgcagggattctcctcatcctctggcctccagtctgaggatggaggctgactattactgtatgtatttggcacagcgcttatgttcttcggaactggggaccaaggtcaccgtcctaggtcagccccaaggccaacccntgtcactctgtcccgccctcctcctcgtctctacctgacgngggcttggcaaggcncagtacgnnnnnnnnnnnnnnn

SEQ ID NO: 293954 - DNA, 298 bp, Homo sapiens
  misc_feature: GYAE6OF02HRBSS.21.75.G09.1.454.CMB.1.raw
  modified_base (294)..(298): a, c, t, g, unknown or other
  misc_feature (294)..(298): n is a, c, g, or t
tcagtcgtcgctcgcacgaccggtgctcgatttagtatagacatcagggactctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccaccctcctcctcgtctctactgacgcgggctggcaaggcgcatagnnnnn

SEQ ID NO: 293955 - DNA, 296 bp, Homo sapiens
  misc_feature: GYAE6OF02HSMTP.21.75.G09.1.454.CMB.1.raw
  modified_base (291)..(296): a, c, t, g, unknown or other
  misc_feature (291)..(296): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtctaggtcagcccaaggccaaccccactgtcactctgttcccaccctcctcctcgtctctactgagcgggctggcaaggcgcatagnnnnnn

SEQ ID NO: 293956 - DNA, 564 bp, Homo sapiens
  misc_feature: GYAE6OF02GRFZF.21.75.G09.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagtatagacatcaacgacacaaaaggggagtctcagtcaggacacagcatggacatgagggtccccgcgtcagctcctggggctcctgctactctggctccgaggtcgccgagatgtgacatccagatgacccagtctccatcctcctgtctgcatccatagganacagagtcaccatcacttgcgggcaagccagagcattaccaactatttgaattggtatcagtttaaaccagggaaagcccctaaaactcctgatctatgctgcatccactttgcaaagtggggtctcagcaaacttcattcggccgtggatcgtgggacagatttcactctacaccatcagcagtttcacaacctgacgtatttgactaacttactacttgtacaacaggtctttacggtcgttcccttgttacgtaccgtttccggacccgtaacggggtacccgtaagggtacggaaattaccgaaaacgtaaccgtggttacggtcctacggaccaccgtacttccgttacgttcctttaccg

SEQ ID NO: 293957 - DNA, 300 bp, Homo sapiens
  misc_feature: GYAE6OF02HFG61.21.75.G09.1.454.CMB.1.raw
  modified_base (294)..(300): a, c, t, g, unknown or other
  misc_feature (294)..(300): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccaccctcctcctcgtctctactgacgcgggctggcaaggcgacatagnnnnnnn

SEQ ID NO: 293958 - DNA, 296 bp, Homo sapiens; identical to SEQ ID NO: 293937
  misc_feature: GYAE6OF02GT7MR.21.75.G09.1.454.CMB.1.raw
  modified_base (292)..(296): a, c, t, g, unknown or other
  misc_feature (292)..(296): n is a, c, g, or t

SEQ ID NO: 293959 - DNA, 308 bp, Homo sapiens
  misc_feature: GYAE6OF02GRIR9.21.75.G09.1.454.CMB.1.raw
  modified_base (293)..(308): a, c, t, g, unknown or other
  misc_feature (293)..(308): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtctaggtcagcccaaggccaaccccactgtcactctcgttcccaccctcctcctcgtctctactgagccggctggcaaggcgacatagnnnnnnnnnnnnnnnn

SEQ ID NO: 293960 - DNA, 308 bp, Homo sapiens
  misc_feature: GYAE6OF02HNKTV.21.75.G09.1.454.CMB.1.raw
  modified_base (292)..(308): a, c, t, g, unknown or other
  misc_feature (292)..(308): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtctaggtcagcccaaggccaaccccactgtcactctcgttcccaccctcctcctcgtctctactgagcgggctggcaaggcgcatagnnnnnnnnnnnnnnnnn

SEQ ID NO: 293961 - DNA, 301 bp, Homo sapiens
  misc_feature: GYAE6OF02GFR2I.21.75.G09.1.454.CMB.1.raw
  modified_base (294)..(301): a, c, t, g, unknown or other
  misc_feature (294)..(301): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggcccaaccccactgtcactctcgttcccgccctcctcctcgtctctactgagcgggctggcaaggcgcatagnnnnnnnn

SEQ ID NO: 293962 - DNA, 310 bp, Homo sapiens
  misc_feature: GYAE6OF02F2PS2.21.75.G09.1.454.CMB.1.raw
  modified_base (284)..(284): a, c, t, g, unknown or other
  misc_feature (284)..(284): n is a, c, g, or t
  modified_base (292)..(310): a, c, t, g, unknown or other
  misc_feature (292)..(310): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaacccactgtcactctcgtcccgccctcctcctcgtctctactgagcggctggcaaggcncacgtagnnnnnnnnnnnnnnnnnnn

SEQ ID NO: 293963 - DNA, 546 bp, Homo sapiens
  misc_feature: GYAE6OF02JD4VB.21.75.G09.1.454.CMB.1.raw
tcagtcgtcgctcgcacgaccggtgctcgatttagtatagacatcaacacgacaaaggggagtctcagtcaggacacagcatggacatgagggtccccgctcagctcctgggctcctgctactctggctccgagtgccagatgtgacatccagatgacccagtctccatcctccctgtctgcatccataggagacagagtcaccatcacttgtcgggcaagccagagcattaccaactatttgaattggtatcagtttaaaccagggaaacgcccctaaaactccctagactctaatgctgcatccactttgctaagtgggtctcagacaacttcattgcgtggatcgtaggacagatttcactctcaccatcacgctagtttcgactaacctggaccgtattttcgactaacttacctactcgtacaacgtagtaccttacggtcgtaccctgttcgtacgttccggaccgaacgggtaccgtaggtacgaagtaccaaacgtactcggtacgtacgtacgcaccgtactcgttacgtcttaccg

SEQ ID NO: 293964 - DNA, 309 bp, Homo sapiens
  misc_feature: GYAE6OF02GKCVM.21.75.G09.1.454.CMB.1.raw
  modified_base (293)..(293): a, c, t, g, unknown or other
  misc_feature (293)..(293): n is a, c, g, or t
  modified_base (299)..(309): a, c, t, g, unknown or other
  misc_feature (299)..(309): n is a, c, g, or t
tcagtcgtcgctcgcacgaccggtgctcgatttagtatagacatcagggctctggagtccccagtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcacgcccaaggcccaaccccatcgtcacctctcgttccccaccctcctcctcgtctctactgacgtcgggctggcaaggcncatagnnnnnnnnnnn

SEQ ID NO: 293965 - DNA, 1059 bp, Homo sapiens
  misc_feature: GYAE6OF02I3SF4.21.75.G09.1.454.CMB.1.raw
tcagtcgtcgctcgcacgaccggtgctcgattttagtatagacatcaacgacacaaaggggagtctcagccaggacacagcatggacatcgagggtcccgctcagctcctggggctcttgctactcgtggctccgaggtgccagatagtgaacactaccaggactcggaaccctagtcctccgactccctcccgtgttctgctactaccgaagtacgggagaccgaaggtacgtaccaaacccgcgttacctaacggttcgggtaccgggacaaacgacccgaaggtacgaccttaacgtttaaccctaaacgttttaacgtttacgtaaagtttcggttaaacgtaccgtttaaaaccggttttaaaaccgaaagggggtaaaaccctaacccccctttaaaacggttacccggttaggtaacgtttaaccgtaacgtaccgggttactacggtaaccgtaaccgttttcccgttaaacggttttacggtaacgggttaaaacggggttcggggtttaccctaaaccggtaacggtaaaaccccttaaagggtttaccgttaggttaccgggtaaccgggttacggttaaccggttaccggttacggggtaaaccggttagttaacccgtttacccggtaaactttacccgggtttaaccgaaacccgttacgtaaccggtaaccgttcggttaacgtttaacgggaacccgttaacgtacgtaacccgggtttatttaaccgtaacccgtaaacggttttacccgttaaacgtagtaaacccgaaccgggtttaacgttacccgggttttaaaaggtccccggttttaccccgttaaagggtttaccccggttaaccgggtacccgggtttaaaacccggggaaacgggtttaaccccgtttaaggggggttaacggaaaaccccgttttaacccggtaaaaacggggtaccccggtttaggggtaacccgggtaaacccggtttaaccggttaccccgggtaaacccgttttaaacgggtcccccggtttttaacgttaaccccgggtttacccgg

SEQ ID NO: 293966 - DNA, 847 bp, Homo sapiens
  misc_feature: GYAE6OF02G33OU.21.75.G09.1.454.CMB.1.raw
tcagtcgtcgctcgcacgaccggtgctcgatttagtatagacatcaatacacaaaggggagtctcagtcaggacacagcatggacatgagggtcccgctcagctcctgggctcctgctactctggctccgaggtcgccagatgtgacatccagatgacccagtctccatccctcctgtctgcatccataggacgactaggactcaccatctacttgtcgggacaacggaccagacgactaacttaaccgaactattagtaattaggtatactaagtttaaaacccgaagggtaaaccgacccgttaaaacctaccctacggtaacttaccttaattacgacttaccgactacctaccttaacttttcgaactaaaggttacgggtacctactaacgtaactaaaccttactacgtttacgggaccggttaggtactttacgtacggggtaacctaaggtacttttacgtaaccttcgttacctaacctaaactttcccgaaaggttaccttacggttttacgaaccgttaaacccgttaggtaacccgtttaagtttaccggtaacctttaaaacctttaaccgttaaaccttacgtacccgtaaaccttacggggtacgtttaaccccgggttaccgtttacccccgtacgtttaaccggtacccgggtttttaaaccgggacccgggttaaaacccgggtaacccggttaacgggggttaaaccggtaaaccgtttaaaaccccgggtaaaaccggttaaaccggtttaaccggggtccggttaacggttaacccggaccctaaccccgtaagtttaccccggttagttttaacccccgttaacg

SEQ ID NO: 293967 - DNA, 458 bp, Homo sapiens
  misc_feature: GYAE6OF02I6719.21.75.G09.1.454.CMB.1.raw
  modified_base (396)..(401): a, c, t, g, unknown or other
  misc_feature (396)..(401): n is a, c, g, or t
  modified_base (403)..(458): a, c, t, g, unknown or other
  misc_feature (403)..(458): n is a, c, g, or t
tcagtcgtcgctcgcacgaccggtgctcgatttagtatagacatcagggctctggagtccccagtcgcttctctggatccaaagatgcttcggccaatgcagggatttctcctcatctctggcctccagtctgaggatggaggctgactattactgtatgtatttggcacagcgtctttagttcgttcgtttaccgggaactcggggaaccaaaggtccgaccgttccgtagggtccaccggacccccgaacgggacccccaaacccccacttccgtacctaccttccgtccctttcccccaacccccttcccttccccttccgtccttacccttaacctggtaaccggcccggggcttacggggaccgaaacgggcccgaccgtaattaccggannnnnncnnnnnnnnnnnnnnnnnnnnnnnnnnnnnnnnnnnnnnnnnnnnnnnnnnnnnnnn

SEQ ID NO: 293968 - DNA, 728 bp, Homo sapiens
  misc_feature: GYAE6OF02HKP22.21.75.G09.1.454.CMB.1.raw
tcagtcgtcgctcgcacgaccggtgctcgatttagtatagacatcaaacgacacaaaggggagtctcagtcaggacacagcatggacatgagggtccccgctcagctcctggggctcctgctactctggctccgaggtgccagatgtgacatccagatgacccagtctccatcctcctgtctgcatccataggagacagagtccaccgatcaacgttggtccgggacaaggccagtagactaacttaccaaacttagtttacgtaaagtttggtaacttacgtaaacggttttaaaacccgaaggggtaaaaccgtaacccccgttaaaaccgttccccgtaaggtaacttaccgttacgtacggtaccgttcggacctacgttacccttacgtttacgacgtaaaggggttcgggttcctacgaacgtactaaaccttcgaacgttcggtccgtaggtaacttccggtaggaactaggttactttccgaccctattacccaactactcgacgtacgttacgttcgacttaaccgtagtacgttagtttacgactaaacgtttactacgtcgtaacgttaacgacggttaccttacggtccgttaccgtcgttacggtaccggttaccggaacgtaaccgggtaacgtacggtacgtaaacgtaaccgaacgtaacgtggtaccgacgtaccgtaccgaaccgttacgtacttacggtaccttaccgg

SEQ ID NO: 293969 - DNA, 769 bp, Homo sapiens
  misc_feature: GYAE6OF02JT07G.21.75.G09.1.454.CMB.1.raw
  modified_base (152)..(152): a, c, t, g, unknown or other
  misc_feature (152)..(152): n is a, c, g, or t
  modified_base (248)..(248): a, c, t, g, unknown or other
  misc_feature (248)..(248): n is a, c, g, or t
  modified_base (727)..(727): a, c, t, g, unknown or other
  misc_feature (727)..(727): n is a, c, g, or t
tcagtcgtcgctcgcacgaccggtgctcgatttagtatagacatcaacgacacgaaaggggagtctcagtcaggacacagcatggacatgagggtcccgctcagctcctgggctcctgctactctggctccggaggtgccaggatcgtgacntccgagatcgacccagtcctccatcctcctgtctgcattccagtaggactacgaggacgtccaccgtacttcctaacggttgggtaccggggaacncccgtaaggaccgtacttactttaacccgtaacgtttagttacgtaagtttcggtaataccgttaacgttaaaccggaagggaaaccgttaccccgtaaccttaccgaaggtactacttaacgtgtacctgactaccgtacttaacgttacggtacgtaaacggttcggggtaacctcgaacgtaacttaaccgttacgacgttacggtacgttaggaacttcggtaacggactaacggtactttacccgactaccgttacgaaccttacggacctaagaccgttagttaccgaacgttaacctacgggttaacttacgtttaacgtaccctttaaacgtacccgtaacttaaccgtaaccgtacttaacgggttccctttaacggtccttaccggttacctaccgggtttaccgtacggaacccggtaacggttacgtaacgacgttaaactaacgggaaccgtacgttaggtcccgngttaaccgccgtactacgttcctcggttacccgtattacccg

SEQ ID NO: 293970 - DNA, 719 bp, Homo sapiens
  misc_feature: GYAE6OF02H422Z.21.75.G09.1.454.CMB.1.raw
tcagtcgtcgctcgcacgaccggtgctcgatttagtatagacatcaacacaccaaaggggagtctcagtcaggacacagcatggacatgagggtccccgctcagctcctggggctcctgctactctggctccgaggtgccagatgtgacatccagatcgacccagtcctccactccctccctgtctgactactcctagtacggacgacgaggacgttaccaaccgtactcctaacgtttcggtccgggacgaacgccgagacgtactacttaacctattagttagtaagttgtactacgttaacgttaaaccgacggtaacctaccctaacgtcctagtactactatcgtctacactacttaccgtagtacgtacgtaaggtcggtactacgtaactaccttaacgtcgtacgttccggacggtcgtacgtcggtaggtacgtacgttacttaccgtaccttacctactaccgtacgtacgtacgtacgttacgttacgaacgtaaccgtagttacgtttaccgttacgtaaccgttaacgttaccgttacgtacgtaaccgtacgtacggttaccgttaccgtccgttaccgttcggttaccggtaccggtaccggaaccggtaacggtaccggtacggtaacgtaacggtaaccgtaacggttacgccggttacgaccgtcgtaccgtaccgttcgttacgttccttacccgttacg

SEQ ID NO: 293971 - DNA, 416 bp, Homo sapiens
  misc_feature: GYAE6OF01AMVQ8.41.60.F05.1.454.CMB.1.raw
  modified_base (369)..(369): a, c, t, g, unknown or other
  misc_feature (369)..(369): n is a, c, g, or t
  modified_base (399)..(399): a, c, t, g, unknown or other
  misc_feature (399)..(399): n is a, c, g, or t
  modified_base (405)..(416): a, c, t, g, unknown or other
  misc_feature (405)..(416): n is a, c, g, or t
tcagtctatactatcacgaccggtgctcgatttagtacgtcatcagggaaagagccaccctctcctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcggcctgcagtctgaggattttgctagtttattactgtcagcagtataataactggcctctcacgtttcgggcgggggaccaagggtggagatcgagacgaacgtgtggctgcacatctgtcttcactctcccgcatctnatatatctgtctgagcgggctggcaggcgnagtagnnnnnnnnnnnn

SEQ ID NO: 293972 - DNA, 406 bp, Homo sapiens
  misc_feature: GYAE6OF02JRJJD.41.60.F05.1.454.CMB.1.raw
  modified_base (391)..(391): a, c, t, g, unknown or other
  misc_feature (391)..(391): n is a, c, g, or t
  modified_base (397)..(406): a, c, t, g, unknown or other
  misc_feature (397)..(406): n is a, c, g, or t
tcagtctatactatcacgaccggtgctcgatttagtacgtcatcagggaaagagccaccctctcctgcagggccagtcagagtgttaccagcaacttagcctggtaccaccagaaacctgggcaggctcccaggctcctcatctatggaacatccaccagggccactggtatcccacccaggttcagtggcagtgggtccgggacagagttcactctcaccatcagcggcctgcagtctgaggattttgcagtttattactgtcagcagtatgcttactcacctctgacgttcggccaagggaccaaggtgaaatcaaacgactgtggctgcacatctgtcttcattcttcccgcatctgatatatactgtctgagcgggctggcaaggcncatagnnnnnnnnnn

SEQ ID NO: 293973 - DNA, 411 bp, Homo sapiens
  misc_feature: GYAE6OF01BXGOC.11.80.H03.1.454.CMB.1.raw
  modified_base (367)..(367): a, c, t, g, unknown or other
  misc_feature (367)..(367): n is a, c, g, or t
  modified_base (405)..(411): a, c, t, g, unknown or other
  misc_feature (405)..(411): n is a, c, g, or t
tcagcgagagataccacgaccggtgctcgatttagctgtgcgtcgaaggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactggaggctgaagattttgcaatttatttctgtcagtattatggtgtctcaccggggacgtttcggccaggggagcaagggtggaaatcaaaacgactgtggctgcacatctgtcttcatcttccgcatcngagtatctctcgctgagcggctgggcaaggcgcatagnnnnnnn

SEQ ID NO: 293974 - DNA, 416 bp, Homo sapiens
  misc_feature: GYAE6OF01CFS8C.11.80.H03.1.454.CMB.1.raw
  modified_base (399)..(399): a, c, t, g, unknown or other
  misc_feature (399)..(399): n is a, c, g, or t
  modified_base (404)..(416): a, c, t, g, unknown or other
  misc_feature (404)..(416): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcagcaacctgcaggctgaagatgtggcagtttatactgtcagcagtatgtgaagctccgctcactttcggcggtagggaccgcggtggagatcgagacgaactgtggctgcacatctgtcttcatctcccgcatctgagtatctctcgctgagcgggctggcaagggcncatgnnnnnnnnnnnnn

SEQ ID NO: 293975 - DNA, 427 bp, Homo sapiens
  misc_feature: GYAE6OF01EG8HO.11.80.H03.1.454.CMB.1.raw
  modified_base (385)..(385): a, c, t, g, unknown or other
  misc_feature (385)..(385): n is a, c, g, or t
  modified_base (412)..(412): a, c, t, g, unknown or other
  misc_feature (412)..(412): n is a, c, g, or t
  modified_base (418)..(427): a, c, t, g, unknown or other
  misc_feature (418)..(427): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactggaggctgaagattttgctaattttatttctgtcagttattatggtgtctcgaccgggggtacgtttcggccgagggggagcgaagggtggaaaatcgaaacgaactgtggctgcacatctgtctcatcttcccgctatctgagtntctctcgctgagcggctggacaaggcncatagnnnnnnnnnn

SEQ ID NO: 293976 - DNA, 433 bp, Homo sapiens
  misc_feature: GYAE6OF01AHSNE.11.80.H03.1.454.CMB.1.raw
  modified_base (417)..(417): a, c, t, g, unknown or other
  misc_feature (417)..(417): n is a, c, g, or t
  modified_base (424)..(433): a, c, t, g, unknown or other
  misc_feature (424)..(433): n is a, c, g, or t
tcagcgagagataccacgaccggtgctcgatttagctgtgcgtcggaaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctggggacagacttcactctcaccatcaacggcctgcagtctgaagattttgctagtttattactgtcagcagtataataactggcctcggacgttcggccaagggaccaaggtggaagtcaaaacgaactggtaggctgcaccatctgtcttcatccttcccgcatcctgagtactctctcgctggagccgggtctgggactaagggcncatacgnnnnnnnnnn

SEQ ID NO: 293977 - DNA, 461 bp, Homo sapiens
  misc_feature: GYAE6OF01CZFPZ.11.80.H03.1.454.CMB.1.raw
  modified_base (235)..(235): a, c, t, g, unknown or other
  misc_feature (235)..(235): n is a, c, g, or t
  modified_base (449)..(461): a, c, t, g, unknown or other
  misc_feature (449)..(461): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacngactggaggctagaagtattttgactaaattttatttctgttcagttattatggtgttctcggaccgggggtacgttcgggccgaggggagacgaagggtaggaaatacgaaacgacgtggtggctgaccactatctagtcttcacttcctcccgctatcgtagtagtatcctctcgctggacgcgggtctgggaccaagggccgactagtagnnnnnnnnnnnnn

SEQ ID NO: 293978 - DNA, 434 bp, Homo sapiens
  misc_feature: GYAE6OF01AYM2C.11.80.H03.1.454.CMB.1.raw
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (417)..(417): a, c, t, g, unknown or other
  misc_feature (417)..(417): n is a, c, g, or t
  modified_base (424)..(434): a, c, t, g, unknown or other
  misc_feature (424)..(434): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctggggacagacttcactctcaccatcaacagactggaggctgaagattttgcaattttatttctgtctagtattatggtgtctcgaccggggtacgttcggccgaggggagcgtaaggtggaaatacgaaacgacgtggtggctgcaccatctgtcttcatccttcccgctatctgacgttatcctctcgntgacgtcggntggcaaggcnctatagnnnnnnnnnnn

SEQ ID NO: 293979 - DNA, 436 bp, Homo sapiens
  misc_feature: GYAE6OF01D92QL.11.80.H03.1.454.CMB.1.raw
  modified_base (344)..(344): a, c, t, g, unknown or other
  misc_feature (344)..(344): n is a, c, g, or t
  modified_base (395)..(395): a, c, t, g, unknown or other
  misc_feature (395)..(395): n is a, c, g, or t
  modified_base (401)..(401): a, c, t, g, unknown or other
  misc_feature (401)..(401): n is a, c, g, or t
  modified_base (416)..(416): a, c, t, g, unknown or other
  misc_feature (416)..(416): n is a, c, g, or t
  modified_base (422)..(436): a, c, t, g, unknown or other
  misc_feature (422)..(436): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggtcaggctcccaggctcctcattcatggtgcatccaatagggccactggcatcccagccagattcactgggcggtgggtctggggacagacttcactctcaccatcagcagcctgcagtctagaagtattttgctagtttattactgtcagcagtatagtaaggtggccgtctcacgtttcggcggagggaccaagggtgagatcagacgaacgtgngctgcaccatctgtcttcacttcctcccgctatctgagtatctctcgctgnggcggngtcggcgacggcganagtagnnnnnnnnnnnnnnn

SEQ ID NO: 293980 - DNA, 412 bp, Homo sapiens
  misc_feature: GYAE6OF02GAPZE.11.80.H03.1.454.CMB.1.raw
  modified_base (405)..(412): a, c, t, g, unknown or other
  misc_feature (405)..(412): n is a, c, g, or t
tcagcgagagataccacgaccggtgctcgatttagctgtgcgtcgaagtgggaaagagccaccctcttgtgcagggccagtcagagtgttcttgccaagtacttggcctggtaccagcacaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaaacgactgtggctgcaccatctgtcttcatcttcccgcatctgagtatctctcgctgagcgggctggcaaggcgcatagnnnnnnnn

SEQ ID NO: 293981 - DNA, 425 bp, Homo sapiens
  misc_feature: GYAE6OF02GSJ9L.11.80.H03.1.454.CMB.1.raw
  modified_base (418)..(425): a, c, t, g, unknown or other
  misc_feature (418)..(425): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactggaggctgaagtattttgctaattttatttctgtcagttattatggtgtctcgaccggggtacgttcgggccagggggagcgaagggtggaaatcaaacgaactgtggctgcaccatctgtctcatcttcccgcatctgagtatctctcgctggacgcgggctgggcaagggcgcatgnnnnnnnn

SEQ ID NO: 293982 - DNA, 431 bp, Homo sapiens
  misc_feature: GYAE6OF02GS8ZS.11.80.H03.1.454.CMB.1.raw
  modified_base (424)..(431): a, c, t, g, unknown or other
  misc_feature (424)..(431): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactggaggctgaagattttgctaatttatttctgtcagttattatggtgtctcgaccgggggtacttcgggccgaggggagcgaagggtggaaatcaaacgactggtggctgcaccatctgttcttcatccttcccgctatctgagtactctctcgctggacggcgggctgggcaaggcgacatacgnnnnnnnn

SEQ ID NO: 293983 - DNA, 466 bp, Homo sapiens
  misc_feature: GYAE6OF02G26CO.11.80.H03.1.454.CMB.1.raw
  modified_base (444)..(466): a, c, t, g, unknown or other
  misc_feature (444)..(466): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactggaggctagaagtattttgactaattttatttctgtcagttattagtggtgtctcgaccggggtcgttcggccgaggggacgcgaaggtaggaaatacgaaacgaatggtcgctgcacatctgtcttctactccttcccgcctattctgtagttactcttcgtcgtcgtggacggtcgggcgtggacgaacgggcacgtagtagnnnnnnnnnnnnnnnnnnnnnnn

SEQ ID NO: 293984 - DNA, 507 bp, Homo sapiens
  misc_feature: GYAE6OF02JP4SZ.11.80.H03.1.454.CMB.1.raw
  modified_base (213)..(213): a, c, t, g, unknown or other
  misc_feature (213)..(213): n is a, c, g, or t
  modified_base (442)..(442): a, c, t, g, unknown or other
  misc_feature (442)..(442): n is a, c, g, or t
  modified_base (471)..(471): a, c, t, g, unknown or other
  misc_feature (471)..(471): n is a, c, g, or t
  modified_base (473)..(507): a, c, t, g, unknown or other
  misc_feature (473)..(507): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaccagggccactggtttcccagccaggttcagtggcagtgggtctgagacngagttcactctcacatcaacggcctgcagtctgaagatttgcagtttatactgtcagtcagtataatactggcctggacgttcggaccgaaggaccaaggtcgggaatcgaaaaacgagtaggtcggacgtaggcctaaccgatcgttacgtcttactaacgtttccttcccggaccaacttccgtaggaacgttacgttacctctaccgtctcggaaggcccggggtntcgggtacgaaacgggccgactaggtacngnnnnnnnnnnnnnnnnnnnnnnnnnnnnnnnnnnn

SEQ ID NO: 293985 - DNA, 497 bp, Homo sapiens
  misc_feature: GYAE6OF02GT956.11.80.H03.1.454.CMB.1.raw
  modified_base (463)..(466): a, c, t, g, unknown or other
  misc_feature (463)..(466): n is a, c, g, or t
  modified_base (468)..(497): a, c, t, g, unknown or other
  misc_feature (468)..(497): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggctcctcattcatggtgcatccaatagggccactggcatcccagccagattcactgggcggtgggtctgggacagacttcactctcaccatcaacagactgggaggctagaagtattttgactaattttattctgtcagttattatggttgtctcgaccggggtacgttccggaccgaggggacgacgaagggtaggaaatacgaaaacggtactggtggctgacaccgtatctacgtcttcacttccttccccgctacgtctagtacgttactctccgtcgcgtggacggcgggtactcgggacgaggccgtcgagtacgtnnnncnnnnnnnnnnnnnnnnnnnnnnnnnnnnnn

SEQ ID NO: 293986 - DNA, 526 bp, Homo sapiens
  misc_feature: GYAE6OF02HYELM.11.80.H03.1.454.CMB.1.raw
  modified_base (234)..(234): a, c, t, g, unknown or other
  misc_feature (234)..(234): n is a, c, g, or t
  modified_base (490)..(490): a, c, t, g, unknown or other
  misc_feature (490)..(490): n is a, c, g, or t
  modified_base (493)..(498): a, c, t, g, unknown or other
  misc_feature (493)..(498): n is a, c, g, or t
  modified_base (500)..(506): a, c, t, g, unknown or other
  misc_feature (500)..(506): n is a, c, g, or t
  modified_base (508)..(526): a, c, t, g, unknown or other
  misc_feature (508)..(526): n is a, c, g, or t
tcagcgagagataccacgaccggtgctcgatttagctgtgcgtcgaaggggggaaagagccaccctcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcacatcaanagactggaggctgaagtattttgactaattttattctgtctagttattagtggtgtcgtcgtacggggtacgttcggacgagggacgcgaaaggttaggaaactacgaaaacgaacgtggtggtctcggaccaacctatcgttcgttcttactacttcccttcccgcctagttccgtaggtaacttacttccgttcctcgcgttacgggacgggtcggtcggtacgggacggaaccgggtcgtaccgaagttcgancgnnnnnngnnnnnnnannnnnnnnnnnnnnnnnnn

SEQ ID NO: 293987 - DNA, 540 bp, Homo sapiens
  misc_feature: GYAE6OF02IX0LQ.11.80.H03.1.454.CMB.1.raw
  modified_base (450)..(450): a, c, t, g, unknown or other
  misc_feature (450)..(450): n is a, c, g, or t
  modified_base (458)..(458): a, c, t, g, unknown or other
  misc_feature (458)..(458): n is a, c, g, or t
tcagcgagagataccacgaccggtgctcgatttagctgtgcgtcgaagggggaaagaggccaccctcttgtgcagggccagtcagagtgttctgccaagtacttggcctggtaccaacagaacctggccagactcccaggctcctcatctatgatgcatccaacagggccactggcaccccagccaggttcagtggcagtgggtctcgggacagacttcactctcaccatcagcagcctagagcctgaggtacttttagactagtttattactgtcctagcagcgtatcgactggatccaccgttcggaccaagggacacgactaggaaattaaacgactggtagctgcaactactcgtgtacttcacttccttcccgaccattcctgacgttactccgtactcgtctacggaggtccggtcgtgggaccgtaaggtcgactacgtagtnagtcgacngatcgagacgtagctactcacgtaagtcgtacgtagtagacgacgtacgtacgtacgctacgacgactagtcgagtcgtatc

SEQ ID NO: 293988 - DNA, 452 bp, Homo sapiens
  misc_feature: GYAE6OF02H9K8J.11.80.H03.1.454.CMB.1.raw
  modified_base (292)..(292): a, c, t, g, unknown or other
  misc_feature (292)..(292): n is a, c, g, or t
  modified_base (382)..(382): a, c, t, g, unknown or other
  misc_feature (382)..(382): n is a, c, g, or t
  modified_base (419)..(419): a, c, t, g, unknown or other
  misc_feature (419)..(419): n is a, c, g, or t
  modified_base (427)..(452): a, c, t, g, unknown or other
  misc_feature (427)..(452): n is a, c, g, or t
tcagcgagagataccacgaccggtgctcgatttagctgtgcgtcgaagggggaaagagccaccctcttgtgcagggccagtcagagtgttcttgccaagtacttggcctggtaccagcacaaacctggccaggctcccaggcctcctcattcatggtgcatccaatagggccactggcatcccagccagattcactgggcggtgggtctgggacagacttcactctcaccatcaacagactggaggctgaaagtattttgctaattttatttccgtactagtattatggttntctccgaccgggggtacgtttcggccgaaggggagcgaagggtagaaatacaaaacgaatgtggctggacaccatctgtctcatctcccncatctgatatctctcgctgagcgggctggcgaaggcnctaagtgnnnnnnnnnnnnnnnnnnnnnnnnnn

SEQ ID NO: 293989 - DNA, 172 bp, Homo sapiens
  misc_feature: GYAE6OF01EV3UJ.45.26.C04.1.454.CMB.1.raw
tcagacgcgatcgacacgaccggtgctcgatttagtctagcgactttgggtttgggggaagaggaagactgacggtcccccaggagttcaggtgctgggcacagcggccctgggctgcctggtcaaggactacttcctcgatcgcgtctgagcgggctggcaaggcgcatag

SEQ ID NO: 293990 - DNA, 187 bp, Homo sapiens
  misc_feature: GYAE6OF01A8VZ8.45.26.C04.1.454.CMB.1.raw
  modified_base (184)..(187): a, c, t, g, unknown or other
  misc_feature (184)..(187): n is a, c, g, or t
tcagacgcgatcgacacgaccggtgctcgatttagtctagcgactttgggtttggcaccaagggcccatcggtcttcccctggcaccctcctccaagagcacctctggggcacagcggccctgggctgcctggtcaaggactacttcctcgatcgcgtctgagcgggctggcaaggcgcatagnnnn

SEQ ID NO: 293991 - DNA, 174 bp, Homo sapiens
  misc_feature: GYAE6OF02GQ0HS.45.26.C04.1.454.CMB.1.raw
  modified_base (174)..(174): a, c, t, g, unknown or other
  misc_feature (174)..(174): n is a, c, g, or t
tcagacgcgatcgacacgaccggtgctcgatttagtctagcgactttgggtttgggggaagaggaagactgacggtccccccaggagttcaggtgctgggcacagcggccctgggctgcctggtcaaggactacttcctcgatcgcgtctgagcgggctggcaaggcgcatagn

SEQ ID NO: 293992 - DNA, 518 bp, Homo sapiens
  misc_feature: GYAE6OF01BJD9I.10.88.H11.1.454.CMB.1.raw
  modified_base (494)..(494): a, c, t, g, unknown or other
  misc_feature (494)..(494): n is a, c, g, or t
  modified_base (516)..(516): a, c, t, g, unknown or other
  misc_feature (516)..(516): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccacgtggcgtcccagccaggttcgatggcaggtgggtctggggacagacttcactctcaccatcagcagcctggacgcctgaagatattgctagtttattattgtcagcagcgtagcaggtgtcctttcacgtttcgggcccgggactaagtggaaactcgaaacgatgtgctgcacntctgtcttcactcctcccgctntc

SEQ ID NO: 293993 - DNA, 515 bp, Homo sapiens
  misc_feature: GYAE6OF01BUGOO.10.88.H11.1.454.CMB.1.raw
  modified_base (493)..(493): a, c, t, g, unknown or other
  misc_feature (493)..(493): n is a, c, g, or t
  modified_base (513)..(513): a, c, t, g, unknown or other
  misc_feature (513)..(513): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggacgcctgaagatattgctagtttattattgtcagcagcgtagcaggtggcctttcacgtttcgggacccgggacaaagtggaaatcaaacgactgtggctgcaccntctgtcttcatcctcccgcntc

SEQ ID NO: 293994 - DNA, 538 bp, Homo sapiens
  misc_feature: GYAE6OF01CUPVQ.10.88.H11.1.454.CMB.1.raw
  modified_base (377)..(377): a, c, t, g, unknown or other
  misc_feature (377)..(377): n is a, c, g, or t
  modified_base (530)..(530): a, c, t, g, unknown or other
  misc_feature (530)..(530): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggccgtcccagcccagggttcgagtgggcaggtgggtctggggacagacttcactcncaccatcagcagcctggacgcctagaagatattgactagtttattactgtcagcagcgtgcctacgtttcggcggtaggtcgccgtacgtttcgggacggacgggacaaagtagaggtacaaacgacgtggtggctgccacatctcgtcttcntcctcccg

SEQ ID NO: 293995 - DNA, 612 bp, Homo sapiens
  misc_feature: GYAE6OF01B0E8L.10.88.H11.1.454.CMB.1.raw
  modified_base (286)..(286): a, c, t, g, unknown or other
  misc_feature (286)..(286): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacncggcccctggacaaggacttggaggtggggtggggtgggtcagcgtcttacgaaggttggacttacactaaattatgcacagtaacgttccaggacagagtcaccatcgaccacacgacacactaccacgagacaacacgacctacagtacgaacgtgacggacgcctaggacgtatcgtagaaccgacgaaccgggtccgttaacgttacgtttcgtcgaccggacggtaaggaacggtaaaccggttaaaagggttcggaacgggttacggggttaacgggttaccggggggaacctaacgtagtaccggaaccgtacccgggg

SEQ ID NO: 293996 - DNA, 590 bp, Homo sapiens
  misc_feature: GYAE6OF01CL724.10.88.H11.1.454.CMB.1.raw
  modified_base (193)..(193): a, c, t, g, unknown or other
  misc_feature (193)..(193): n is a, c, g, or t
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgtgacgcagtcgccagccaccctgtctttttcnccgaggggacagacgtcaccctctcctgtagggccagttatggtgttggcgccttaattaaacgtggtaaccaaacgagaaacgtggaccaggctccaggcctcctnatctacgaagcanccacgaggccagtggcctcccagccaggttcagtggcaggttcgggctagggacagtacttcacgtctacaccatcagcagccgtggacgcctagaagtatagttgacttagtttattagttgtacagtcgagcgtagcgtagggtcgtacctttcgaccggtttaccgggacccgggtaaactaaaggtcggaaactacgaaaacgtaccgtggtacgtcgtacgactaactcgtaccgtgttaccttacacttcccgtacccgccgtaattcccg

SEQ ID NO: 293997 - DNA, 573 bp, Homo sapiens
  misc_feature: GYAE6OF01CICYZ.10.88.H11.1.454.CMB.1.raw
  modified_base (194)..(194): a, c, t, g, unknown or other
  misc_feature (194)..(194): n is a, c, g, or t
  modified_base (254)..(254): a, c, t, g, unknown or other
  misc_feature (254)..(254): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctattaaacnggtaccaanagaaacgtggcaggctcccagctcctcatcacgancatccaccaggccactggctccagccaggtcatggcaggtggctgggacagacttcactctcaccatcagcacgccgtggacgccgtagaacgtagtattgactagtttattagttgtctagcagcgtagcgtaggtcggtcctttacgaccgtttaccgggacccgggtaacgaaacggtaggaaacgtacgaaacgtaacgtcggtacggtcgtacgactacctacgttcctaggttccttcgtacttacccgtttccccgcctacgttaccg

SEQ ID NO: 293998 - DNA, 663 bp, Homo sapiens
  misc_feature: GYAE6OF01ERFL1.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctcggttacacctttaacacctatggcatctccgtgggtgcgacaggcccctggaacaaggacttggacggtggggtcgggtgggtccgaaggtccgtaccttaacgaaggttcggctacgaacaaagttacgtagacagaagtaacgttccaggacagagtcaccgtatgaccacgacgaccaacactacccgacgacgactacgtacgcctaacgagtacgaacgttacggaaggacgtacccgtaggacggtacgtaccggtacggtaaccgaccgtaccggtccggttaacttaacgtttccgtcggtaccggaccggtaaacggacggttaaaccggtaaaaggttcggtaacccgggttggtaacccgggtttcccggggggaactaccgtaccggtcgtacccgtaaccgggg

SEQ ID NO: 293999 - DNA, 584 bp, Homo sapiens
  misc_feature: GYAE6OF01D9CBE.10.88.H11.1.454.CMB.1.raw
  modified_base (194)..(194): a, c, t, g, unknown or other
  misc_feature (194)..(194): n is a, c, g, or t
  modified_base (255)..(255): a, c, t, g, unknown or other
  misc_feature (255)..(255): n is a, c, g, or t
  modified_base (264)..(264): a, c, t, g, unknown or other
  misc_feature (264)..(264): n is a, c, g, or t
  modified_base (391)..(391): a, c, t, g, unknown or other
  misc_feature (391)..(391): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctatttaaacnggtaccaanagaaacgtggccaggctcccaggctcctcatctacgaagcatccaccagggccactggcctcccagccaggttcatggcagtggatcgtgggacagacttcactctcaccatcagcagcctggatcngaagatatgctagtttattattgtcagcagcgtagcgaggtcggtcctttacgacgtttccgggacccggggtaactaaacgggtacggaaactaccgaaaacggtaaccgttaggttacggaccttaggacctaacccgtacttaccgttacgttacctttaccgactttcccgttcccccggccttaaccg

SEQ ID NO: 294000 - DNA, 576 bp, Homo sapiens
  misc_feature: GYAE6OF01EM5L2.10.88.H11.1.454.CMB.1.raw
  modified_base (244)..(244): a, c, t, g, unknown or other
  misc_feature (244)..(244): n is a, c, g, or t
tcagcatagtagtgcacgaccggtgctcgatttagcgacagcgagaacacacaaaggggacccaaaaccacaccctccttgggagaatccctagatcacagctcctcaccatggactggacctggagcatccttttcttggtggcagcagcaacaggtgcccactcccaggttcagctggtgcagtctggggctggaggtgaagagcccgtggggcctcgagtgaagatctcctgcgaggcttntggttacacctttacacctatggcatctctggtgcgacaggcccctggacaaggcttggaggtgggtgggtaggtcagtcgcttaccagttggctacgactaaagttgtgcacagaacgttccgaggacagagtcacatcgaccacagacacactaccacgacgacacacgcctactatacggaactggacgacgcctgagactactcgaccgacgaccggccgtacttattccgtgtacggaccgaaggtaacggtaaagtaaaacggtacggaacggttgggttaacggttacccggggggaacaacgtacgtacggtaccgaacccggg

SEQ ID NO: 294001 - DNA, 554 bp, Homo sapiens
  misc_feature: GYAE6OF01BFFVU.10.88.H11.1.454.CMB.1.raw
  modified_base (194)..(194): a, c, t, g, unknown or other
  misc_feature (194)..(194): n is a, c, g, or t
  modified_base (263)..(263): a, c, t, g, unknown or other
  misc_feature (263)..(263): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctattaaactggtaccaanagaaacgtggccaggctccaggcctcctcatctacgaagcatcccaccagggcccacgtcggccgtccccaggcccagggttccgatggcagtgggtctggggacagacttcactctcaccatcagcagcctaggacgcctagagtatttgctagtttattactgtcagcaagttataatgtacttggtttacttctacgttcggcctgggacctaaggtcgtattcgagtacgtaagtgtaggctgcctaccattccgtgttacctctaactttcccgttcccgtctacc

SEQ ID NO: 294002 - DNA, 578 bp, Homo sapiens
  misc_feature: GYAE6OF01D1Z5L.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggccccctggacaaggacttggaggtggggtggggtggtcagcgacttaccgaagttggctacaactaaattatgacacagtaacgttccaggacagagtcaccatacgaccacagacacactaccacgacgacacacgacctacatacggaactggaggacgccgagaacgatcgtagacgaccgaccggtaccgtattactttcgtacgtcgacggaggaacgaaggtaaaggtcggtaacggtagggttacggttaccggggggaacagactcggaccgtaacccggg

SEQ ID NO: 294003 - DNA, 672 bp, Homo sapiens
  misc_feature: GYAE6OF01DCM1V.10.88.H11.1.454.CMB.1.raw
  modified_base (210)..(210): a, c, t, g, unknown or other
  misc_feature (210)..(210): n is a, c, g, or t
  modified_base (233)..(233): a, c, t, g, unknown or other
  misc_feature (233)..(233): n is a, c, g, or t
  modified_base (383)..(383): a, c, t, g, unknown or other
  misc_feature (383)..(383): n is a, c, g, or t
  modified_base (430)..(430): a, c, t, g, unknown or other
  misc_feature (430)..(430): n is a, c, g, or t
  modified_base (647)..(647): a, c, t, g, unknown or other
  misc_feature (647)..(647): n is a, c, g, or t
tcagcatagtagtgcacgaccggtgctcgatttagcgacagcgagaacacacaaaggggacccaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagngcccgtggggcctgagtgaaagntctcctggcgaggtcttcgtggttaaccaccttttaacacctatggactatctccgtgggtgcgacacggcccgtggaacaaggacttgaggtggggtggggtaggtcaggtcgtacttaccgaagttcgggactaactaacaaaatttnacggacaagaaggtaacgttccgaaggaacgtagacggtacaacganacgaaccaacacgaacacgaactacccaagaacgacaacaacgacctaacctaagacggaaactaggaaggacggacctaaggagtaactacgtacggaaaccgaacggtaaccggacccggttaagttaacttcgttacggaccgaccggtaaaggtaaacgaaaaggttaaaacggacggttaacggggtaggttaacgggtacccgggggaaanaccgtagtacggacggtaacccggg

SEQ ID NO: 294004 - DNA, 670 bp, Homo sapiens
  misc_feature: GYAE6OF01AQJQ5.10.88.H11.1.454.CMB.1.raw
  modified_base (195)..(195): a, c, t, g, unknown or other
  misc_feature (195)..(195): n is a, c, g, or t
  modified_base (273)..(273): a, c, t, g, unknown or other
  misc_feature (273)..(273): n is a, c, g, or t
  modified_base (626)..(626): a, c, t, g, unknown or other
  misc_feature (626)..(626): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgtctttttcnccgaggggacagagtccaccctctcctggtacgggcctagttatggtgttggccgtaccttaattaactggtaccaanagaaacgtggccgaggcctcccgaggtcctcctcatccgtacgaacgcactcccaccgagggcccacgtcgggaccgtcccgagccgtaggttcgagtcggactagggtcggtcgagggacagtaccttcgacttccgtacacctatcgacgcacgaccggtggacgtccgtagaacgtattagttcgtacgtttaagtttacttagttcgtactaagtacgtacgtaccggtagacggtagggttccgttaccgttttacccggttaccgggtttcccggggaacccggggtaactaaagggtacgtaaacgaccgtaaacgtacgtggtacgtaccgtacgaccaccgttntaccgttacttcgttacctacgttaccccttcccgctactaccg

SEQ ID NO: 294005 - DNA, 658 bp, Homo sapiens
  misc_feature: GYAE6OF01DP96A.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagacgccgtggggcctgagtgaagatcgtcctgcgaggcttcgtggttacctaacctttaacacctagtggacatccgtccgtgggtcgacgacgacggccccgtaggaacgaaggtacgttggacggttgggggtggggtggtcgacggccgtaccttaacgaggttcggactacgaaacgtaaagtttatacgacaacgtaacgtaacgttccgaaggacaggtacgtaccacgtagtacgaaccaacaacgaccaacgacgtaaccaccgtaacgaccaacgacgacctaacgagtacggaacgtagacggacgtacgtagagtacgtacgtacgacgaccggaccgtacgttacttagttcgtgtacggacggaaggtaacggtaagtaaaggtcgaacgtagttacgggtacggtaccggggaactaacgagtaccggtaaccgg

SEQ ID NO: 294006 - DNA, 696 bp, Homo sapiens
  misc_feature: GYAE6OF01DAAE1.10.88.H11.1.454.CMB.1.raw
  modified_base (433)..(433): a, c, t, g, unknown or other
  misc_feature (433)..(433): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggcctcccgaggtaccaccggagagtattgtgttgacgcagtcgccacgccctacccttgtttcctttttccaccgaggggacagactccaccctctccgtggtacgggcctagttagtggtgttcggcgtaccttaatttaaacgtcggtaaccaacaaggaaaccgtggaccaggcctacccgagtcctcctcactcgtaacgaacgcaacgtacccaccggacgggccctacgtcggacccgtacccacggccgtaaggttcggatcggacgaggtgggtctagggactagtcttacnctctacacatcgacgtcacgtcgtacgggactacgtagaagtattacgttagtacctttagtttaattagtttcggactacggtagtacggttacgtagtccggttacgggttccggttcccttttaccggtacccgggtttacccggggtacccgggtaaaccgttaaagggtaacggaaactaaccgaaacggttacgtacgggtacgtcggtcaccgtaactgtccttcgtactcgtacttcccncccgtntacgtaccg

SEQ ID NO: 294007 - DNA, 614 bp, Homo sapiens
  misc_feature: GYAE6OF01C2MBV.10.88.H11.1.454.CMB.1.raw
  modified_base (253)..(253): a, c, t, g, unknown or other
  misc_feature (253)..(253): n is a, c, g, or t
  modified_base (297)..(297): a, c, t, g, unknown or other
  misc_feature (297)..(297): n is a, c, g, or t
tcagcatagtagtgcacgaccggtgctcgatttagcgacagcgagaacacacaaagggggaggaactgctcagttaggacccagagggaaccatggaagccccagctcagcttctcttcctctgctactctggctcccaggtaccaccggagagattgtgttgacgcagtcgccagccacctgtctttttctccaggggacagagtcaccctctcctgtagggccagttatggtgttggcgcctatttaaacnggtaccacagaaacgtgccaggctccaggctcctcatcacgaancatccacaggccactggccgtccagcccaggttcgatcggcagtcgggtctgggacagtacttcactctcaccatcacgcagcctggacgccgtagaagatattgtacgtagttttaacttacttgtacaaactacgtaccgtaccggtagtccgggtcccgtccgggggtccctaccgtttcccgggccccgttaggggaaccctaaaggtcgggtaacttaaacgtaccgtaaaacggtaaccgttggtacggtccgtcgacctaccgacttacgttcgttacctttacgacctttcccgttcccgtccctaacg

SEQ ID NO: 294008 - DNA, 784 bp, Homo sapiens
  misc_feature: GYAE6OF01D61JN.10.88.H11.1.454.CMB.1.raw
  modified_base (290)..(290): a, c, t, g, unknown or other
  misc_feature (290)..(290): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagacgcccgtggggcctcagtgaagatctcctgcgaggtcttcgtggttacaccgtttaacacctatggctatctccgtgggtcncgtacgacggccccgtaggaacgaaggtacttagggagggtgggggttagggggtcgggtacgacgggtccgtaccgttaacccgtaaggttcgggaccttaacgtaacctaaaagtttacgttacggaccgtaacgaaggtaaaccggtttaccggaacgggaaccgtaacggtaccgttaccgaaacccgtacgttaaccgggaacccaaccgaacggaacccaacctaaccgttaacccgaaccggtaaccgaccgaaccgaaccgtacccgtaacctaacggtacggaaacgtacggaacgggacgtaccgtacggaagtaacgtaccgtaggaacccgtacgaccggttaccgttaatttacgtttacctcgggacgacgggtaacggaacggttaaacggttaaaacgggtacgggtacgggttaaggggttaacgggttacccggggggtaacaaccggtaacgtaccggtaaccggtaacccgggg

SEQ ID NO: 294009 - DNA, 586 bp, Homo sapiens
  misc_feature: GYAE6OF01AV775.10.88.H11.1.454.CMB.1.raw
  modified_base (195)..(195): a, c, t, g, unknown or other
  misc_feature (195)..(195): n is a, c, g, or t
  modified_base (413)..(413): a, c, t, g, unknown or other
  misc_feature (413)..(413): n is a, c, g, or t
tcagcatagtagtgcacgaccggtgctcgatttagcgacagcgagaacacacaaagggggaggaactgctcagttaggacccagagggaaccatggaagcaccagctcagcttctcttcctcctgctactctggctcccaggtaccaccggagagattgtgttgacgcagtcgccagcccaccctgtctttttcnccgaggggacagagtcaccctctcctgtagggccagttatggtgttggcgtcctatttaaacgtggtaccaacagaaacgtggccaggcctcccaggctcctcatcctacgaagcactccaccgagggccacgtcggccgtccccgagccctagggttcgagtcgggcaggtgggtctggggacagactttcactctacacaatcagcagcctggacnccgtagaagattagttgactaagtttttatatttgcagtcgagtcgtagcgtaggtcgtcctttcgaccgtttccgggacccgggtactaaacggtggaaaactccaaacgtacgttggacggtctacgactaccgtattcgttcgttccttacactttcccttcccgctacg

SEQ ID NO: 294010 - DNA, 765 bp, Homo sapiens
  misc_feature: GYAE6OF01CQ1MG.10.88.H11.1.454.CMB.1.raw
  modified_base (193)..(193): a, c, t, g, unknown or other
  misc_feature (193)..(193): n is a, c, g, or t
  modified_base (721)..(721): a, c, t, g, unknown or other
  misc_feature (721)..(721): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccacggagagattgtgttgacgcagtcgccagcctaccctgtcttttcnccgagggacagcgtcaccctctcctggtagggcctagttagtggtgttggccgtaccttaatttaaacgtcggtaaccaaacgaagaaacggtcggaccgaacggcctacccgaggcctacctcaatcgtaacgaagccactacccaccgaacgggtcccaacgtcgggacccgtacccaaggcccgtaagggttccggaagtcgggacctaggggttcgggggtaccgttaggggaaccgtagtacctttcgaaccttcctaccaacctagcccgaagccaacggtcccgtagggaccgtaccgtaaggaagttacttaagttcgtaacgtttaagttttaagttagtttacggtaccgaaggtacccgtaggtaacggttacggacggtaacggggttccggtttacccttttaccggtaacccgggttttaccccggggaaccccggggtaaacgtaaaagggttaaccgggaaaacttaccggaaaacggttacgttagggtcgtacgtacggaccctaccgtnttccgttcgtaccttcgactttacccgttcccgcttacgtaccg

SEQ ID NO: 294011 - DNA, 756 bp, Homo sapiens
  misc_feature: GYAE6OF01AFE0U.10.88.H11.1.454.CMB.1.raw
  modified_base (203)..(203): a, c, t, g, unknown or other
  misc_feature (203)..(203): n is a, c, g, or t
tcagcatagtagtgcacgaccggtgctcgatttagcgacagcgagaacacacaaagggggaggaactgctcagttaggacccagagggaaccatggaagccccagcgcagcttctcttcctcctgctactctggctcccagacaacactgcagaaatagttatgacgcagtctccagccaccctgtctgtgtctcgagggganagacgcccacctctcctgcgacgggccggtcaagaattatcgacctaccaacttagcctggtactcaacaaagcctggccacggcctcccagtacctccgtacactctcgtggtcgactacttccgttcggacgggcctacgtcgggtcgtcccgacgtcccgtaggtttcgaggtcgggacgtacgggttcgggtcgtaacgggaacctagggtacgttccacttcctaccacctacgtacgacgggtccggtacctggtaccgtacgttacgtaggtaacgtttacgtttttacggacccttttaggttttacttaccgttcggttaccgtaagtaaccgttaaggtttaacttaaacggttcgggtttaaccgtttttggggttttttaaccttacccggtttaaccggttttacccggggtacccggttaaccggggtaaacgttaaacgggtttcggttaaccgttttacggtaaacggtaaacccggtttacggttcgggttaccggttaccgttaccggtacccgttaaaccgtggttttacccgg

SEQ ID NO: 294012 - DNA, 620 bp, Homo sapiens
  misc_feature: GYAE6OF01AU4MD.10.88.H11.1.454.CMB.1.raw
  modified_base (193)..(193): a, c, t, g, unknown or other
  misc_feature (193)..(193): n is a, c, g, or t
  modified_base (257)..(257): a, c, t, g, unknown or other
  misc_feature (257)..(257): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttcnccaggggacagagtcaccctctcctgtagggccagttatggtgttggcgtaccttatttaaacnggtaaccaacgagaaacgtggccaggcctcccgaggcctcctcatctaacgaagcactccaccgagggccacgtggcctcccagccgaggttcgatggcaggtcgggtctgggacagacttcactctacacatcagcagccgtagacgcgtagaagtatacttgacttagtttattatgtacagtacagtcgtagtcgtagggttcgtccgtttactaccggtttccggggacccgggtaaactaaaggtacgggtaaactacgtaaaaccgtacgtcggtacggtacctggtacccaacgtaacttccgttacgttacccgttactaaccgtttcccgttacccccggacttagttaacccg

SEQ ID NO: 294013 - DNA, 760 bp, Homo sapiens
  misc_feature: GYAE6OF01BR39K.10.88.H11.1.454.CMB.1.raw
  modified_base (197)..(197): a, c, t, g, unknown or other
  misc_feature (197)..(197): n is a, c, g, or t
  modified_base (269)..(269): a, c, t, g, unknown or other
  misc_feature (269)..(269): n is a, c, g, or t
  modified_base (749)..(749): a, c, t, g, unknown or other
  misc_feature (749)..(749): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgttctttttccnccgaggggtacagagtccaccctctccgtgtacggcctagttagtggtgttggcgtaccttaatttaaacgnggtaaccaacgaagtaaacggtggccaaggcctaccgaggtcctctacagtctacgaagcactccaccgaggccacgtcggccgtaccaggtacccgtagggttccgagttcggacgtagggtggtccgtaggggaacctaggtacctttacacgtacctaccgaacctattccgaagtaccaacgggtcccgttagggaaccgaccgttaaacgggaaacgttacttaacggtttacgaaaccgtttaaggtttttaatttaacggttcgtaccgaaggtccgtaaagtcgggtagacggttaggggttaccgttcccgttttaccgtaccgggtttaccccggggaaccccgggttaaagtaaaacgggttaacggtaaaacgtacccggaaaaacggttaccggttggtaaccggtccgtaaggtacccaacgttacttcgttaacggtccttaccgtaccttacccgtaccccgtntacccgttacg

SEQ ID NO: 294014 - DNA, 695 bp, Homo sapiens
  misc_feature: GYAE6OF01DS0EB.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcgagtgaagatcctccgtgcggacgtcttcgttacgttaacctaacctttaaccacctagtcgactacttccgtcggtggtcgaccgacgccggtcccgtaggaacgaacggtacgttggtaggggttgggggtggggttcggtacgacggtccgttaccgtaaccgttaaggttcggtaactaacgtaaacgttaaagtttgacgaacaacgtaagttaaccgtacggaacggaacgagtacgtaccaactacgtacgaaccagaaccgaacaactacgtaccgaacgacgaccaacgaccgtacctacgtaagtacggacgtaggagacgtcaagtacgtactaccgtacggaaccacggtaccgtacgttattacgttcgacgaccgaggaacggtaaacgtaaaggtaaggtcggtaacgggttagggtaaccgggtaccgggaataacgtagaccgtacccggtaccgggg

SEQ ID NO: 294015 - DNA, 599 bp, Homo sapiens
  misc_feature: GYAE6OF01EQ2RO.10.88.H11.1.454.CMB.1.raw
  modified_base (265)..(265): a, c, t, g, unknown or other
  misc_feature (265)..(265): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
  modified_base (407)..(407): a, c, t, g, unknown or other
  misc_feature (407)..(407): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtaggccagttatggtgttggcgtcctatttaaactggtaaccaanagaaacgtggccaggctcccaggctcctcatctacgaagcatccaccaggggccacgtggccgtcccagccaggttcgatggcaggtgggtcngggacagacttcnctcncaccatcagcagcctgngcctgaagatagttnactagtttattatgtcagcagtcggtagccgaggtcggtcctttcgaccgttttccgggacccggggtaacctaaacggtacggtaaaacgtcgaaaaaccgtacgttggtacgggtcctacggacccaaccgtacttaccgttacgttaccgtttacctacttaccccgtttccccgccgtacgttacccg

SEQ ID NO: 294016 - DNA, 621 bp, Homo sapiens
  misc_feature: GYAE6OF01BMGVU.10.88.H11.1.454.CMB.1.raw
  modified_base (373)..(373): a, c, t, g, unknown or other
  misc_feature (373)..(373): n is a, c, g, or t
  modified_base (409)..(409): a, c, t, g, unknown or other
  misc_feature (409)..(409): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccgaggggacagagtccaccctctcctgtagggccagttatggtgttggcgtccttatttaaactggtaccaacagaaacgtggccaggcctcccaggcctcctcatctacgaagcatcccaccgagggccacgtggccgtcccagccaggttcgagtggctaggtggggtctgggacngtaccttcactctcaccatcagcagccgtagggacnccgtgaagtattattgacttaagttttattagtttcgtctagctagtcgtagcgtagggttcgtaccttttcgtaccggtttccggggacccgggtaactaaaggtcggaaaactacgaaaacgtacgttggtaccggctacggaccctaaccgtcttccgttagtttaccctttacacccgtttcccgtttcccccggacctacgttcccg

SEQ ID NO: 294017 - DNA, 578 bp, Homo sapiens
  misc_feature: GYAE6OF01BOENY.10.88.H11.1.454.CMB.1.raw
  modified_base (380)..(380): a, c, t, g, unknown or other
  misc_feature (380)..(380): n is a, c, g, or t
  modified_base (401)..(401): a, c, t, g, unknown or other
  misc_feature (401)..(401): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagacgcccgtggggcctcgagtgaagtactcctccgtggcggaggtctttcgttcggttaacctacctttaaaccaccttagtggcatcctccgtgggtgcgacgcggcccctggacaaggcttggaggtggggtggggtgggtcaggcgtctacgtagttggctacactaattngcacagacgttccgagacagngtcacatcgaccacagaccacactaccacgacgcaacgacgacctacagtacggaacgtagaggtacgcgtagagacgtcgagacgaccgacggtcgtattacttcgtgcgaggaggacgtaagtaaaggtggtacggtaggttacggtaccggggacacgacgtgaccgtaccggg

SEQ ID NO: 294018 - DNA, 818 bp, Homo sapiens
  misc_feature: GYAE6OF01CJH7Z.10.88.H11.1.454.CMB.1.raw
  modified_base (180)..(180): a, c, t, g, unknown or other
  misc_feature (180)..(180): n is a, c, g, or t
tcagcatagtagtgcacgaccggtgctcgatttagcgacagcgagaacacacaaagggggaggaactgctcagttaggaccagagggaaccatggaacgccccagctcagtcttcttcttcctcctgctactctggctcccaggtaccacggagagattgtgtgacgcagtctccaaccncctgtctttgtctcggtgggggacacgccacctctctgcacgggcctaggtacgttaaccttttaggtagttaagtttagtttacgccgttaggtagtccggaaactaaaaaccgtcgggaccacggccctacccggtaacttcccgttcgttttcggtttacgggtacggtacgtacccgttaacggtaccgggggtaccaaccggtccggaacccaacccgaacggaacgaacggtaacgtacgaacgggtcggacggtaacgggtccgggtacggtacgggaacgaacggttaccttacgtaactttccaacctaacctaacgtaaccaaaccgaacggttacacggtaacaacggtaacccggttaaggaaaagttactttaacgttaagtaaccgtttaacttttaaccgtaacgttagtaccgtagtaccgtaagttacgtttacccggttaccgttaccccggtaggttaacccggtcggaaccgaacgggtaacgtaaggggtaccgaaacgtaacctaaaccggaacgtacgttacgggaccggtaccgttacgtaacccgtactaacgtttccgtaacgttccgtttaaacctccttacccgttacccacttacgtccacggtaaacc

SEQ ID NO: 294019 - DNA, 576 bp, Homo sapiens
  misc_feature: GYAE6OF01AYMJP.10.88.H11.1.454.CMB.1.raw
  modified_base (192)..(192): a, c, t, g, unknown or other
  misc_feature (192)..(192): n is a, c, g, or t
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (388)..(388): a, c, t, g, unknown or other
  misc_feature (388)..(388): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccacctgtcttttcnccaggggacagagtcaccctctcctgtagggccagttactggtgtcggcgcctaatttaaacnggtaaccaanagaaacgtggccaggctccaggcctctcatctacgaagcatccaccgaggccacgtggcctccagccaggttcgatggcagtgggtctgggacagacttcgactcacacatcagcagcctganctgaagntatnctagttatattgctagcagcgtagctagggtcgcctttacgacgtttccggggacccgggtaacgtaaacggtggtaaaactacgaaaaaccgttaacgtgtaacgggccttacgacccgtaccctaagttcccttggttacctttacgactttacccttccccgccgttactaccg

SEQ ID NO: 294020 - DNA, 891 bp, Homo sapiens
  misc_feature: GYAE6OF01AD6X6.10.88.H11.1.454.CMB.1.raw
  modified_base (194)..(194): a, c, t, g, unknown or other
  misc_feature (194)..(194): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttcttttcncgaggggacagagtccacctctccgtgtagggcctagttagtggtgtcggcgtaccttaatttaaacgtcggtaaccaaacgaaggtaaaccggtggaccacgggtccctaccccgaggtcctccctactactaccgtaacggaaagccaactaccccgaaccggtacggggacccctaaccggttccggggacccgtaccccgacgggtaccccgtaaggggtttaccgaacggtcggggaccgtaggggttcgggggttaccggtacgggggaacctaacggtacccttttccgaaccttccctaaccgaaccctagttccgaaccggtaccaaccgggtccccggtaggggaacgtaccgtaaacgggaaacggttaattacggtttacgtaaccgtttagtttttaactttaaggttacgtacgtaacggtaccgtaaggtccggttaacggaccgggttaacggggttcccggtttaccccgtttttaccgggtaaccccggggttttaccccgggggaaacccggggttaaaccggtaaagggttaaccgggtaaaacctaaaccggtaaaaaccgggtccgttacggggttaccggtcccgtaacggtaccctaaccgttacgtttcccggttactttaccgtttaaccctacccgttttacccccgttccccggtaacttcggtaaccg

SEQ ID NO: 294021 - DNA, 597 bp, Homo sapiens
  misc_feature: GYAE6OF01BTO2Y.10.88.H11.1.454.CMB.1.raw
  modified_base (194)..(194): a, c, t, g, unknown or other
  misc_feature (194)..(194): n is a, c, g, or t
  modified_base (296)..(296): a, c, t, g, unknown or other
  misc_feature (296)..(296): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgtcctaatttaaaactggtaccaaacagaaacgtggccaggctccaggcctctnatctacgaagcatccaccgaggccactggccgtccagccaggttcatgcagtcggtctgggacagacttcactctcaacatcagcagtcctagacgctgaagatattgactagtttaatacttgtcagcagcgtagcagggtcgtccttttacgaacgttttccgggacccggggtaaacctaaaacgggtagaaaagtactaaaaacgtaaacgttcggtagggtactcggtaccaaccgtaacgttacttcggttacctttacaactttcccgtttaccccgaaccccgtaattacccg

SEQ ID NO: 294022 - DNA, 625 bp, Homo sapiens
  misc_feature: GYAE6OF01ETNHG.10.88.H11.1.454.CMB.1.raw
  modified_base (212)..(212): a, c, t, g, unknown or other
  misc_feature (212)..(212): n is a, c, g, or t
  modified_base (323)..(323): a, c, t, g, unknown or other
  misc_feature (323)..(323): n is a, c, g, or t
  modified_base (504)..(504): a, c, t, g, unknown or other
  misc_feature (504)..(504): n is a, c, g, or t
tcagcatagtagtgcacgaccggtgctcgatttagcgacagcgagaacacacaaaagggggaggaactgctcagttaggacccagagggaaccatggaagccccagctcagcttctcttcctcctgctactctggctcccagttttcagataccaccggagagattgtgttgacacagtctccagccaccctgtctttgctccaaggggaanagccaccctctcctgcagggccagtcagagtgttggcgcctacgtagcctggtaaccaacgaacgaaacctggaccaggcctcccgacggcccctcactcctagtgggtcncactaccaacgacgggccacgtggcaacgtcccgagcctaggttccaggtcggcaggtgggtcgtaggggactacggaccttcgactccgtacacctatccactccagtcctaggacgccgtagaacgtagttcgtgtactagtttacttacgtacgtacaacgtacgtaccggtaaccgnggttaccggccggtacccgggggtaccctacggtttcccggcccgttacgggaaacctaaaggtcggtaacttaacgtaccgaaacgtacgtaggtcgccgtacgaccaactgtcgttacg

SEQ ID NO: 294023 - DNA, 570 bp, Homo sapiens
  misc_feature: GYAE6OF01CQB71.10.88.H11.1.454.CMB.1.raw
  modified_base (260)..(260): a, c, t, g, unknown or other
  misc_feature (260)..(260): n is a, c, g, or t
  modified_base (278)..(278): a, c, t, g, unknown or other
  misc_feature (278)..(278): n is a, c, g, or t
  modified_base (370)..(370): a, c, t, g, unknown or other
  misc_feature (370)..(370): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgagagccctggggcctcagtgaagatctcctgcgaggcttctggttacacctttaacncctatgcatctctgggtncgacaggcccctggacaggacttgaggtgggtgggtggtcagcgcttacgagtgctacactaattatgcacgagtaagttccgaggtacagngtacacatcgaccacacgacacatccacgacgacacacgctacagtagaactaggacggacgctgagactcgtacgacgtacgaccggtcttattagttcgtcggaccgaggaacggtaaggaacggttaaaaggtggtaaccgggttagggttacgggttaccggggggacctaacgtacgcggaaccggtacccgggg

SEQ ID NO: 294024 - DNA, 635 bp, Homo sapiens
  misc_feature: GYAE6OF01A0WLX.10.88.H11.1.454.CMB.1.raw
  modified_base (194)..(194): a, c, t, g, unknown or other
  misc_feature (194)..(194): n is a, c, g, or t
  modified_base (256)..(256): a, c, t, g, unknown or other
  misc_feature (256)..(256): n is a, c, g, or t
  modified_base (265)..(265): a, c, t, g, unknown or other
  misc_feature (265)..(265): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggcctagttatggtgttggcgtcctattaaacnggtaccaanagaaacgtggccaggctcccaggctcctcatactacgaagcactccaccaggccacgtggccgtacccgagccgtaaggttcgagtcggctaggtcggggtctgggacagacttcacgtctcaccatcacgcgacgccgtaggacgcgtagaagattacgtagacttaaggtttactttacgtcgttacgagtcgtacgtcgttcgccttacggttcggggacggtagggtccgtccggtaaccgtttaccggggacggtaacgggaaaccctaaaagggtacggaacggtaaccgtaaacgtaacgttggacggtaccgtggaccctacgacttccgtcgttaccgttacgtacgttcccgttaacccg

SEQ ID NO: 294025 - DNA, 581 bp, Homo sapiens
  misc_feature: GYAE6OF01EJV6H.10.88.H11.1.454.CMB.1.raw
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagtcaggggatcagcagcaatttagcctggtaccaacagaagcctggccaggttcccagactcctcatatatgaagcctctccgagggccacgtggacgtcccagccgtaggttcaggcggcggtggtcgtgggacagacttcacgtctacaccatcagcacgcctgcagtctgacggtaccgttggtacgttttattacgtgtacagtctagtatactagtaacgtcggtcctcggtacggtacgttccggaaccgaagggtaaccgtaagggtcggacccgtacgaaaccggtacgtaggtacggtactcggaccacctattccgtcgtaccttctacgtcccgttaccccg

SEQ ID NO: 294026 - DNA, 731 bp, Homo sapiens
  misc_feature: GYAE6OF01B6LSU.10.88.H11.1.454.CMB.1.raw
  modified_base (202)..(202): a, c, t, g, unknown or other
  misc_feature (202)..(202): n is a, c, g, or t
tcagcatagtagtgcacgaccggtgctcgatttagcgacagcgagaacacacgaaagggggaggaactgctcagttaggacccagagggaaccatggaagccccagctcagcttctcttcctcctgctactctggcctcccgaggtaccacggagagattgtgttgacgcagtccgccagccctacccttgttcctttttcnccgaggggacagacgtccaccctctccgtggtacgggcctaagttagtgggttgttcgggcctaccttaagtttaaacgcggtaaccaacgaaggaaacggtcggaccaggcctaccgaggtcctccgtctactccgtaacggaagcctaacgtcccaaccggacgggacccaccggtcggacccgtacccgacgccgtaggttccgagtcggcgtagggttcgggtacgtacgggacacggtacctttaccgaccttctaccacctactccgaacgcgacggtccgtaggaccgtccgtaagaacgtaacttgtttacgactttagtttatagttacgtacgagtaccgaggtcgtacggacggttagggtaccgttccgtttaccgttacccgggttacccgggggaacccgggtaacgtaaaggttaacgggaaacttaaccggaaaacggtacgttcgggtacggctaccggaacctaccttagtcctttacgtacctttcaccgttcccgtcccgatcgtaccg

SEQ ID NO: 294027 - DNA, 620 bp, Homo sapiens
  misc_feature: GYAE6OF01AY9E3.10.88.H11.1.454.CMB.1.raw
  modified_base (221)..(221): a, c, t, g, unknown or other
  misc_feature (221)..(221): n is a, c, g, or t
  modified_base (274)..(274): a, c, t, g, unknown or other
  misc_feature (274)..(274): n is a, c, g, or t
  modified_base (359)..(359): a, c, t, g, unknown or other
  misc_feature (359)..(359): n is a, c, g, or t
  modified_base (367)..(367): a, c, t, g, unknown or other
  misc_feature (367)..(367): n is a, c, g, or t
  modified_base (419)..(419): a, c, t, g, unknown or other
  misc_feature (419)..(419): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagcccgtggggcctnagtgaagatctctgcgaggcttctggttacacctttacactatggcatctccngggtgcgacacggcccctggacaaggcttggaggttggggtggggtcggtcaggcgtcgttaaccgaaggttggacctaacgaanaaatttancggcaacgaagtaacgtccaagggacaggactcacatcgacacagacacacnccacacgacaacacgacctaacacgtagggaacctagggaaggacgaccgtaggaacgtacgtccgtacggtaacggaccgtaccgggtaccgtacgttacgtttcggagccgacgaaggtaacggaacggttaaaaggtcggacggttagggttaaccgggttaccgggggaacaacggcgtacggtacgtaacccgggg

SEQ ID NO: 294028 - DNA, 688 bp, Homo sapiens
  misc_feature: GYAE6OF01BGDO8.10.88.H11.1.454.CMB.1.raw
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (422)..(422): a, c, t, g, unknown or other
  misc_feature (422)..(422): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtccaccctctcctgtagggccagttatggtgttggcgtcctatttaaacgtggtaaccaacagaaacgtggccaggcctcccgaggcctcctcactccgtacgaagcactaccaaccgagggcccagtcggccgtacccaggccgtagggttaccgagtcgggctaggtcgggtactggggacagtactcacgtcncacntcagcacgctggacnccgtagaacgattagttgacgttaagttttattagtttacgtcgtacgtacgagtacggtaagtcggtaagggttcggttaccccttttaggtaccccgggttttaccgggggacccccggggtaaacctaaaggggttaccggtaaaacgttaccgaaaaaccggtacggttacgggttacggtcggtacggtacccaccgttacttcccgttagttacccgttacttaaccgttccccgtttaacccccgcgttacgttacccg

SEQ ID NO: 294029 - DNA, 717 bp, Homo sapiens
  misc_feature: GYAE6OF01C80P1.10.88.H11.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (449)..(449): a, c, t, g, unknown or other
  misc_feature (449)..(449): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacgaggtcgccccactcccaggttcagctggtgcagtcgtggggctggaggtgaagcgccgtggggcctnagtgaagntctcngcgaggtcttctgttaccacttacactatcgctactctccgtggtcgccgaacgaccggtcccctagggaccgtaaaggtcgttagggtaggggtgggggtcgggggttggtacgacggtcgtaccgttaacgtaggttcggactaacaactaaagtttacgtacgacactaaggtaacgttccgaaggtacaggtacgtaccaacgtanacgaccaacgacacacactaccacgaacgacaacgaccgacctaacgtagtacggaacgtacggacgggacgtccgtagaacgtacgtacggtacggaaccgacggtaaccggtaccgtttagttacgtttcgacgggtaccggtaacggaaacgggttaacggtaaacggttaaagggtaccggttaaacggggttacgggttaacccgggggttaacccgggggaaactaccggtaacggtacccggtaaccgggtaacccggggg

SEQ ID NO: 294030 - DNA, 889 bp, Homo sapiens
  misc_feature: GYAE6OF01AROQN.10.88.H11.1.454.CMB.1.raw
tcagcatagtagtgcacgaccggtgctcgatttagcgacagcgagaacacacaaagggaacccaaaaccaacacccctccttgggagaatccctagatcacagctcctcaccatggactggacctggagcacttccttttcttggtggcaggcagcaacgaggtcgcccactcccgtaggttcagctggtgcaggtcgtggggctaggaggtgaacgcggtcccggtggggcctcgagtagaagtactccgtccgtggacggtcggtcctttcggttcggttacctaacccttttaacacctagttggcctagttcctccggttggggaccgtcggaccgtaccgggtcccctagggaacctaacgggtacgtttcggaggggttggggggttcgggggttcggtacggtagggaccggttaccgtttaaccggtaagggttttcggacccgtttaaacgaaaacgttaaaacgtttcgtacggaacccgtaaaccggtaaggttaaacccgttaaccgggaacggtaacccgtaaaagggtaccggtttaaccccgaaacctaacggttacccgggaaaacccgtaaccgtaaacgaacccggtaacctaccgtaaccccgtaaacggaaccgttaaccgaaacctaaccggtaaccccgttaaacgtaaccgttaaacggtaaacccggtaaggtaacgggaccgttaccgggtaacgtaaccggttaacgtaccggtaacgaacccggtaccggtaaccgggtacccggtaattaccgttacgtacggacgtaacgggtaacggtaacggtaaaggtaacggttaacgggacggttacgggtacgggttacgggggaactagtaacggtcggaaaccggtccgggg

SEQ ID NO: 294031 - DNA, 630 bp, Homo sapiens
  misc_feature: GYAE6OF01AWGJU.10.88.H11.1.454.CMB.1.raw
  modified_base (363)..(363): a, c, t, g, unknown or other
  misc_feature (363)..(363): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcctgcgaggtcttcgtggttactacctttaacacctagtggcatccgtccgtgggtgcgacgacggcccctggacaaggtacttggaggtggggtggggtggtcagcgcttacgagttgctacataatngacacagtacgtccgaggacagtagtacaccagtacgaccacgacgaacacactaccgaacgacgaccacgacgaccctaacagtacggaacgtggaacggacgaccgtagacgtaacgtccgtacggaaccgaccgtaccggtaccgttattacgttcgacggacggacggtaaggacggtaaacggttaaaggtcgggtaacgggttacgggttaacggggttcccgggggaactaacgtacggtacggtaaccggtacccgggg

SEQ ID NO: 294032 - DNA, 731 bp, Homo sapiens
  misc_feature: GYAE6OF01BG4U5.10.88.H11.1.454.CMB.1.raw
  modified_base (190)..(190): a, c, t, g, unknown or other
  misc_feature (190)..(190): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgtgacgcagtcgcagccacctgtcttttcncgagggacagagtccacctctcctgtacgggcctagttatggtgttcggccgtaccttaatttaaaccgtcggtaaccaaacgaacggaaaacggtcggaccaagggcctcccgaggtcctcctacaatcctaacgaagccaactcccaaccgacgggcccacgtcggaccgtcccaaggtcccgtaagggtttccgaagttcgggaccgtagggttcggggtcgtacggggaacctacggtaccttacgacccttccgtaaccaacccgtaagtccgaacggaccaacggtacccgttaagggaccgtacccgttaaggtaaacgtttacgtttttacggaactttaaggttttaacttaccggtagtaccgagtacgtacggtccgtcgtacccgttacggtttcggggacggtacgtaccgtcccgttacggttacgggacggaacggaaactaaggacggtacgtaacgaaacgtacgtggtacgtcgtacgacctacgtattccgttacgtaccttagtaccttcccgtccgtaac

SEQ ID NO: 294033 - DNA, 699 bp, Homo sapiens
  misc_feature: GYAE6OF01BONAT.10.88.H11.1.454.CMB.1.raw
  modified_base (197)..(197): a, c, t, g, unknown or other
  misc_feature (197)..(197): n is a, c, g, or t
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgttcctttttcnccgaggggacagacgtccaccctctcctgtacgggcctagttatggtgttggccgtccttaatttaaacgtggtaaccaacagaaacgtggaccgaggcctcccgaggcctccncatcctaacgaagcactccaccgacgggcccacgtcggccgtcccgacgtccgtaggttcgacgtcggacgtagggtcgggtcgaggggaacncggtaccttcactcctaccacctatacacgcacgccgtaggacgtccgtaagaagtattattacgtacgttaagttttaattagtttcgacgtagtcgtacggtacgtaggcgttacgggtcggtttcccgtttacgtacccgggtttacccggggaaccccggggttaacgtaaacgggtacggtaaactaaccggtaaaacggtaccgttcggtacggtccgttacgacccgtacgttacctcgttacgttacccttacgtaccgttaccccttacccgtccgtacttacccg

SEQ ID NO: 294034 - DNA, 786 bp, Homo sapiens
  misc_feature: GYAE6OF01B1OE8.10.88.H11.1.454.CMB.1.raw
  modified_base (200)..(200): a, c, t, g, unknown or other
  misc_feature (200)..(200): n is a, c, g, or t
tcagcatagtagtgcacgaccggtgctcgatttagcgacagcgagaacacacgaaagggggaggaactgctcagttaggacccagaggaaccatggaagccccagctcagcttctcttcctcctgctactcgtggctcccaggtaccaccggagagtattgtgtgacgctagtcgcacgcctacccttgttccttttccnccgagggactagacgtcaccctctccgtgtacgggctagttgtgggtgttcggcgtaccttaattaaacgtcggtaaccaaacgtaaggtaaaccgtggacccagggtccctacccgaggtccctcctacacgttaccgtaacgaaagccaactaccccgaacggaccgggccctaacgtcgggcccgtacccaggcccgtaagggtttccaaggtcgggactagggttcgggtacgtacggggaatacgtaccttaccgacccttcgaccctaaacctcgacgacgtacgaacgtcccggttaagggaccgtaccgtaaggtaactagttaattccggtaaagttaaggtttttaaccttagttacgtaacgtaggacgtacggtacggtaacgtcggttaacgggttccggttccgttttacccggtacccgggttttacccgggggaaaccccgggtaaacgttaaacgggtaaccggtaaaacgtaaccggtaaacggttacggtacggtacggtccgtacgtaaccgaccttcgttacgtccgttacctcgttaccttacccgtacccgtctacgttaccg

SEQ ID NO: 294035 - DNA, 798 bp, Homo sapiens
  misc_feature: GYAE6OF01BWU13.10.88.H11.1.454.CMB.1.raw
  modified_base (197)..(197): a, c, t, g, unknown or other
  misc_feature (197)..(197): n is a, c, g, or t
  modified_base (463)..(463): a, c, t, g, unknown or other
  misc_feature (463)..(463): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagcccaccctgttcctttttcnccgaggggacagacgtccaccctctcctggtacgggcctaggttatgggttgttcggccgtaccttaatttaacgtcggtaaccaaacgtagaaacggtggacccgaggcctacccgaggcctcctcatctaacgagccactacccgaaccgacgggccacgtcggccgtccacggccgtaggttcgagtcgggcgtaggtcgggtacgtgggaactacggtcttaccgacttcgtacacctatcgagccgacgtccgtagggacnccgttaaggaaacgtacttagttacgcgtttaaagtttttaacttacgtttcggtaacgtaacggtccgtaagggtaccgttacgggacgttacggggtttcccggttacccttttaacccggttaccgggtttaccccgggggaaccccgggttaaaacgttaaaacgggttacgggtaaaacccttaccgggtaaaaaaccggttaccggtttacgggtaccgggtaccgttaccggtaaccctaaaccgttaggtttaccccgttacggtttacccctttaacgttaaccccgtttaccccgtttacccccgacccggttaaatttccccgg

SEQ ID NO: 294036 - DNA, 784 bp, Homo sapiens
  misc_feature: GYAE6OF01DGC34.10.88.H11.1.454.CMB.1.raw
  modified_base (200)..(200): a, c, t, g, unknown or other
  misc_feature (200)..(200): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggcctcccgaggtaccaccggagagtattgtgttgacgcagtcgccagcccaccctgttcctttttcnccgaggggacagacgtccaccctctccgtgtacgggcctagttagtggtgttggccgtaccttaagtttaaacgcggtaaccaaacgaaggaaaacggtcggacccgagggtccctacccgaggtccttccctacaacttaccgtaaacgaacgtacctacgtaccccgaaccgaccggggtacccaccgtcgggcccgtaccccgagtcccgtaacgggttcgacgtcgggccgtaggtcggggtcgtacggggactaacggtaccttccaaccgttccaccaacctacgtcgaacggtcctacggtcccgttagggaaccgtcccgtaaggtaaagtacttaagttcggtactttaaggttttaattagttcgtacgagtcgagtccggttacgcgtaagggttcgttaccctttacggtacccggtttacccggggaccccgggtaaactaaagggtaacggtaacgtaaccggtaaaaccgtcggttggtaccggtaccgttaaccggaccctaaccgttacgtttccgttcggttacccttaccgtaccctttaccccgtccccgtactcggttacccg

SEQ ID NO: 294037 - DNA, 875 bp, Homo sapiens
  misc_feature: GYAE6OF01AZOWT.10.88.H11.1.454.CMB.1.raw
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccgaggtaccaccggagagattgtgttgacgcagtcgccagcccaccttgttccttttcnccgaggggacagacgtccaccctntccgtggtacggcctagttagtggtgtcggcgtacttattaacgtggtaccaacgagtaacgtcggcctacggcctacccggagtccctaccgtatactaccgtaacggaacgcctaaccgtcccgaaccggtacggggacccctacggttccgggaccccgtacccgacgggtcccgttagggtttcgacggttccggacgtagggttccgggtacgtacgggactaacggtccttaccacctaccgtaccaacccgtagtacccgaaggccgtaaccggtcccggtagggtaccgtaccggttaacggtaacgttaacgttacggtttacgtaaacggtttaacggtttttaacgtttaacgttttaccgggtacgttaaccggtaccggttaccgggtacggttaccggttaacgggttaccggggtttaccggttccccggttttaccgggtttaacccgggtttacccgggggtaaaccccgggggttaaaccttaaacgggttaacggtaaacccgtaaacccggttaaaccgtaccgggtttacccggtaacggggttaccctaccggttaccccgtaaccggtacttaccccggttattacccgtttacccttaccggttacccgtcccctaacgttcccgtaacc

SEQ ID NO: 294038 - DNA, 776 bp, Homo sapiens
  misc_feature: GYAE6OF01EAZ6V.10.88.H11.1.454.CMB.1.raw
  modified_base (756)..(756): a, c, t, g, unknown or other
  misc_feature (756)..(756): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccaggttcagctggtgcagtcgtggggctggaggtgaagcgcccgtggggcctcgagtagaagactcctccgtggcgaggtctttcgtacggttaacctacctttaaccaccttagtcggtactacgttccgttaccggtggggtcgaccggaaccgaccgggtcccccgttagggaaacgtaacggggttaccgtttaggggagggggttggggggttcggggggttacggggtcgacgggtcccggtaccgtttaaccggtaaggtttcggaccttaaccgaaacgttaaattacgttacgactaaacgtaaggtaaaccggttaccggaacggtaaccgaaggtaacggtaccaacccgtaagttaccggaaccctaacgaacgaacccaacctacgtacccgaacggaacgaccaaccgtaaccgaccctaactaacggttaacggtacgtaggacgggtacgtaccgtaggaacgtacgtcgtacggaaccgtaccgaccggttaccgttattacgttccgtacggtcggacgtaaggacgtaaaggtaggtacggtacggtacggtacgggtacggganagacgtcgacggtaccgggg

SEQ ID NO: 294039 - DNA, 651 bp, Homo sapiens
  misc_feature: GYAE6OF01EVQ3L.10.88.H11.1.454.CMB.1.raw
  modified_base (167)..(167): a, c, t, g, unknown or other
  misc_feature (167)..(167): n is a, c, g, or t
  modified_base (193)..(193): a, c, t, g, unknown or other
  misc_feature (193)..(193): n is a, c, g, or t
  modified_base (259)..(259): a, c, t, g, unknown or other
  misc_feature (259)..(259): n is a, c, g, or t
  modified_base (268)..(268): a, c, t, g, unknown or other
  misc_feature (268)..(268): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacncagtcgcagccaccctgtctttttcnccgaggggacagacgtcaccctctcctgtacgggccagttatggtgttgcgaccttatttaaacgnggtaccaanagaacgtgccagcctccaggctcctcatctacgaagcactaccgaccgaggggccacgtggccgtcccagccgtaggttccgaagtggaccgtaggtggggttctacggggacacggtacttccgacttcgtacaccctataccaaggaccaacggtccgtaggacgtacccgttaggaacgtaattagttgtaccgtaagttttatttacgttagtactagcaacggcgtaacgtcgaaggttcggtacctttcgtaacgttcccggggaccgggtaaccaaacgggtacgaaactacggaaacgtacgttggacggttcgtacgacccgacgtacttcgtacgttccttaccgtacttacccctccgtcccctgttacccg

SEQ ID NO: 294040 - DNA, 794 bp, Homo sapiens
  misc_feature: GYAE6OF01CF6MQ.10.88.H11.1.454.CMB.1.raw
  modified_base (198)..(198): a, c, t, g, unknown or other
  misc_feature (198)..(198): n is a, c, g, or t
  modified_base (694)..(694): a, c, t, g, unknown or other
  misc_feature (694)..(694): n is a, c, g, or t
  modified_base (787)..(787): a, c, t, g, unknown or other
  misc_feature (787)..(787): n is a, c, g, or t
tcagcatagtagtgcacgaccggtgctcgatttagcgacagcgagaacacacaaagggggagaactgctcagttaggacccagagggaaccatggaagccccagctcagcttctcttcctcctgctactctggcctcccaggtaccaccggagagtattgtgttgacgcagtcgccagcccaccttgttctttttccncgagggacagagtccaccctctcctggacggcctagttagtgggtgttcggccgtactttaagtttaaccgacggtaaccaacaaggtaaacggtcggaccacgggtcctacccgacggtccttaccgtacacttaccgtaaccggaacgtccaacctccccgaaaccggacgggcctaaccgtccgggtacccgtacccgacggtaccgtacgggttacggacgttcgggaccgtagggttcggggtcgtaggggaccaaggttaccttccgacctaccgtaccaaccgacgtacacggtacctacggtccggtacgggaaccgtaccgtaaggaacgttaagttaacgttacggtactttaagttttaactttagtttacgtacgtacgtacgtacggtacggtacgtcgttaaccgggtttccgttaccgttttaccgtcccgggtttaacccgggggaaccccggttaaacggtaaacgttaaccggtaaanaaccggtaaaacggtcgttacggtacggtaccgtaaccgaccaacgttagtacctttcggtaccctttacgtacccttcccgtacccgtcctnttaaccg

SEQ ID NO: 294041 - DNA, 657 bp, Homo sapiens
  misc_feature: GYAE6OF01EGQ0L.10.88.H11.1.454.CMB.1.raw
  modified_base (283)..(283): a, c, t, g, unknown or other
  misc_feature (283)..(283): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggtcttcgtgttacacctttaacacctatggcatctccgtgggtncgacacggcccctggacaaggcttggaggtggggtggggtggtcagcgtcttaacaggttgactaacgactaaagttatgactaacgaaggtaacttccgaaggtacaaggactccgaacctagtcgaaccacgacgaacaacactaccaacgacgacaacgaccgtacctaacgatacggtaacgtggaaggacgtaccgagaacggtactacgtacgaacgaaccgtacgggtaccgttagttacgttcgtacggtaccggacggtaacggtaaacggtaaacgggttaaaacggtcgggtaaacgggttacgggttaacgggttacccggggggaaactaacggtaacgtacggaacccgtaacccggggg

SEQ ID NO: 294042 - DNA, 741 bp, Homo sapiens
  misc_feature: GYAE6OF01D2PWW.10.88.H11.1.454.CMB.1.raw
  modified_base (409)..(409): a, c, t, g, unknown or other
  misc_feature (409)..(409): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
tcagcatagtagtgcacgaccggtgctcgatttagcgacagcgagaacacacgaaagggggaggaactgctcagttaggacccagagggaaccatggaacgccccagctcagcttctcttcctcctgctctcgtcggcctcccgacgggtacccaccgggagaggtagtttcggtggttacggaccgcgtacgtccgcccgaccgcccctaacccgttcgtttcctttttaccgccggacggggactacggtacgtcccaccctccttaccgtggtacggccttaggttcgtcgggttcgttgggacccttacttaacgttaaacgtcggttaaacccaagaacggtaaccgtcgggaccaccgggtcctacccggtaggtccctctaccgtactctcggttggtcctntaccgttcgtacggacggtccctagtacggtccctcgtacggttacgaggttcngggtcgngtcggttcggtagtacgaagtacggtcttacaccgttccaacgtaccgattcggaccggtcctaggtcgtacgtcgtacgtagtagttagtttcgtagtttagtttaacctcgtagtacgtagtataacgttatagtacgttcgtttaggtttccttaacgttccgttacggtaccgttaagtacgtaagtcgtacgtgtaacgtcgtaacgtggtacctgtaccctacgtacgtctaccgttacgtcctagttacccttccgccctaccg

SEQ ID NO: 294043 - DNA, 700 bp, Homo sapiens
  misc_feature: GYAE6OF01AS1T8.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagcgcccgtggggcctcaggtgaagtacttcctcgtggcgaggtctttcgtaggttacctaccgtttaacacctagtcggcatccgtcgtggggtgccgacgcggcccctaggaccaggtacgtggaggtggggtgggtggtcaggccgtctaaccgtagtcgactaacacgtaaattcgtagacaacgtaagaacgttaccgaaggaacacgtaagtcccgaacgtacgtacggaaccaacgacgaacaccgtaaccgtaccgaacgaacgtaccaacgacgtacctacgtaacggtacgaacgtagggaacgacgtaccggtagtaacgcgtacgtaaccgacggtaaccgtacggtaccgtaagtttacgttcggtaccgacggtacggaacggtaacgttaaacggtaaacgggtcgggtaacgggtttaccggggaacggggtttaccccgggaagtaaccgtaccgtaagggacccgtaacccgggg

SEQ ID NO: 294044 - DNA, 710 bp, Homo sapiens
  misc_feature: GYAE6OF01BI23Y.10.88.H11.1.454.CMB.1.raw
  modified_base (249)..(249): a, c, t, g, unknown or other
  misc_feature (249)..(249): n is a, c, g, or t
  modified_base (281)..(281): a, c, t, g, unknown or other
  misc_feature (281)..(281): n is a, c, g, or t
  modified_base (488)..(488): a, c, t, g, unknown or other
  misc_feature (488)..(488): n is a, c, g, or t
  modified_base (534)..(534): a, c, t, g, unknown or other
  misc_feature (534)..(534): n is a, c, g, or t
  modified_base (669)..(669): a, c, t, g, unknown or other
  misc_feature (669)..(669): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagacaacgaggtcgcccactcccgtaggttcacgcgtggtgcagtcgtggggctggaggtagaagacgccggtcggggcctcgagtgagtctctcgngcgtagtcttgtacgtacctaactacactagngactctccgtcggtggcgacgacgacccggtccgtaggaacgtaaggttcgtgggtaggggttgggggtcggggtacgtacggacggtaccgttaacgttaacggtaggtacgtaacctaacgtaaacgttaatcgtacgaacgaagtaacggtacgtacgaagtaacgagtacgactacgtacgacgaaccgaacgaccgaactanacccgtaacgacgaacaccagaccgtacctaagtaggacgtaacgnggtacacgtacgagtagtcctagaacggaccgtaaccggtacgttaccgttattcgtccggagtaccgggaaagtacgggtaaacggtaaacgttaaggtcgggttaacggtttaacgggggtaacccggggtanaaacccttagggtacggtaacccggtccggtaacccggggg

SEQ ID NO: 294045 - DNA, 838 bp, Homo sapiens
  misc_feature: GYAE6OF01AO3M4.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttctggtggcagcagcaacaggtcgcccactcccaggttcagtctggtcgcagtcgtggggctgaggtgaagcgccgtggggcctcgagtgaagactcctccgtggcgaggtctttcgtggttaactaccttaacacctagtcggctacttcgtccggtgggtcgacggtacgacggtccccgtagggaacgtaacgggtacgttcgggtaggttcgggggtgggggtcgggttaccgaagggtccgtaccgtttaaccggtaaggttcgggactaaccgtaacgttaaacttagtaccgactaacgaaacggtaacgttaccggaacggaacgtaacggtacgtaccgtaaccagtaccggaacccaacgaaccggtaaccaacgtacctacccaaccggaacgccaaaccgaacctacccctaaagtacgggtaacgggtaaccgtacgggaacgggaacgtcccggtaacggaacggtaacctccggtaaccggtaaccggtaaccgggttaacccgggtcccggtttaaatttcccgtttaccggtcgggtaaccggtaaaccgggtaaaggtaaaccgggttaaacgggttaaaacggtaccggggtttacgggggttaaacggggttacccgggggtaacccgggggaaacgtaaacgttacccgggttaacggaacccgggttaacccgggggg

SEQ ID NO: 294046 - DNA, 864 bp, Homo sapiens
  misc_feature: GYAE6OF01BX7GF.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagctattcctttttcttgggtggcagcagacaacaggtcgccccactcccaggttcagcgtggtgcaggtcgtggggctgaggtagaagcggcccgtgggcctcgagtagaagacttcctcccgtgccggtaggtctttcgtacggttacctaacctttaacacctagtcgctactcgtccgtgggtcacgacgaccggcccctaggaacgtaaggtcgttaggtaggggttgggggtcgggggtcggtaccgaggtaccgttaaccgtttaaccggtaagggtttccggaaccttaaccgtaaaacttaaacgtttagccgtaaccgaacgtaaacggtaacggttaaccgaaggaacctaacgggaaccgttacccgaaacctacgtacccgaaacccgaacaacggtaaaccctaactaccccgtaaccgaaccggaacaaccgaaccgtaaaccggttacccgtaaacgtacggttaaaccgggtaacgttacggggaacggttaccggtaaccgtacgggtaacgtaccgtttaccggaaccggttaaccggaacccggttaacccgggttaaccttaagtttcgtttaccggtaccggtaacgtaaccggtaaaggtaaacgggttaaacgggttaaaacgggttcccgggtaaacggtttacgggggttaaccgggtaccgggggaacccttaagtaacccggtaaccggtacccggtaaacccggggg

SEQ ID NO: 294047 - DNA, 603 bp, Homo sapiens
  misc_feature: GYAE6OF01EX1KL.10.88.H11.1.454.CMB.1.raw
  modified_base (130)..(130): a, c, t, g, unknown or other
  misc_feature (130)..(130): n is a, c, g, or t
  modified_base (304)..(304): a, c, t, g, unknown or other
  misc_feature (304)..(304): n is a, c, g, or t
  modified_base (514)..(514): a, c, t, g, unknown or other
  misc_feature (514)..(514): n is a, c, g, or t
  modified_base (543)..(543): a, c, t, g, unknown or other
  misc_feature (543)..(543): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggancattccttttcttggtgcagcagcaacaggtcgacccactcccgaggttcagctggtagctagtcgtggggactggaggtgaacgtcggacccgtggggccctgaggtcgaagctcgtacctgcgaggtctttcgtacggttactaaccttttaacaccttagtcgccattccnccgtggtgcgacgacggtaccccgacgacgacgtacgagttgggtgggtgggtcgggtggtcgtacgtaccgtacgttacgacgtacgactaactactaagtactacgacgacgtacgaacgtacgacgacgacgacgtacgacactacgacacacgacacacgtacgacacacactaacgactacgactaggaacgtacgacgacgcanagacgtacgacgacgacgtacgtacgttntgtcgagacgacgagaagtacgtacgtagtacggtacggtacgacggacgtacgacgtcg

SEQ ID NO: 294048 - DNA, 176 bp, Homo sapiens
  misc_feature: GYAE6OF02H17I7.10.88.H11.1.454.CMB.1.raw
  modified_base (175)..(176): a, c, t, g, unknown or other
  misc_feature (175)..(176): n is a, c, g, or t
tcagcatagtagtgcacgaccggtgctcgatttagcgacagcgagaacacacaaaggcccatcggtcttccctggcaccctcctccaagagcacctctgggcacagcggccctgggctgcctggtcaaggactacttcccactactatgctgagcgggctggcaaggcgcatagnn

SEQ ID NO: 294049 - DNA, 511 bp, Homo sapiens
  misc_feature: GYAE6OF02IO8YX.10.88.H11.1.454.CMB.1.raw
  modified_base (389)..(389): a, c, t, g, unknown or other
  misc_feature (389)..(389): n is a, c, g, or t
  modified_base (509)..(509): a, c, t, g, unknown or other
  misc_feature (509)..(509): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggancctgaagatattgctagtttattattgtcagcagcgtagcaggtgcctttcacgtttcggcccgggtacaaagtggaaatcaaacgactgtggctgcacatctgtcttcatctcccgccntc

SEQ ID NO: 294050 - DNA, 511 bp, Homo sapiens
  misc_feature: GYAE6OF02G40R1.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaaggacagagtcaccatgaccacagacacatccacgagcacagcctacatggaactgaggagcctgagatctgacgacacggcctatattctgcgcgagagaacgtaaagtgacgtggtacgtcggggacacgatgacgtaccgg

SEQ ID NO: 294051 - DNA, 512 bp, Homo sapiens
  misc_feature: GYAE6OF02H19VK.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtgggtggtcagcgcttaccaagttggctacacaaattatgcacagaagttccaaggacagagtcaccatcgaccacagacacatccacgagcacagcctacatagaactgaggagcctgagatctagacgacgacggcgtatatttctgcgcgagagacgtaaaggtgacgtggtagttccggggacacgatcgacacgg

SEQ ID NO: 294052 - DNA, 593 bp, Homo sapiens
  misc_feature: GYAE6OF02IYJOV.10.88.H11.1.454.CMB.1.raw
  modified_base (367)..(367): a, c, t, g, unknown or other
  misc_feature (367)..(367): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggcctagttatggtgttggcgtcctatttaaactggtaccaacagaaacgtggccaggctcccaggctcctcatctacgaagcactccaccagggccactggcgtcccagccaggttcgatggcagtggtctgggacagacttnactctcaccatcagcagcctggagcctagaacgatattgctagtttattattgtcagcagcgtagcgtagggtcggtcctttaccgtacgtttccggggacccgggtaccggggggtaaacttagggtaaacgttaccgaaacgtaaccgttagtacggtacgttaaccgaaccgtataccgttcgttcctttactacgttccttcccgtacctacttccttacgg

SEQ ID NO: 294053 - DNA, 590 bp, Homo sapiens
  misc_feature: GYAE6OF02JAY4B.10.88.H11.1.454.CMB.1.raw
  modified_base (313)..(313): a, c, t, g, unknown or other
  misc_feature (313)..(313): n is a, c, g, or t
  modified_base (389)..(389): a, c, t, g, unknown or other
  misc_feature (389)..(389): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggcctcccaggctcctcatctacgaagcatccaccnggccactggccgtcccagccaggttcgatggcagtggtctgggacagcttcactctcaccatcacgcagcctgganccctgaagatagttgctagtttattagttgtcagtcagtcgtaagcgtagggtcgtcctttccgtaccgttttccgggacccggggtaacctaaaggtacggtaaacttacgaaaccgtaacgtacggtaggtaccgtgacccacccgtaagtccgttagttccttacgtacttcccgtttaccccgtcctaacttcccgg

SEQ ID NO: 294054 - DNA, 552 bp, Homo sapiens
  misc_feature: GYAE6OF02H5RO2.10.88.H11.1.454.CMB.1.raw
  modified_base (242)..(242): a, c, t, g, unknown or other
  misc_feature (242)..(242): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtaggccagttatggtgttggcncctatttaaactggtaccaacagaaacgtggccaggctcccaggcctctcatcacgaagcatccacaggccactggctccagccaggttcgatggcagtggtctgggacagattcactctcacactcagcagccgtgacgcctgaagatattgctagtttattattgttcagcagcgtagcaggtgtcctttcacgtttccgggcccggggaccaaaggtacggtaaactacgtaaacgtaacgtagttaggcgtcggaccactattcctagttacgttcctacttaccttccccggtacctacgtaccg

SEQ ID NO: 294055 - DNA, 519 bp, Homo sapiens
  misc_feature: GYAE6OF02I32WF.10.88.H11.1.454.CMB.1.raw
  modified_base (366)..(366): a, c, t, g, unknown or other
  misc_feature (366)..(366): n is a, c, g, or t
tcagcatagtagtgcacgaccggtgctcgatttagcgacagcgagaacacacaaagggggaggaactgctcagttaggacccagagggaaccatggaagccccagctcagcttctcttcctcccgctactctggctcccaggtaccaccggagagattgtgttgacgcagtcgccagccaccctgtctttttctccaggggacagagtcaccctctcctgtagggccagttatggtgttggcgcctatttaaacctggtaccaacagaaacgtggccaggctccaggctcctcatctacgagcatcccacaggccactggccgtcccagccaggttcgatggcaggtggctggacagcttcactcncacatccagcagcctggacgcctagaagatatgctagtttattattgtctagcagcgtagcaggtgctttcacgtttcggccggaccaagtagaaatcaaacgatagtgctgcacctatctgtacttcacgttccttaccgcctactcgtacg

SEQ ID NO: 294056 - DNA, 504 bp, Homo sapiens
  misc_feature: GYAE6OF02I3VZZ.10.88.H11.1.454.CMB.1.raw
  modified_base (435)..(435): a, c, t, g, unknown or other
  misc_feature (435)..(435): n is a, c, g, or t
  modified_base (462)..(462): a, c, t, g, unknown or other
  misc_feature (462)..(462): n is a, c, g, or t
  modified_base (492)..(492): a, c, t, g, unknown or other
  misc_feature (492)..(492): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgaggtgggtggggtgggtcagcgcttacagttggctacacaaattatgcacagaagttcaggacagatcacatgaccacagacacatccacgagcacacgcctacatcgaactgacggagcctgagatcngacgacgacgctatattctgcgcgagngaacgtaaagtgagtggtacgtccgggganagatgactacgg

SEQ ID NO: 294057 - DNA, 598 bp, Homo sapiens
  misc_feature: GYAE6OF02I99K2.10.88.H11.1.454.CMB.1.raw
  modified_base (292)..(292): a, c, t, g, unknown or other
  misc_feature (292)..(292): n is a, c, g, or t
  modified_base (374)..(374): a, c, t, g, unknown or other
  misc_feature (374)..(374): n is a, c, g, or t
  modified_base (390)..(390): a, c, t, g, unknown or other
  misc_feature (390)..(390): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctccaggctcctnatctacgagcatccaccagggccacgtggccgtcccagccaggttcgagtggcaggtggctgggacagcttcactctcaccntcagcagcctaggacnccgtagaagtattattgacttaggtttattagttgtcagtcagtcgtagcgtagggttcggtcccttttcgaccgtttccggggacccggggtaactaaagggttacggtaaacgtaccgaaaacggtactggttacggtaccgtggacctaacccgtagttccttcgttccttcgtaccgttcccgttccccggtactacgttaccg

SEQ ID NO: 294058 - DNA, 712 bp, Homo sapiens
  misc_feature: GYAE6OF02I2IEI.10.88.H11.1.454.CMB.1.raw
  modified_base (226)..(226): a, c, t, g, unknown or other
  misc_feature (226)..(226): n is a, c, g, or t
  modified_base (237)..(237): a, c, t, g, unknown or other
  misc_feature (237)..(237): n is a, c, g, or t
  modified_base (258)..(258): a, c, t, g, unknown or other
  misc_feature (258)..(258): n is a, c, g, or t
  modified_base (634)..(634): a, c, t, g, unknown or other
  misc_feature (634)..(634): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttctccagggacagagtcacctctcctgtacgggtcngtatggtgtgngtacctagttaacctggtacnaacagaacgtaggcgacgacgccacgcgtacctctactacgtacgaacgacactaccgaccacggaccgaccgtcgacgtcccgacgtaccgacgttacggtacgtacggtcgacgtgggtacgtacggtacgtacgacgttctactacgtactaccacgtacgacgacgacgaccgtacggtacgtaccgtacgtaagtagtaacgttacgttacgtaacgtttaagtttaacgttacgttacgtaacggtaccagggtaccgtaacggtacagggttacgggtacccgttttaccgtaaccgttttccgggttacccctagggggtaacccgtaaaacgggttaccgggtaaaaacgttaccgtaaacgtaaancctaacggttacgggtaccgttacggtaccgtaacccgtaacgttacccgttacggttccgtttaccgtacgttaccg

SEQ ID NO: 294059 - DNA, 678 bp, Homo sapiens
  misc_feature: GYAE6OF02JMF4M.10.88.H11.1.454.CMB.1.raw
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccgaggggacagagtccaccctctcctgtacgggcctagttatggtgttgggcgtccttaatttaaacgtggtaaccaacagaaacgtgaccaggcctcccaggcctacctcatctacgaagcactccaccagggccacgtcggccgtcccaggccagggttcagtcggctaggtggtctgggacagtacttcactctcactatcagcacgtccgtgggacgtacctaggaaacgtataacgttgaccgttagtttaatttacgttacgtacgtaaggtaccgtaaggtccgtagtaccgtagggttacggtcccgttttacgacccggttttacccggggaccccgggggttaacctaaaggggtaccggtaaaaacttaccgggaaaaccgttaacgtgggttaccgtcggtaacggtaccaaccgtaacgtcgtttagttccctttcaaccgtttcccgtttaccccgacttagttacccg

SEQ ID NO: 294060 - DNA, 602 bp, Homo sapiens
  misc_feature: GYAE6OF02JSRF8.10.88.H11.1.454.CMB.1.raw
  modified_base (234)..(234): a, c, t, g, unknown or other
  misc_feature (234)..(234): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttctccagggacagagtcaccctctcctgtagggccagttagttnggtgttggcgctattaactgtaccaacagaacgtgcagctccgacgctcctcatactacgaacgacactccaccgacggccacgtcggccgtcccgacgccgaggttcgtagtggcgtacggtcgggtcgtacgggacgacgtacgttctactctacaccactacgacgacacgccgtacggacgacgtagaagtatagttagtacgttagtttaagttagttgttacgtactaagtagttaggttaggtacgtacgtacggttacgtttacggtacgtacggacgtaacgtcgtaggagtagtacgaacgtaacgtaggtggtacgtacgactactactcgtcgtacttactacttccgtcccgtcc

SEQ ID NO: 294061 - DNA, 588 bp, Homo sapiens
  misc_feature: GYAE6OF02FG7HU.10.88.H11.1.454.CMB.1.raw
  modified_base (194)..(194): a, c, t, g, unknown or other
  misc_feature (194)..(194): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctaatttaaactggtaccaacagaaacgtggccaggctccaggctcctcatctacgaagcatccaccagggccactggccgtcccagccaggttcgagtggcaggtggtctgggacagacttcactctcaccatcagcagcctggacgcctagaagatattgactagtttatattgtacagcagcgtagcgtaggtcgtcctttcgaccgtttccgggacccggggtaactaaaggtcggtaaaactccgaaaacgtaccgtaggtcggacgttcggacctaaccgtacgttaccgtacgttactttccgtaacctttcccgttaccccgtactacgttacccg

SEQ ID NO: 294062 - DNA, 528 bp, Homo sapiens
  misc_feature: GYAE6OF02I0PIM.10.88.H11.1.454.CMB.1.raw
  modified_base (472)..(472): a, c, t, g, unknown or other
  misc_feature (472)..(472): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttggagtggggtggggtggtcaggcgcttacaaggttggactacactaaattatgcacagtaagttccaggacagagtcaaccatcgacacagacacataccacgagcacacgcctacatagaactgagagcgtgagatctagacgacgacgtccgtattattctgcgngagagacgtaaagtgtacggtggtacggttaccggggacacgagtacgacgtacgg

SEQ ID NO: 294063 - DNA, 641 bp, Homo sapiens
  misc_feature: GYAE6OF02HJ9WD.10.88.H11.1.454.CMB.1.raw
  modified_base (197)..(197): a, c, t, g, unknown or other
  misc_feature (197)..(197): n is a, c, g, or t
  modified_base (274)..(274): a, c, t, g, unknown or other
  misc_feature (274)..(274): n is a, c, g, or t
  modified_base (319)..(319): a, c, t, g, unknown or other
  misc_feature (319)..(319): n is a, c, g, or t
  modified_base (417)..(417): a, c, t, g, unknown or other
  misc_feature (417)..(417): n is a, c, g, or t
  modified_base (444)..(444): a, c, t, g, unknown or other
  misc_feature (444)..(444): n is a, c, g, or t
tcagcatagtagtgcacgaccggtgctcgatttagcgacagcgagaaacacacaaagggggaggaactgctcagttaggacccagagggaaccatggaagccccagctcagcttctcttcctcctgctactctggctcccaggtaccaccggagagattgtgttgacgcagtcgccagcccaccctgttctttttcnccgaggggacagagtccacccttctccgtggtacgggcctagtttatgggtgttcggccgtccttaattttaaacgnggtaaccaactaagaaacgtggccaggcctacccgagcctcctanactcctaacgaagccatcccgaccgacgggcccacgtcggcctcccagcccgtagggttcagtggctagggtcggtctgggacagtacctcacgtccncaactatcacgcgacgccgtagggacnccgtaagaagtattatgtacttagtttaacttattgtacaagcgtagtacgtacgacgtagggtcttcctttacgtaccggtttcccgggaacccgggtaacttaaagggtacggtaaactaaccgtaaacgtactcgggtagaccgtagacctacgtattcctgttcctacgtaccttccgtacccgactagttcg

SEQ ID NO: 294064 - DNA, 543 bp, Homo sapiens
  misc_feature: GYAE6OF02GWV7T.10.88.H11.1.454.CMB.1.raw
  modified_base (536)..(536): a, c, t, g, unknown or other
  misc_feature (536)..(536): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcaggtgggtctgggacagacttcactctcaccatcagcagcctggacgcctagaagatattgctagtttattattgtcagcagcgtagcgaggtcgtcctttcgtacgtttccgggcccgggtaacctaaaggtacggaaactacgaaacgtacgtgtcggctgacacctatctgtcttctacttccgtcccncctatcc

SEQ ID NO: 294065 - DNA, 517 bp, Homo sapiens
  misc_feature: GYAE6OF02JJLIA.10.88.H11.1.454.CMB.1.raw
  modified_base (352)..(352): a, c, t, g, unknown or other
  misc_feature (352)..(352): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtggtcagcgcttaccaagttggctacacaaattangcacagaagttccaggacagagtcacatgaccacagacacatccacgagcacacgcctacatggaactgaggagcctgagatctagacgacgacggccgtattattctgcgcgaggagaacgtaaagtgacgtggtacgtccggggacacgagtagacgtaccgg

SEQ ID NO: 294066 - DNA, 619 bp, Homo sapiens
  misc_feature: GYAE6OF02FGFVR.10.88.H11.1.454.CMB.1.raw
  modified_base (352)..(352): a, c, t, g, unknown or other
  misc_feature (352)..(352): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacacggcccctggacaggacttgagtgggtgggtggtcagcgcttaccgaagttggctacacaaattangcacagaagttccaggacagcgtcacatcgaccacagacacactccacgacgcaaccacgacctaacacgtacggaacgtaggacggaacgccgtaggaacgacgttactacggaaccggaccgaaccgggtacccgttaacttactttaccgtcgtacggacggaacggtaacggtaaaccggttaaaacggttacggtaacggttagggttacgggtttacccggggggaacctaaccggtacgttacggtacccgtaacccggg

SEQ ID NO: 294067 - DNA, 524 bp, Homo sapiens
  misc_feature: GYAE6OF02FUNT7.10.88.H11.1.454.CMB.1.raw
  modified_base (418)..(418): a, c, t, g, unknown or other
  misc_feature (418)..(418): n is a, c, g, or t
  modified_base (518)..(518): a, c, t, g, unknown or other
  misc_feature (518)..(518): n is a, c, g, or t
  modified_base (521)..(521): a, c, t, g, unknown or other
  misc_feature (521)..(521): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcaggtgggtctgggacagacttcactctcaccatcagcagcctggacgcctgaagatattgctagtttattattntcagcagcgtagcgaggtcgtcctttctccgtttcggacccggggtacaaagtgaaactcgaaacgactggtacgctgcaccatctgtctcatcctcccnctntcc

SEQ ID NO: 294068 - DNA, 533 bp, Homo sapiens
  misc_feature: GYAE6OF02IUUXF.10.88.H11.1.454.CMB.1.raw
  modified_base (345)..(345): a, c, t, g, unknown or other
  misc_feature (345)..(345): n is a, c, g, or t
  modified_base (347)..(347): a, c, t, g, unknown or other
  misc_feature (347)..(347): n is a, c, g, or t
  modified_base (353)..(353): a, c, t, g, unknown or other
  misc_feature (353)..(353): n is a, c, g, or t
  modified_base (473)..(473): a, c, t, g, unknown or other
  misc_feature (473)..(473): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttggagtggggtggggtgggtcagcgcttacaagttggctananaaattngcacagaagttcaggacagagtcaccatgaccacagacacactccacgacgacacacgacctacagtaggaactgaggagccgtagagagtcgtcgacgacgacggccgtattacttcgngcgcgaggagaacgtaagtgacggtaggtacggttccggggacacgagtacgactaccgg

SEQ ID NO: 294069 - DNA, 586 bp, Homo sapiens
  misc_feature: GYAE6OF02IGI2X.10.88.H11.1.454.CMB.1.raw
  modified_base (256)..(256): a, c, t, g, unknown or other
  misc_feature (256)..(256): n is a, c, g, or t
  modified_base (421)..(421): a, c, t, g, unknown or other
  misc_feature (421)..(421): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccagagagattgtgttgacgcagtcgccagccaccctgtctttttctccaggggacagagtcaccctctcctgtagggccagttatggtgttggcgccttatttaaacnggtaccaacagaaacgtggccaggctccagctctcatctacgagcatccaccagggccacgtggccgtcccagccaggttcatggcagtggtctgggacagcttcactctcaccatcagcagcctggacgcctgaagtatagttgctagtttattattgttcagnagcgtagcgtagggtcgtcctttcgtacgttttccgggacccggggtaaacctaaaggtacggaaaacttaccgaaacgtacgttaggtacggtcgtacggacctaacccgtagttaccgttcggttacctttaccgtaactttcccgttcccccgaccttaccg

SEQ ID NO: 294070 - DNA, 685 bp, Homo sapiens
  misc_feature: GYAE6OF02J28TY.10.88.H11.1.454.CMB.1.raw
  modified_base (195)..(195): a, c, t, g, unknown or other
  misc_feature (195)..(195): n is a, c, g, or t
  modified_base (328)..(328): a, c, t, g, unknown or other
  misc_feature (328)..(328): n is a, c, g, or t
  modified_base (613)..(613): a, c, t, g, unknown or other
  misc_feature (613)..(613): n is a, c, g, or t
  modified_base (622)..(622): a, c, t, g, unknown or other
  misc_feature (622)..(622): n is a, c, g, or t
tcagcatagtagtgcacgaccggtgctcgatttagcgacagcgagaacacacaaaggggaggaactgctcagttaggacccagagggaaccatggaagcccagctcagctctcttcctcctgctactctggctcccaggtaccaccggagacgattgtgttcgacgcagtcgccacgccaccctgtcctttttcnccgtagggacagacgtcacccttctcctgtacgggccagttactggtcgttcggctccgttatttaacgtcggtaaccaacgagaaaccgtcggaccacggcctccgaggcctcctacacgtcctacggaacncaactccaccgacggtccacgtcggcctccacgccgtacggttcgacgttcggccagggttcgggtctcggggtacaggtaccttcgtacctctaccacgatccgacgtaccgcgtccgtggacgtccctagtacgtaagttcttacgacgtttatttaacgtattcgatacggtcgaaggtcctaggtcgtaacggttcgtccttttaccgtaccggtttccgggaacccgggtaacgttaaacggtaacgtaaacgtaacgaaccgtacggtctaccgggtcnccgtaaccnctaaccgttacgttccggttacccttcgaccgttttaccccgccggttacccttgttaacccg

SEQ ID NO: 294071 - DNA, 629 bp, Homo sapiens
  misc_feature: GYAE6OF02IEJQ3.10.88.H11.1.454.CMB.1.raw
  modified_base (195)..(195): a, c, t, g, unknown or other
  misc_feature (195)..(195): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (378)..(378): a, c, t, g, unknown or other
  misc_feature (378)..(378): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggcctcccaggtaccaccggagagattgtgttgacgcagtcgccagccaccctgtctttttcnccgaggggacagagtcaccctctcctggtaggccagttanggtgttggcnccttatttaaacnggtaaccaacagaaacgtggccaggctcccaggctcctcactctacgaagcatccaccagggtccactcggcctccacgcctaggttcgatcggacagtgggtctgggacacgtacttcnctcgtcactatcagcagccgtaggacgtcctagaacgtataagtgactaaggttttatattgactaggcagtcgtagcacgggtcggtcctttcgtaccgttttccggggaccccggggtaacctaaagggttcggtaaaacgttaaccgaaaccgtaacgttcggtacgggtccttacggacctaaccacgtttacccgttacgtttccgttacctactttccggttccccccggtacctactttaccgg

SEQ ID NO: 294072 - DNA, 610 bp, Homo sapiens
  misc_feature: GYAE6OF02GBR33.10.88.H11.1.454.CMB.1.raw
  modified_base (195)..(195): a, c, t, g, unknown or other
  misc_feature (195)..(195): n is a, c, g, or t
  modified_base (422)..(422): a, c, t, g, unknown or other
  misc_feature (422)..(422): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttcnccaggggacagagtcaccctctcctgtacgggccagttatggtgttggcgtccttaattttaaactggtaaccaacagaaacgtggccaggcctcccgaggcctcctcatctacgagcatcccacgagggcccagtcgggcctcccagccgtaggttccagtggctaggtgggtctggggacagtacttcactctcaccatcagccacgccgtggactcctagaagnttagttcgacttagtttattactgtacagctagtcgtagcgtagggtcgttcctttacgtacgtttcccgggacccgggtaactaagggtacgaaactaacgaaacgtacgtggtacgaccgtcggacctacctagttaccgttcgttacctttcaccgtttcccgttaccccgtactacgttacccg

SEQ ID NO: 294073 - DNA, 815 bp, Homo sapiens
  misc_feature: GYAE6OF02JND3K.10.88.H11.1.454.CMB.1.raw
  modified_base (194)..(194): a, c, t, g, unknown or other
  misc_feature (194)..(194): n is a, c, g, or t
tcagcatagtagtgcacgaccggtgctcgatttagcgacagcgagaacacacaaaggggaggaactgctcagttaggacccagagggaaccatggaagcccagctcagcttctcttcctcctgctactctggctcccaggtaccaccggagagattgtgttgacgcagtcgccagccaccctcgttctttttcncctaggggaccagacgtcaccctctcctgtcggcctagttacgttggtcgttcggcgtccgttaatttaaacgtcggtaaccaaactaggaaacgttggaccaggtccctccgaacgggccttcccgtcacttacctaacggaacgcgactacccaaccgacgggtccaccgtcggtccgtacccacggtcccgtaagggtttccgacgttcggacgtacgggttcgggtcgtacggggacaacgggaccttttacaacgttccgtaccacctaacgttacacggtccgaaccgtccgtaggggaccgtccgttaggaaagtacttaacgtttacggcttaaacggtttttaagtacttttacggtcaacggtccaagggtttccaagggtcacggggtttcgtccctttaccgttaccgggttacccggggggttaccccggggaaaccttttaaaacggggccggttaaaaacgtaaccccgtaaaaaggggtacccgtttaggggtcccggtttaacccgacgggttacccctaaaccggtaccgtttccgttcggttttaaccctcggttaccccttttaccccgggtttccccggaacctttcggtttaacccccg

SEQ ID NO: 294074 - DNA, 583 bp, Homo sapiens
  misc_feature: GYAE6OF02H4SHT.10.88.H11.1.454.CMB.1.raw
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
  modified_base (445)..(445): a, c, t, g, unknown or other
  misc_feature (445)..(445): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgtcctaatttaaactggtaccaacagaaacgtggccaggctccccgaggcctcctcatctacgaacgcactcccaccgagggccacgtcggcctcccgagccaggttcgagtggcgtaggtgggtctgggacagaccttcactcncacatccagacagcctggagtccgtagaagtatattgctaggttagtacttagtcgtnagtcagttagtcggtccgccccggtggctacgtacgggttcgggcggaggtaccgtaaaggttgaacgatacgaaacgtgtacggtggactcggacctaccgtactacgttcgttaccttaactccttcccgttcccg

SEQ ID NO: 294075 - DNA, 747 bp, Homo sapiens
  misc_feature: GYAE6OF02GUTAB.10.88.H11.1.454.CMB.1.raw
  modified_base (195)..(195): a, c, t, g, unknown or other
  misc_feature (195)..(195): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttcnccgaggggacagacgtccaccctctccgtgtacgggcctagttagtggtgttggcgtccttaatttaaacgtggtaaccaacgagtaaacgtggccaggctcccgaggcctcctcactctaacgaacgcactccaaccgacgggcccacgtcggccgtaccccaggcccagggttccagtcggcgtagggttcgggtcgtaggggaacctaggtacctttccaccgttccacccgtaaccgtaataccgaacggtccgaaccggtacccgtaaggaaccgtcccggtaaggtaaacggtttacgtttttcgggtaaccggtttttacttaacggttcgtaccgtagtaccgtaggtccggttacggaccctacggtcggtacccgttcgggttcccgtttcccggttaccgggcccgttagggaaccctaaggtcggtaacttaaccgtaaccgtaaaaccggtcgttcggtacgggtcctacggacccgtaaccttacgttcgttaccgtttccttacgtacccgttttcccgttacccccggattaaccg

SEQ ID NO: 294076 - DNA, 827 bp, Homo sapiens
  misc_feature: GYAE6OF02HLZ1R.10.88.H11.1.454.CMB.1.raw
  modified_base (193)..(193): a, c, t, g, unknown or other
  misc_feature (193)..(193): n is a, c, g, or t
  modified_base (205)..(205): a, c, t, g, unknown or other
  misc_feature (205)..(205): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcttttcnccgaggggaaangccaccctctcctgcagggccagtcagagttcgtttccccgcttacgttagccttgggtaacccaaacagaacgcctgggacccagggcctcccgagggtcctccctcaattgtatggatgaccatcccgaacgcgggccaacgtcgggacctactccccaggtacccgtagggtttcaagggttcgggaccgtagggttcggggttctagggacccgtaacgtaacggtaaccctttcccgaacccgtttcccttaacccgaaccccttaacttaacccgaaaacccgtaccggttaacccccttaaacgggtaaaccccttagggttaaaacgtttaccgtttttaccggaaccttttaacctttttttaacgttttccccgtttaacggtttaccctaaacccggtaaggttaccggttaccccggtaacttaaacccgggttccgggtacccccgtttaccccgggttaaccgggtttcccggggaacccggtaacggggggtaaacccggtaaaggggttaccgggaaggtaccgtaccggaacgggtaacgtaaccggttggtaccggtccggtacgaccctacgtacgtttacgtcgtttacctacgttaacccg

SEQ ID NO: 294077 - DNA, 561 bp, Homo sapiens
  misc_feature: GYAE6OF02IQJFD.10.88.H11.1.454.CMB.1.raw
  modified_base (433)..(433): a, c, t, g, unknown or other
  misc_feature (433)..(433): n is a, c, g, or t
  modified_base (526)..(526): a, c, t, g, unknown or other
  misc_feature (526)..(526): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatcacgaagcatccaccagggccacgtggccgtcccagccaggttcgagtcggcaggtggtctggggacagacttcgactctcacatcagcagccctaggacgccgtagaagtatattgtactagtttattattgtcagnaggctagcgagtcggtcctttcgtaccgtttcggacccgggtaacaaaggtacggaaataaccgaaacgaagttcgtggccgtgaaccacgtntacgtgttacttctactcccgttacccgctatacc

SEQ ID NO: 294078 - DNA, 710 bp, Homo sapiens
  misc_feature: GYAE6OF02JJMS3.10.88.H11.1.454.CMB.1.raw
  modified_base (195)..(195): a, c, t, g, unknown or other
  misc_feature (195)..(195): n is a, c, g, or t
  modified_base (505)..(505): a, c, t, g, unknown or other
  misc_feature (505)..(505): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggcctcccaggtaccaccggagagattgtgttgacgcagtcgccagccacctgttctttttcnccgagggacagacgtcaccctctcctgtagggcctagttagtggttgttggccgtccttaattaaacgtgggtaaccaactaagaaacggtggaccgaggcctcccgaggcctcctacattaccgacgaacgccaactcccgaaccgacgggccctacgtcggccgtaccccagtacccgtagggttccgaggtcggacgacgggttcgggtcgtcggggactacgacttcgaactccgtacaccactcgacgcacgccgtaggacgacctaagagtatacgtcgtaacgttactttaattagtacgtanacgtactaggtaccgttagcggtacgggttacgtcccttttaccggtaccgggtttacccggggacccggtaaaccgtaaaggtcgtaaaacccgttaaagtaaccgggacttgggtcggtacccgtagtaaccaacccgttagtactttacccgttacgtttaccctaaccgttcccgttaacccggtcgtaccgtttaaccgg

SEQ ID NO: 294079 - DNA, 689 bp, Homo sapiens
  misc_feature: GYAE6OF02G1QQ3.10.88.H11.1.454.CMB.1.raw
  modified_base (286)..(286): a, c, t, g, unknown or other
  misc_feature (286)..(286): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcgagtgaagatctccgtgcgaggtcttcgtggttacacctttaacacctatggcatctccgtgggtncgacgacggcccctggacaggtcttggaggttggggtggggtggtcgaggcgtcttaaccgaaggttcggactaacgaactaaatttgcgacacgaaggtaacgttaccgaaggtacaggtacgtaccaaccgtagtacgaaccctacgaacgaacctaaccgtaacgtaacccgtaacggaacgaccgtaaccgaccggtacccttaacgaacgttaacgggaaaccgttagggaacgggtacgtaccggtagacgtacgttacgtacgaaccgtaccgtacggtaccgttagttacgtttcgtacggcgtacggtaagaacggtaaacggttaaggtacggtaacgggttacggttacgggttacccggggaactacggtagtaccggacctaacccgggg

SEQ ID NO: 294080 - DNA, 559 bp, Homo sapiens
  misc_feature: GYAE6OF02F8M0V.10.88.H11.1.454.CMB.1.raw
  modified_base (290)..(290): a, c, t, g, unknown or other
  misc_feature (290)..(290): n is a, c, g, or t
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagcatagtagtgcacgaccggtgctcgatttagcgacagcgaggaacacacaaaggggacccaaaaaccacacccctccttgggagaatcccctagatcacagctcctcaccatggactggacctggagcatccttttctggtggcagcagcaacaggtgcccactcccaggttcagctggtgcagtctggggctggaggtgaagagccctagggcctcagtgaagatctcctgcgaggtcttcgtggttaccacctttaacacctatggcatctcctgggtgcgacnggcccctggacaaggcttgagtgggtggggtggtcgaggcgtcttaccgaaggttggacctacgactaaattatacggacctaacaaggtaacttccgaggaacagtacgcaccagtcgaaccacagacacactaccacgancacagcctacanggaactgagacgcgtgagatcacgacgacgacggcctattacttctcgcgcggagtaaggacgtaaagtcgtaacgtggttacggtccggggtaacagacgtacggactaccggg

SEQ ID NO: 294081 - DNA, 611 bp, Homo sapiens
  misc_feature: GYAE6OF02HPY1I.10.88.H11.1.454.CMB.1.raw
  modified_base (534)..(534): a, c, t, g, unknown or other
  misc_feature (534)..(534): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtcgtggggctgaggtgaagagcccgtggggcctcgagtgaagatctcgtggcgaggtctttcgtggttacctacctttaacaccttatcggactagttcctccgtgggtcgccgacgaccggccccgtaggacaaggtacgttggaggtggggtgggtggtcgaggcgtacttacgaggttcgactaacactaaattgcgacacgagtactcgaaggacagtactcaccatacgaacacagaccacgactaccgacgacgaccacgacgtacctaacgaagtacggaactaggaacggacgccgtagacgtactcgacgaccgacgacggtacgtatacgttccgngcggacgaggaagtaacggtaagtacggtacggtaggtacgggtaccggggacacggtagtacggaccgtaccgggg

SEQ ID NO: 294082 - DNA, 723 bp, Homo sapiens
  misc_feature: GYAE6OF02G0TAE.10.88.H11.1.454.CMB.1.raw
  modified_base (236)..(236): a, c, t, g, unknown or other
  misc_feature (236)..(236): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcattcgccagccaccctgttctttttctccaggggacagagtccaccctctcctgtacgggccagttanggtgttggcgcctattaacgtggtaccaacgagaacgtggaccaggcctcccgaggcctcctcatctacgaagcactcccgaccgacgggtaccacgtcggccgtccacggtcctaacgggttccgagttgggaccagggttcgggtacgtcggggacacggttaccttcaaccgtccttaccgaccctaatcagggccacggtcgtacgggacgtccgtaggaaacgttacgttattacggtacgtttaacgtttagtttaacgttcgttacgtaacgtacgttacgtcggttacgtcggtaaccgggttcggttacccgtttacgttaccggttttaccggggacccggggtaaaccgtaaacgggttaacggtaaacgtaaccggtaaacccgtacggttacggtacggaaccgttcggtaccaacggttacctacgttccgttacttaccgtacttccccgtttcccgtaccgttactacccg

SEQ ID NO: 294083 - DNA, 791 bp, Homo sapiens
  misc_feature: GYAE6OF02HLVRD.10.88.H11.1.454.CMB.1.raw
  modified_base (195)..(195): a, c, t, g, unknown or other
  misc_feature (195)..(195): n is a, c, g, or t
  modified_base (496)..(496): a, c, t, g, unknown or other
  misc_feature (496)..(496): n is a, c, g, or t
tcagcatagtagtgcacgaccggtgctcgatttagcgacagcgaggaacacacaaagggggaggaactgcgtcagttaggacccagagggaaccatggaagccccagctcagcttctcttcctcctgctactctggctcccaggtaccaccggagagattgtgttgacgcagtcgccagccacctgtctttttcnccaggggacagagtccacctctcctgtacgggacctagttagtggtgttcggcgtaccttaatttaaaccgtaggtaaccaaacgaacgtaaaacggtcggaccgagggtccctacccgaaggtcctaccctcgaacttaccgtaacggaacgcctaactaccccgaaccggtacggggaccctaccggtcgggtacccgtacccgaacgtccgtagggttcgagtacggacgaggtcgggtcgtagggacaggtaccttcaccttactaccacctactcacgtcaccgtccgtagggacnccgtagaaacggtattacggttacgacgttaagttttacttaacggttacgtacgtacggaccgtaacggtaccgggtacgaccgggtaacgggttcggttacccgttttaccgttacccgggtttacccggggacccgggggttaaacgaaacggttaacggggtaaaacttaaccggaaaacgttaccggttagggtaccggtacgttccggaaccctaacggttacgttaccggtttcgttaacccgtttaccacccgttttacccggtacccctaccttagttaaccccgg

SEQ ID NO: 294084 - DNA, 759 bp, Homo sapiens
  misc_feature: GYAE6OF02JE9GP.10.88.H11.1.454.CMB.1.raw
  modified_base (195)..(195): a, c, t, g, unknown or other
  misc_feature (195)..(195): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtcctttttcnccgaggggacaggacgtccacccttctccgtgtacgggcctagttacgtggttcgttggccgtaccttaagtttaaccgtgggttaacccaaactaacggaaaaccgttcgggaccgaacggaccttacccgaggccttccgtcaactcctaacgaagcctactccgaaccacgggacccaccgtcgggcctaccccgacgacccgtaacggttccgtaacgtcggcgacggtcgggtcgtagggaaccaggtccttacgaccgttacctccgtaacctactacgaccgacgtacgccgtagggtaacgccgtaaggaacgtaagtacgttcgtaaccgttaagttttacgttaacgtttcgtaccgtacgttacgtaacggttcgtaacggtaccgtcgggttaccggttacccttttaccggtaccgttttaacccggggacccgggttaacccgtaaaggttacggtaaaaccgtaccgtaaaacgtacgttacggtacgggacgttacgacctaacgtcctgttacgttctacgttactccgttaacccgtctacgtccg

SEQ ID NO: 294085 - DNA, 669 bp, Homo sapiens
  misc_feature: GYAE6OF02G5W9D.10.88.H11.1.454.CMB.1.raw
  modified_base (233)..(233): a, c, t, g, unknown or other
  misc_feature (233)..(233): n is a, c, g, or t
  modified_base (342)..(342): a, c, t, g, unknown or other
  misc_feature (342)..(342): n is a, c, g, or t
  modified_base (369)..(369): a, c, t, g, unknown or other
  misc_feature (369)..(369): n is a, c, g, or t
  modified_base (374)..(374): a, c, t, g, unknown or other
  misc_feature (374)..(374): n is a, c, g, or t
  modified_base (397)..(397): a, c, t, g, unknown or other
  misc_feature (397)..(397): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagagcccgtggggcctcgagtgaagntcctccgtgcgaggtcttcgtggttacctaccttttaacacctagtggctatctccgtgggtgcgacgacggccctggacgaaggtctggaggtggggtggggtggtcngcgtcttacgaggttgctacactaatngacanagtacgtcagacagagtacacancgaccacagacacactacacgtcacacacacctacagtacgacaggacggacgtccgtagacgtacgtaccgtacggacgtaacccgtaccggtaaccgttaagtttacgtttacgtaccggtacggtaaccgggtaacggaaacgggttaaaccggtttaaaagggttaccgggttaaccgggtttaaccgggggttaaccggggtttaacccgggggggaaaccgttaacccgggtaacggttaccgggaaaccccggtaccccgggggg

SEQ ID NO: 294086 - DNA, 709 bp, Homo sapiens
  misc_feature: GYAE6OF02H9TTF.10.88.H11.1.454.CMB.1.raw
  modified_base (197)..(197): a, c, t, g, unknown or other
  misc_feature (197)..(197): n is a, c, g, or t
  modified_base (337)..(337): a, c, t, g, unknown or other
  misc_feature (337)..(337): n is a, c, g, or t
  modified_base (444)..(444): a, c, t, g, unknown or other
  misc_feature (444)..(444): n is a, c, g, or t
tcagcatagtagtgcacgaccggtgctcgatttagcgacagcgagaacacacaaagggggaggaactgctcagttaggaccagagggaaccatggaagccccagctcagcttctcttcctcctgctactctggctcccaggtaccaccggagagtattgtgttgacgcagtcgccagcccaccctgttcctttttcnccgaggggacagacgtcacccctctcctggtacgggcctaggtttagtgggttgttggccgtaccttaattttaaaaccgtgggtaacccaaacgaaggaaaacggtcggacccaagggtcctacccgaggtcctccttnacttccgtaacgaagcactaccgaccgacgggaccagtcggccgtacccagccgtaggttcgagtggcgaggttgggccgtagggactagtacttcgacttctaccncctaatcaacgcgagtcccgtaggacaccgttagaacgtatagttgtacttaagttttattagttgtacagtcagcgttaggctagggttcgttaccttttacgtaccgttttaccggggacccggggtaaactaaaggtacggtaaaacgtaccgtaaaaccggtacgttcgggtacgggtaccgtcggtaccaccgtaacgttccgtacggtttacccgttactacccggtttcccgtttaccccggtaccctacttacccgg

SEQ ID NO: 294087 - DNA, 621 bp, Homo sapiens
  misc_feature: GYAE6OF02F2WT3.10.88.H11.1.454.CMB.1.raw
  modified_base (195)..(195): a, c, t, g, unknown or other
  misc_feature (195)..(195): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgttctttttcnccaggggacagagtccaccctctcctgtagggccagttagtggtgttggcgtaccttaatttaaacgtcggtaaccaacgagaaacgtggccaggcctcccagctcctcatctacgagcatcccaccgaggccactcggcgtcccagccaggttcgagtcggcaggtgggtctgggacagtcttcactctacacatcagcacgccgtggacgccgtagaacgtatattagacttaggtttattagtttgtacgagtactaggccgttagccggtaagggttccggtaccttttcgtaccggtttccgggacccggggtaactaaacgggtacgtaaacgtacgaaaccggtacgtaggtcgtacgtaggaccctaacgtcttcgttcgtactttaccgtacgtaccgttcccgtacctacttaccg

SEQ ID NO: 294088 - DNA, 599 bp, Homo sapiens
  misc_feature: GYAE6OF02FOM0I.10.88.H11.1.454.CMB.1.raw
  modified_base (390)..(390): a, c, t, g, unknown or other
  misc_feature (390)..(390): n is a, c, g, or t
tcagcatagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaactggtaccaacagaaacgtggccaggctcccaggctcctcatctacgaagcatcccaccgagggcccacgtggccgtcccaggccaggttcgagtggcaggtcgggtctggggacctagtaccttcactctacactancagcacgtcccgtggacgtcctaggaacgtatagttgacttagtttattaattgtcagcagcgtagcgtaggtcgttacctttcgaccggtttccggggacccgggtaacctaaagggtcggaaaactacgaaaaccggtacgtcggtacggcgtcgacctacctaagttccgtacgttcttctaacgttcccttcccgcctattcccg

SEQ ID NO: 294089 - DNA, 730 bp, Homo sapiens
  misc_feature: GYAE6OF02IKYI2.10.88.H11.1.454.CMB.1.raw
  modified_base (234)..(234): a, c, t, g, unknown or other
  misc_feature (234)..(234): n is a, c, g, or t
  modified_base (270)..(270): a, c, t, g, unknown or other
  misc_feature (270)..(270): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacaggtcgcccactcccgaggttcagctggtgcagtcgtggggctggaggtgaagcgcccgtgggcctcgagtgaagntctcctgcgaggcttcgtaggttaccacctttaacncctatcggacagtcctcgtggtgccgacgacggcccgtggacaaggtcgttggaggtggggtgggtggtcgacggtcgtacgttacgtaaggttcggactaacgtaagtaaacttgacgacgacgtaacggtaacgttccgaagggacctaaggtacgtaccgaaccgtaagtcgaaacccacgaacgacaacgtacgtaccgaacgacgtaccgaaccgacgaaccctttacgaaacgttacggaaacgttcgggaaacggtaacggtacccggtaaggtaacgtaacgttacggaccgggtaaccgaaccggtaccgggtaacccgttaagtttacggttaccgtacggaccgggtacggtaacggtaaccgggttaaacgttaaacggcggttacggtacggggttaaccggggtaccgggtaacctacgttacggtaccggaacggtaacccgggg

SEQ ID NO: 294090 - DNA, 817 bp, Homo sapiens
  misc_feature: GYAE6OF02G0BV9.10.88.H11.1.454.CMB.1.raw
  modified_base (356)..(356): a, c, t, g, unknown or other
  misc_feature (356)..(356): n is a, c, g, or t
  modified_base (468)..(468): a, c, t, g, unknown or other
  misc_feature (468)..(468): n is a, c, g, or t
tcagcatagtagtgcacgaccggtgctcgatttagcgacagcgagaacacacaaagggacccaaaaccacacccctccttgggagaatccctagatcacagctcctcaccatggactggacctggagcatccttttcttgggtggcagcagcttaacaggtgcccactcccaggttcagcgtggtgcacgtcgtgggctggaggtgaagacgccgtgggcctcgagtagaagtatctccgtgcggagtccttcgtgttactacctttaacgacctagtggctacgttctccgtgggtcgacggtacaccggtcccgtaggactaaggtcgttgacggttgggtcggggtggtacgnggtacgtccgttaaaccgtagttcgggtacctaacggtaaactaaagttgacgtccgaacgtaacggttaacgttaaccggacggtaacgaaggtacgtaacccgacgtacnccgtaaacccgaacgaacgtaaccaacgtaccgtaaccgaacgaccgtaccaacgaaccggtaccctaaccggtaacgttaccggtaaacggttaacggaacgtaccgtaacccgtagtaaccggtacgtttaccggaaggttaacccgtaccggaaccggttacccgggttaatttaaccggttaccgttaaccgggtcccggaacggttaaccgggtaaaccgggttaaaaccggttaaaccgggttaaacgggttaaccgggtttaacggggtttaccggggttaaccccggggggaaacgttaacccggtaacggttacccgggtaaaccgttaacccccggggg

SEQ ID NO: 294091 - DNA, 709 bp, Homo sapiens
  misc_feature: GYAE6OF02HCW7U.10.88.H11.1.454.CMB.1.raw
  modified_base (508)..(508): a, c, t, g, unknown or other
  misc_feature (508)..(508): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtcgcccactcccaggttcagctggtgcagtcgtggggctggaggtgaagagcccgtgggcctcgagtgaagatctctgcgaggtcttcgtggttacctaacctttaacaccttagtcggactacttccgtccgtgggtcgaccgacgaccggcccctagggaaccgaagggtaccgtttgggaggggttgggggttcgggggtcgggtcacggtccgtacgtttaaccgaaggtttcggaccttaacgaactaaagttgacacaacgtaagtaacgtccgaagggacaggtacgtaccacgtatacgaccacgacgacacgactaccgacgacacgacacgtcctaanacgtacgacgtagacgacgtaccgtagacgtacgtacgtacggaccggtacgtaccggtacgttaacgtttacgttccgtacggccggaccggtaacggtaaccgggtaaacggttaaacggttacggtaacgggttacgggttaaccggggttacccgggggaacctaacggtacggttaccggaacccggtacccgggg

SEQ ID NO: 294092 - DNA, 535 bp, Homo sapiens
  misc_feature: GYAE6OF02FKAV3.10.88.H11.1.454.CMB.1.raw
  modified_base (351)..(351): a, c, t, g, unknown or other
  misc_feature (351)..(351): n is a, c, g, or t
  modified_base (468)..(468): a, c, t, g, unknown or other
  misc_feature (468)..(468): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggcttgagtgggtggggtggtcagcgcttaccaagttggctacacaaattangcacagaagttccaggacagagtcaccatcgaccacacgacacactaccacgacgacacacgacctaacagtcggaactagagagcctgagatcagacgacgacggcgtatattcgngcgcgaggaagaacgtaaaggtgacggttaggtacggttaccgggggactacgagtcgacgtaccgg

SEQ ID NO: 294093 - DNA, 823 bp, Homo sapiens
  misc_feature: GYAE6OF02HYD3B.10.88.H11.1.454.CMB.1.raw
  modified_base (197)..(197): a, c, t, g, unknown or other
  misc_feature (197)..(197): n is a, c, g, or t
  modified_base (369)..(369): a, c, t, g, unknown or other
  misc_feature (369)..(369): n is a, c, g, or t
  modified_base (631)..(631): a, c, t, g, unknown or other
  misc_feature (631)..(631): n is a, c, g, or t
tcagcatagtagtgcacgaccggtgctcgatttagcgacagcgagaacacacaaaggggggaggaactgctcagttaggacccaggagggaaccatggaagccccagctcagcttctcttcctcctgctactctggctcccaggtaccaccggagagattgtgttgacgcagtcgccagccacccttgtctttttcnccgagggtacagacgtccaccctctccgtaggtagggacctaggtttagtgggttcggttcgggaccgtaccttaagtttaaaacggtcggttaacccaaagtaacggaaaacggttcgggaccgacgggtacctacccggaacggtcctaccttcactacgtaacggaacnccaactaccaacccggacgggtaccaccggtacggtacccgtaccccgaacggtacccgtaacgggttaccgaacggttgggaccgtagggttccgggggtacggttacggggaaacgacggttaccgttacgttactaccgtacctaacccggtattaccggactaccgaccggtccgtaggggtaacgccgtaggtaaaacgtagttaacgttggtaacttacggttttaaattcgttacgtaccgtaagtacgtaacgnggttaacggcggttacgggtcgtttacccggtttacttacccgggttaccggggtaacccgggtaaacgtaaaaggtacgggtaaaactaaaccggtaaaacggagttacggtacggtacgtacggtacctacgtaaccgttccgttagttaccgttaaccgctttaccccgtccgtacccctaattacccg

SEQ ID NO: 294094 - DNA, 704 bp, Homo sapiens
  misc_feature: GYAE6OF02JU5DR.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatccttttcttggtggcagcagcaacaggtgcccactcccaggttcagctggtgcagtctggggctggaggtgaagagcccgtggggcctcgagtgaacgatctccgtgcgaggtcttcgtggttacctacctttaacacctatcggctatcctccgtgggtcgcgtacgacggccccgtaggacgaaggtcttggtaggtggggttggggtcgggtcgaggccgtcgttaaccgtaaggttcggactaactaacgtaaattacgtgacaacgaaggtaacgttccgaaggtaacgagtaacgtacccaaccgtagtacgaacctaacgacgaaccacgaactacccgacggacgaccacgacacctaacgagtacggtaacgtacggacggacgtacgtagaacgtacgtacgtacggaccgaccgaaccgtaccgtaacgtttacgttcgtaccgtaccggtaacgtaacggtaacggtaaacgttaaacggtaacggtacgggttaacgggttaaccgggttacccgggggtaacctaccggtaacgtacggtaacccggtaacccgggg

SEQ ID NO: 294095 - DNA, 754 bp, Homo sapiens
  misc_feature: GYAE6OF02IEUKQ.10.88.H11.1.454.CMB.1.raw
  modified_base (187)..(187): a, c, t, g, unknown or other
  misc_feature (187)..(187): n is a, c, g, or t
  modified_base (231)..(231): a, c, t, g, unknown or other
  misc_feature (231)..(231): n is a, c, g, or t
  modified_base (413)..(413): a, c, t, g, unknown or other
  misc_feature (413)..(413): n is a, c, g, or t
tcagcatagtagtgcacgaccggtgctcgatttagcgacagcgagaacacacaaaaggggacccaaaaaaccacacccctccttgggagaatcccctagatcacagctcctcaccatggactggacctggagcatccttttcttggtggcagcagcaacaggtgcccactcccaggttcagctggtncagtctggggctgaggtgaagagcccgtgggcctcgagtgaagntctctgcgaggtcttgtcggttactacctttaacacctatcggctactctccgtggtcgcgacgcggccccgtaggaccaaggtacgttggtaggtggggtgggtgggtcagcgtcttacgaaggttgctacactaaattagtcgcacgagtaacgttcgaacggactagacgtccaacgtntacgaccaacgacgaacactactaccgaacgtacgacgaacgacgtacctaacgtacgtacggaacgtacggaacggtaaccggccgtaacgtaacggtacgttacgtaaccgggaaccgtaacccgggtaaccgggttaacccgtttaaacgtttaccgttttaccgtttaccgggaccggttaaccgggtaaacgggtaacgggtaaaaccgggttaaaacgggttaccgggttaaccggggtttaacggggtttaaccggggtttaaccccggggggggtaaaccttaacccgggtaaacgggtttacccgggtaacccggttaaacccccggggggg

SEQ ID NO: 294096 - DNA, 754 bp, Homo sapiens
  misc_feature: GYAE6OF02F67II.10.88.H11.1.454.CMB.1.raw
tcagcatagtagtgcacgaccggtgctcgatttagcgacagcgagaacacacaaaggggacccaaaaaccacacccctccttgggagaatcccctagatcacagctcctcaccatggactggacctggagcatcctttcttggtggcagcagcaacaggtgcccactcccaggttcagctggtgcagtcgtggggctgaggtgaaagacgcccgtggggcctcgagtgaagactctcctgcgaggtcttctggttacctaccttaacacctatgacatcctccgtagggtcgacgacgacggtcccctagggaacctaagggtccttaggaggttggggtggggtcgggtacaggtccgtacgttaccgaaaggttggaccttaagaaccgtaaaatttcgtacggactaacgtaacggtaacggttacccgaaggggtacacggtaaccgtactacccgtaagtacgaacccaacgacgtaaccgaacctaacgtaccccgacgtaacgaccgaacgtaaccggacctaaccgtacgtaacgggtaacgtacggaacgggtacgtaccgtagaacggtacgtaccgtacggtaccgtaaccggaaccggtacccggtaacgtttaacgttacgtcggtaccgtacggtaacgtaacggtaaaccggttaaacggttacggtaaccggttacgggttaacgggtacccgggggtaaacccttacggaacggttaccgaaccggttaccccgggg

SEQ ID NO: 294097 - DNA, 771 bp, Homo sapiens
  misc_feature: GYAE6OF02JREM7.10.88.H11.1.454.CMB.1.raw
  modified_base (560)..(560): a, c, t, g, unknown or other
  misc_feature (560)..(560): n is a, c, g, or t
  modified_base (663)..(663): a, c, t, g, unknown or other
  misc_feature (663)..(663): n is a, c, g, or t
tcagcatagtagtgcacgaccggtgctcgatttagcgacagcgagaacacacaaaggggacccaaaaaccacacccctccttgggagaatcccctagatcacagctcctcaccatggactggacctggagcattccttttcttggtggcagcagcaacgaggtcgccacctcccaggttcagtctggtgcagtcgtggggctggaggtgaagacggcccgtggggcctcgagtggaacgtatccgtaccgtgacgtgggtcctttcgtcggtttaacctaaccttttaaaccgtccgttaagtcggactagtccttccggtagggtcgaccgtacgacggccccgttacggaacgtaacggtcgttgggagggttcgggggtgggtgggaccgacggtccgtaccgtacgtaaggttcggtacctaacgtaactaaattcgtacgactaacgtaaggtacgttaccgaggtacaaggtacgtaccacgtataccaaccgacgaacgtactaccgtaaacgtcccggtaaaggaccgaacgttaccgaactacccggtaanacggtaacggtaaacgacgggacggtaacgacccggttagtacgaacttcccggtaacggggaaccgtaccgggaaccgttccgttaaacgtttagtccccgnggttccgaaacgggagtaacggttaaacggttaagtaccggtaacggttaccggggtttaacccggggaccgggtaaccaaggtaccggtaccggttaaccgcggggg

SEQ ID NO: 294098 - DNA, 989 bp, Homo sapiens
  misc_feature: GYAE6OF02H0QEB.10.88.H11.1.454.CMB.1.raw
tcagcatagtagtgcacgaccggtgctcgatttagcgacagcgagaacacacaaagggggagaactgctcagttaggacccagagggaaccagtggaagccccagctcagcttctcttcctcctgctactcgtggcctcccgaggtacccaccgggagagtattggtgttggaaccgccgtaggccgccacgcccctacccttcgtttctttttccgaccggaggggacaggacgtccaccccgttctaccgtggtacgggacctagttagtcggttagtcgggcgtaccttaagttttaaaacgcggttaaccaaacgaagtaaaccggtacggacccgtacggtcccctacccgaacggtcctaccgtctaacgtaccgtaacgaagccaactccccgaaccggtaccggacccgtacggtaccggtacccggtacccgacgaccggttacggttacgtagtcggacggttacggtcggggttacctagggggtaaccctaagttccgtacctacccgttacacccctaccgaacttacgacgtacctaaaccggtccggtttaacgggaccggtaccgtaacggttaaaacggtaacgtttaaacggtttcggtaaacgttttaacggttttaagttaaccgttttccggttaaaccgggtacgtaacccgggttaaacgggtaccgggttaacgggtaccgggttaaccgggtttacccgggttttaccccggtttttaccgggtttaccccggggtttttaaccccggggggaaacccccgggggtaaacccgggtttaaaacgggttaaccggtaaaaaacccgttaacccgggttaaaaacccggttaacgggttaacgggttaccggggtaactaccggttaaccgtaacccgttaacggtttacccggtttacccgtttacgtttaccgttaacccctttacccccgggtttaaacccctacccggttaccttaacccgg

SEQ ID NO: 294099 - DNA, 888 bp, Homo sapiens
  misc_feature: GYAE6OF02HEX5Q.10.88.H11.1.454.CMB.1.raw
  modified_base (196)..(196): a, c, t, g, unknown or other
  misc_feature (196)..(196): n is a, c, g, or t
tcagcatagtagtgcacgaccggtgctcgatttagcgacagcgagaacacacaaagggggagaactgctcagttaggacccagagggaaccatggaagccccagctcagcttctcttcctcctgctactctggctcccaggtaccacggagagattgtgttgacgctagtcgccacgcctaccctgttctttttcncgagggtacagacgtccaccctctccgtgtacggcctagttagtggtagttcggcctaccgttaatttaaaccgtcggtaaaccaaacgtaaggaaaaccggttcggacctacgggtccctaccccggaaggtccttcccgtacaacttacctaaacggtaacgaccaacgtaccccgaaaccggaccgggaccctaaccggtcgggcccgttacccccgaacggtacccgtacgggttacgaacgtggggaccgtaagggttcggggttacgtacggggacttaacgtacctttacgtacgtaccttaaccgaaccctaagttaccaacggtaccgtacggtccgttaggaacgtcccgtaagaaacgttaagtacgttacgggtacctttaaaggttttaattacgtttacgtaccgaacggttccgttaaacggtaccggttaagggaccggtttaacggggttcccgtttacccgttttacccggtttaacccggttttccccgggggaacccgttaaacgggggtaaaaccgttaaacgggttacggtttaaacgttttaccgaaacgggtaaccgttaaccggttacgggtacggtaccgtaccggtaacccgttaaccgttaccgtttccgtttaacggtcccgttttaacccgtaccggtttaccccctttaccccgtaacccg

SEQ ID NO: 294100 - DNA, 678 bp, Homo sapiens
  misc_feature: GYAE6OF02H0JPI.10.88.H11.1.454.CMB.1.raw
  modified_base (516)..(516): a, c, t, g, unknown or other
  misc_feature (516)..(516): n is a, c, g, or t
tcagcatagtagtgcacgaccggtgctcgatttagcgacagcgagaacacacaaaagggggaggaactgctcagttaggacccagagggaaccatggaagccccagctcagcttctcttcctcctgctactctggctcccaggtaccaccggagagattgtgttgacgcagtcgccagccacctgttctttttctccaggggacagagtccaccctctcctgtacggcgtagtagttggtggtggtcgcttattaaacttacgtacaacaagaaacgtacggccgacgcgtcccgacggcgtcctcatcgtaacgaacgcactaccaaccgacggaccgacgtacggccgtaccccacgaccgtacggttacgtacgtaggcgtacggtcgggttacgtcgggaacgtaggtacttctactactaccgacctacgtacacgacgaccgccgtaggacggaccctaggtaaaagactttagttaggtactaaggttttaattagttcgtgaaccgtnacgtacgtgacgtcgggttcgttcctttccgtaacggtttcccggggacccgggaactaaaagtacggaaaacttcgaaaacgttactgggtacgtacgtaacgccctaaacgtcgttacgttccgttacttctaaccggtttaccctcccggtacattacg

SEQ ID NO: 294101 - DNA, 747 bp, Homo sapiens
  misc_feature: GYAE6OF02GPTS1.10.88.H11.1.454.CMB.1.raw
  modified_base (142)..(142): a, c, t, g, unknown or other
  misc_feature (142)..(142): n is a, c, g, or t
  modified_base (161)..(161): a, c, t, g, unknown or other
  misc_feature (161)..(161): n is a, c, g, or t
  modified_base (166)..(166): a, c, t, g, unknown or other
  misc_feature (166)..(166): n is a, c, g, or t
  modified_base (247)..(247): a, c, t, g, unknown or other
  misc_feature (247)..(247): n is a, c, g, or t
  modified_base (352)..(352): a, c, t, g, unknown or other
  misc_feature (352)..(352): n is a, c, g, or t
tcagcatagtagtgcacgaccggtgctcgatttagcgacagcgagaacacacaaaggggacccaaaaaaccacacccctccttgggagaatcccctagatcacagctcctcaccatggactggacctggagcattccttttntgggtggcagcagcaacgnggtcncccactcccgaggttcagtcgtggtgctagtcgtggggctggaggtgaagacgcccggtgggcctgagtgaagctcctcgnggcgtcgtcgttcgtacgtaacctaccttaactacgtagtcgctattccgtcggtcggtcgtaccggacggcccggtccggtaggaacgtacggtacgttagggnggggttggggtcggggtgcgacggtaccgtacgttacgtaggtacgactaacgtaacgtaagtcgacgtaacgaacgtaacgtaacgttacggaacgtaacgtaagtaccgtaccgacgtacgtaacgaaccgaacgtaaccgtaaccgtaacaccgtaaccgaacgtaccgaccgaacctaaccgacgtaacgtaacgtacggtaacgtacggaacgaccgtacgacgtacgtacgtacggacgaaccggaccggttaccgttaacgttaacgttacgttacgtacggacgtacggtaacggtaaacggtaacggttaacggtaacgggttaacggttacgggttaaccgggtaccgggtaacctaacggtacggtaccggtacccggtacggg

SEQ ID NO: 294102 - DNA, 886 bp, Homo sapiens
  misc_feature: GYAE6OF02IL757.10.88.H11.1.454.CMB.1.raw
tcagcatagtagtgcacgaccggtgctcgatttagcgacagcgagaacacacaaagggggaggaactgctcagttaggacccagagggaaccatggaagccccagctacagtcttcctcttccctcctgcctactcgtggcctcccacggtacccgaccggagaacgtagttttcgtgtttcggaaccgccgtaggtccgacccagcccgtaccctttgtttccttttttcgcccggagggacctagacgttcccacccttcgtccgtaggtacgggccttaggtttgtggttcgttcggaccgttacttaagtttaaacgtcggtaaccctaaacgaaggaaaccgttcggaccgtacggcccttaccccgaaggcccttacccgtctacgttctaaacggaactccgtaacgtaccccaaccggacggggaccctaccggtccgggtacccgtacccgacggtacccgtacgggtttcgaagttcggacgttacgggtcggtacgtcgggaactacgtccgtttacgaccgttctaccgaaccgttagcccgtaaacggccgtaacggttcccggtagggtaaccgtcccggttaaaggaacggtacttttaacgtacggttacctttaggtttacgtttaacgttcggtactaaggtaccgtacggttaccggttacggacggttaacgggttccgtttacccgtttacgtaacccgggttacccggggtaaccgggtaaaccctaaagggttaacggttaaaccgtaaaccgtaaaccggtaacggttcgttaacgggtcctaacgggacccttaacggttacgttcgttcccgtttaaccgttcgttaacccgtttcccggtaacccgtccaactttcccg

SEQ ID NO: 294103 - DNA, 491 bp, Homo sapiens
  misc_feature: GYAE6OF01EAUNR.36.2.A02.1.454.CMB.1.raw
  modified_base (333)..(333): a, c, t, g, unknown or other
  misc_feature (333)..(333): n is a, c, g, or t
  modified_base (464)..(464): a, c, t, g, unknown or other
  misc_feature (464)..(464): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagccacctttagnggcagtgggtctgggacagagttcactctcaccatcagcagcctgcagtctagaagtattttgctagtttattactgtacaacagtacaatgactgcctctcacttcggcggaggaccagggtgagactanaaacgactgtgctgacaccatcgtgtc

SEQ ID NO: 294104 - DNA, 518 bp, Homo sapiens
  misc_feature: GYAE6OF01CXW0I.36.2.A02.1.454.CMB.1.raw
  modified_base (395)..(395): a, c, t, g, unknown or other
  misc_feature (395)..(395): n is a, c, g, or t
  modified_base (439)..(439): a, c, t, g, unknown or other
  misc_feature (439)..(439): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagcctacctttagtggcaggtgggtctgggacaggagtttcactctcaccatcagcagcctgcagtctagaagtntttgctagtttatactgttacaatagtacaatgactggaccttntctacgttcgggacggacgggaccaagggtgagacgttacaaaacgtactggtaggctcggaccactacgtgtgttacc

SEQ ID NO: 294105 - DNA, 494 bp, Homo sapiens
  misc_feature: GYAE6OF01DU7JK.36.2.A02.1.454.CMB.1.raw
  modified_base (199)..(199): a, c, t, g, unknown or other
  misc_feature (199)..(199): n is a, c, g, or t
  modified_base (297)..(297): a, c, t, g, unknown or other
  misc_feature (297)..(297): n is a, c, g, or t
  modified_base (333)..(333): a, c, t, g, unknown or other
  misc_feature (333)..(333): n is a, c, g, or t
  modified_base (477)..(477): a, c, t, g, unknown or other
  misc_feature (477)..(477): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
tcagtacgctgtctcacgaccggtgctcgatttagactcatctacagggggaggtaactgctcgagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcaagaaacctggccaggttcccatgctcatcatctatggtncatccaccagggccatggtatcccagccactttagnggcaggtgggtctgggacagacgttcactctcaccatcagcagcctgcagtctagaagtattttgactagtttattactgtacaactagtacaatgactgcttctcacttcggcgagggaccaggtggacgatacaaagactgnggtcncgnacntcgtcg

SEQ ID NO: 294106 - DNA, 491 bp, Homo sapiens
  misc_feature: GYAE6OF01DYR8W.36.2.A02.1.454.CMB.1.raw
  modified_base (331)..(331): a, c, t, g, unknown or other
  misc_feature (331)..(331): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccacgaggccactggtatcccagccacctttagnggcagtggtctgggacagagttcactctcaccatcagcagcctgcagtctgaagtatttgctagtttattactgtacaactagtacaatcgactggcctctcacgtttcggcggaggaccaggtgagtatacaaacgtactgtgctgcacatcgtgttcc

SEQ ID NO: 294107 - DNA, 867 bp, Homo sapiens
  misc_feature: GYAE6OF01CGLXP.36.2.A02.1.454.CMB.1.raw
  modified_base (228)..(228): a, c, t, g, unknown or other
  misc_feature (228)..(228): n is a, c, g, or t
tcagtacgctgtctcacgaccggtgctcgatttagactcatctacaggggagctctgagagaggagcccagccctgggattttcaggttgttttcatttggtgatcaggactgaacagagagaactcaccatggagtttgggctgagcgtggtcgttttctggtggctaattttaaaaaggtgtccagtgtgaggtgcagctgttggagtgtggggaggtcttggacngccggtgggggtcctgagcctctccgtgtgcacgcctgtggtatctaccttagcagtctatcgcctagtcgaccgtcggtcccgccgacggcctaccggaagggggtaacgggaccgtaggggacgggttcgggttccgtccggttacttaagtttagggtagggtaaacggttggggttaagggttaaactaaacgtaaaaacgttccggacgtaacggtccccgtttaacccggtaggggaaaccggggtccctaccgtttacccaaacccctaacggttaccttaacccccggaaggtaaaacggttaaccccgtttaaacttaacccccggaaaaaagggcccgtacccgttaaacccttccgtttaacgggttaacctttaccgttaaccgggaacctaaaaaagttaccggaaaaaccgtcggttaaccccgttagggggaacgttaccgggaccccgggtaaaccgggaacccgtaccccgggttaacccttaaagttaaccgttttagttaacgggtacgaaccggggttaaaaggtttccgggggggaaagggggggtacgggttaccggggggtaccctttaacgggttccccgttagggggtttccggttttacggtaaaccccgggg

SEQ ID NO: 294108 - DNA, 501 bp, Homo sapiens
  misc_feature: GYAE6OF01B1NTO.36.2.A02.1.454.CMB.1.raw
  modified_base (335)..(335): a, c, t, g, unknown or other
  misc_feature (335)..(335): n is a, c, g, or t
  modified_base (494)..(494): a, c, t, g, unknown or other
  misc_feature (494)..(494): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggcccactggtatccccagcccacctttagnggcagtgggtctgggacaggagttcactctcaccatcagcagcctgcagtctgaagtattttgctagtttattactgtacaacagtacaatgactggtcctctctacgtttcggcggagggaccaagggtggagatacgaaacgtactgtggctgcacntcgtgtc

SEQ ID NO: 294109 - DNA, 531 bp, Homo sapiens
  misc_feature: GYAE6OF01BSEHR.36.2.A02.1.454.CMB.1.raw
  modified_base (525)..(525): a, c, t, g, unknown or other
  misc_feature (525)..(525): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccaacagacacctggccaggcctcccaggcctcctcatctatggtgcatcccaccgagggcccacgtcggtactccccagccaggttcagtggcgagtgggtctgggacagagttcactctcaccatcacgaccaacctgacagtctagaagtattttgcttagtttattactgtcagctagtataatgacacggtcgtaccgggtacgtttcggcgtacggggaccaggtacgtagggagtagtacgaaacgacgtagtggtcgtacgacactntcgtcg

SEQ ID NO: 294110 - DNA, 496 bp, Homo sapiens
  misc_feature: GYAE6OF01AKP0H.36.2.A02.1.454.CMB.1.raw
  modified_base (367)..(367): a, c, t, g, unknown or other
  misc_feature (367)..(367): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatccccagccacctttagtggcagtgggtctgggacagagttcactctcaccntcagcagcctgcagtctgaagtatttgctagtttattactgtcaacagtacaatgactggcctctctacgtttcggcggagggaccagggtggagactacaaacgactgtgcgtcgcaccatcgtgtcc

SEQ ID NO: 294111 - DNA, 701 bp, Homo sapiens
  misc_feature: GYAE6OF01DK2YE.36.2.A02.1.454.CMB.1.raw
  modified_base (294)..(294): a, c, t, g, unknown or other
  misc_feature (294)..(294): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggttcccaggctcatcatctagtggtncatccaccgagggcccacgtggtactcccgacgtccctaccgttttaggcgggacctagggttcggggttaccgtagggggaacctaggtacggtttccaaccgttcctaccaccctatccgacgcacgtcctgctaggttctagtaagtattttgacgtttaaggttttactttacgttacgttaaccgtaactaacgttaactaagtacgtaccgttaccgggtacccttaccgttaccgttaaccggttttccgggggaaccggggttaacgggggtaacccggtaaagggggttacgggtaaacgggtaacgttaaccggtaaaacccggtaacgtttacggggtaccgggttaccgtacggtacccgtaacccgtaacgtttcccggttcggttttaccccg

SEQ ID NO: 294112 - DNA, 605 bp, Homo sapiens
  misc_feature: GYAE6OF01CSAYP.36.2.A02.1.454.CMB.1.raw
  modified_base (196)..(196): a, c, t, g, unknown or other
  misc_feature (196)..(196): n is a, c, g, or t
  modified_base (424)..(424): a, c, t, g, unknown or other
  misc_feature (424)..(424): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccacctatctgtgtctccaggagaaagngccaccctctcctgtacgggccagtcagagtgttagcagacaacttagcctggtaccagcagaaacctggccaggttcccaggctcatcatctagtggtgcactccaccgagggccacgtggtactccccgacgccctaaccgtttaggcggactagggttggggttcgtaggggaacaggtacgttccacttcctacaccatcagcacgcctgacagagtagaagtntttcgattagttttattattgtacagtctaagttaataaacgttacgtcgggtcccttaccgggtacttaccggtttcgggaccggggtaacgggaaccgtaaggggtgggaagtaacgtaaccgtaaaacggtaacgtgggtacggtctacggacccaaccgtattccgttcgttacccg

SEQ ID NO: 294113 - DNA, 564 bp, Homo sapiens
  misc_feature: GYAE6OF01APUHR.36.2.A02.1.454.CMB.1.raw
  modified_base (334)..(334): a, c, t, g, unknown or other
  misc_feature (334)..(334): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagcccacctttagnggcagtgggtctgggacagagttcactctcaccatcagcagcctgctagtctgaagtattttgactagtttattacttgtactaatacgtaacaagttgacgtcggtcccttcttacgtaccgtttaccgggacgggtaacgggaccgtaaagggtcgggtaacgaacgttacgaaaaccggtacgttcggacggttactacgaccgaaccttacgtcgttcggttaccc

SEQ ID NO: 294114 - DNA, 572 bp, Homo sapiens
  misc_feature: GYAE6OF01EAYV2.36.2.A02.1.454.CMB.1.raw
  modified_base (229)..(229): a, c, t, g, unknown or other
  misc_feature (229)..(229): n is a, c, g, or t
  modified_base (346)..(346): a, c, t, g, unknown or other
  misc_feature (346)..(346): n is a, c, g, or t
  modified_base (531)..(531): a, c, t, g, unknown or other
  misc_feature (531)..(531): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (540)..(541): a, c, t, g, unknown or other
  misc_feature (540)..(541): n is a, c, g, or t
  modified_base (543)..(572): a, c, t, g, unknown or other
  misc_feature (543)..(572): n is a, c, g, or t
tcagtacgctgtctcacgaccggtgctcgatttagactcatctacgaggggaagggcttggagtgggtctcaggtatcagttacaatagtggtagcgtgggctatgcggactctgtgagggggccgattcacctatctccagagacaacgccaagaactccctgtatctgcaaatgaacagtctgaaacctgaggacacggccgtggtattactgtgacaaaaacgggngaccccggccagggtcggggtcttagtctattaccgactacgtggggaccaaggggacccggtcaccgtctcctcacgcctccgaccaacgggcccagtccggtctccccgtggccnccctgcctaccgaggtacgcctacccgtccgacgtacgccaccgacggcccggaccccgtgggccgttcggcccgtacggtaccgaacggtacccttaaccgttcccgaaggaccgtaggacccggttaacgtacgggacgtaccgggggtctacgggacgtaaacgggccgactacgagcgagngcgnngngnngnnnnnnnnnnnnnnnnnnnnnnnnnnnnnn

SEQ ID NO: 294115 - DNA, 533 bp, Homo sapiens
  misc_feature: GYAE6OF01DF358.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactccccagccctaccgtttagtggcaggtgggtctggggacagagttcactctcaccatcagcagcctgcagtctagaagtattttgctagtttatactgtacaactagtacaatgactggtcctctctacgtttcgggcggtacgggaccgaagggtggagtacgtacgaaacgtaacgtggtacggctcggacctacctaacgtccgtgttacccg

SEQ ID NO: 294116 - DNA, 831 bp, Homo sapiens
  misc_feature: GYAE6OF01DG4AS.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctccagatatcactggaagaaatagtgatgacgcagtctccagcccacctatctgtgtctcgaggagaaagacgccaccctctcctaggtacgggccagtcagtagtgttagcagactaacgttagccgtaggtaccagacaacgaaaccgtggacccacggttcccaggcctacatcatctagtggtcactactcccgaacgacgggtacctacgtcggtacctcccgacgtcccttaaccgtttaggcggacgtagggttgggtccgtagggactaggtacgttccacgtctaccaaccgtatccgaacgtccgacgtccgtaggaccgttaggttaccgttaaggtaaacgttttacgtttttacggaacgttttaaaggtttttaactttaaccggttacgttaaaccgttaaaacgtacgttaaaccgtaaaggtttaccggtacccggtttacccgggttacccctttaccggttacccggtttaacccggggttttacccggggggaaccgggggttaaaccgggggtaaaccccggttaaagggggggttaacgggtaaaacccgggttaaaccggtttaaaacccgggaaaaaaacccgggtttaaccgggtttcgggggttaacccggggttacccttaacccggggtaccccttaaaacccgttacgggttttacccgttcggttttaacccccg

SEQ ID NO: 294117 - DNA, 519 bp, Homo sapiens
  misc_feature: GYAE6OF01ETV56.36.2.A02.1.454.CMB.1.raw
  modified_base (340)..(340): a, c, t, g, unknown or other
  misc_feature (340)..(340): n is a, c, g, or t
  modified_base (512)..(512): a, c, t, g, unknown or other
  misc_feature (512)..(512): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtacgggccagtcagagtgttagcagcaacttagcctggtaccagcagaaacctggccaggttcccaggctcatcatctatggtgcactccaccagggccacgtggtactccccagccctaccgtttagnggcaggtgggtctgggacagtagttcacttctcaccatcagcagcctgcagtctagaagtattttgacttagtttattactgtactaacagtacaatgactcggtcctctctacgttcgggcggagggtaccgaagggtggagactacgaaacgtactggtggctgacactntctgttc

SEQ ID NO: 294118 - DNA, 578 bp, Homo sapiens
  misc_feature: GYAE6OF01EZGYX.36.2.A02.1.454.CMB.1.raw
  modified_base (297)..(297): a, c, t, g, unknown or other
  misc_feature (297)..(297): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagcgtgtgtttctaggtcggctatttaaaggtgtcagtgtgaggtgcagctgttggagtcgtgggggaggcttggtacagccgtggggggtccctgagctctcctgtgcagctctggattcacctttagcagctatgccatgacctgggtccncaggctccgagggagggactggagtggtctcggtctattaggtggaagtggtaggttatacgaaactacgcagtcctccgtgaacgggccgtacttcacctactcctccgagacgacttacttaccaagtacgcaacctctgtaatcctgtaaccaatacgaacaacgcctaggacgtcgaccgaggaccgaccggaccctattacttagttggtgtaacgaaggttgggtaggggggtagtcgggggtactacgttccggtggttcgttttggtaaccgg

SEQ ID NO: 294119 - DNA, 528 bp, Homo sapiens
  misc_feature: GYAE6OF01BK8FW.36.2.A02.1.454.CMB.1.raw
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
  modified_base (395)..(395): a, c, t, g, unknown or other
  misc_feature (395)..(395): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccgaggagaaagagccaccctctcctgtagggccagtcagagtgttagcagcaacttagcctggtaccagcagaaacctggccaggttcccaggctcatcatctatggtgcatcccacagggccactggtactcccagcccacgtttagnggcagtcgggtctgggacagagttccactctcaccatcagcagcctgcngtctgtaagtnttttgcttagtttattactgtacaactagtacaatgtaactcggtcctcttccgtacgtttcgggacgggtagggaccgtaggtggaagataacgaaacgagtcgtaggtactgacctacacttcgtgttacc

SEQ ID NO: 294120 - DNA, 521 bp, Homo sapiens
  misc_feature: GYAE6OF01BTXS6.36.2.A02.1.454.CMB.1.raw
  modified_base (340)..(340): a, c, t, g, unknown or other
  misc_feature (340)..(340): n is a, c, g, or t
  modified_base (510)..(510): a, c, t, g, unknown or other
  misc_feature (510)..(510): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagcccaccctctcctgtagggccagtcagagtgttagcagcaacttagcctggtaccagcagaaacctggccaggttcccaggctcatcatctatggtgcatcccaccagggcccacgtggtactccccagccctacctttagnggcaggtgggtctgggacaggacgttcactctcaccatcagcagctgcagtctagaagtatttgacttagtttattactgtacaactagtaacaatgactgccttctctacgttcggcggaggaccagggtggagtactacgaaacgacgtggtacggctcgacctaacncttcgtgtacc

SEQ ID NO: 294121 - DNA, 670 bp, Homo sapiens
  misc_feature: GYAE6OF01EBPM4.36.2.A02.1.454.CMB.1.raw
  modified_base (178)..(178): a, c, t, g, unknown or other
  misc_feature (178)..(178): n is a, c, g, or t
  modified_base (195)..(195): a, c, t, g, unknown or other
  misc_feature (195)..(195): n is a, c, g, or t
  modified_base (214)..(214): a, c, t, g, unknown or other
  misc_feature (214)..(214): n is a, c, g, or t
  modified_base (514)..(514): a, c, t, g, unknown or other
  misc_feature (514)..(514): n is a, c, g, or t
tcagtacgctgtctcacgaccggtgctcgatttagactcatctacaggggagctctgagagaggagcccagccctgggatttttcaggttgtttttcatttggtgatcaggactgaacagagagaactcacatggagtttgggctgagcggtgtgtttctaggtgctaatttaaaggntcagtgtgaggtgcagntggttggagtcgtgggggngtcttggacagccggtgggggtccctagacgtctcttccgtgtcgcagccttgtggtactttccacctttagccagtctatcgcctatcgtccgtcgggtcccgacgcggtccgtaccggaaggggaacggtacggtggtaggtcgggtcttcggtattagtaggtaggtaagttgggttacgttaactaacgaaaacgtcgcacgcctcggtagaaccgggtccgcttacgactactctaccgagtactacttaactaccgaacgacgtctactcgttattctacctagaaccttaaanacgaaccgtacgtccgtaggtacggtcggacccggaacggacctaccgtacgttattaacgttagttacggaacgtaagggttaaggttcggggggtaggggtacgggtcggggttaccttaccggttcgggtttgggtttacggtttcggacggg

SEQ ID NO: 294122 - DNA, 531 bp, Homo sapiens
  misc_feature: GYAE6OF01E11QC.36.2.A02.1.454.CMB.1.raw
  modified_base (335)..(335): a, c, t, g, unknown or other
  misc_feature (335)..(335): n is a, c, g, or t
  modified_base (411)..(411): a, c, t, g, unknown or other
  misc_feature (411)..(411): n is a, c, g, or t
tcagtacgctgtctcacgaccggtgctcgatttagactcatctacagggggaggaactgctcagttaggacccagacggaaccatggaagcccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcactccaccagggccactggtactcccagccacctttagnggcaggtgggtctgggacagagttcacttctcaccatcagcagcctgcagtctagagtatttgctagtttatactntacaacagtacatgacgtgtccttctctacgttcgggacggtacgggacctagggtaggaaggtagtaacgaaaacggtaacttggtacggctacggacctaaccgcttcgtggttaccc

SEQ ID NO: 294123 - DNA, 728 bp, Homo sapiens
  misc_feature: GYAE6OF01B8ZPS.36.2.A02.1.454.CMB.1.raw
tcagtacgctgtctcacgaccggtgctcgatttagactcatctacagggggaggtaactgctcgagttaggacccagacggaaccatggaagccccagcgcagcttctcttcctcctgctactctggctccagatatcactggagaaatagtgatgacgcagtctccagccaccctatctgtgtctccaggagaaagacgccaccctctcctgtacgggccagtcagagtgttagcagcaacgttagcctggtaccagcagaaacctggccaggttcccatcgctcatcatctagtggtgctactccaccgacgggcctacgtggtacctccccagtccctaccgtttaggtcggtccgtaaggttcggggttcgtaggggaacctaggtacgtttccaaccttctaccaacctacgtaccacggtaccaacggtccccgtaggtaccctaggttaccggttaaagtaacggttttacgtttttaggtaaccgtttaaggttttttaactttaaccgtttacggtaacctaaacgttaacgttaacgtaaagttcgtaaccggttccggtaccctttacgtaccggttaccgggtttcccggggaacgggtaaccgggggtaacccgtaaagggggtacgtaaacgggtaacttaaacccggtaaaaacgggtaaccgttgggtaccgggtacctacgggacccctaacggtacttccgtttacccgg

SEQ ID NO: 294124 - DNA, 675 bp, Homo sapiens
  misc_feature: GYAE6OF01BNGRY.36.2.A02.1.454.CMB.1.raw
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccaccctatctgtgtctccgaggagaaagcgcccaccctctcctggtacgggccagtcagngtgttagcagactaacttgcctggtaccagcaacgaacctggacctacggttcccaggctcatcatctagtggncactccacgacggacctagtacggtactaccgacgtccctaccgtttaggcggcgtagggttcgggtacgtcgggaactaggtacgttacacgtctacacctatcgagccgtacgtacctggtactagtacgtaggtaaacgtttacgttttacgacgttttaacggttttaacttaaccgttacggttaacctaaacgttaacgtaacttaaagtccgttaaccggttcgggtacccctttacgttacccgttacgggtttaccgggacgggtaaccgggtaaaccggtaggggtacggaacgtaacgtaaccggaaacgtaacggtggttaccgacgttaccgacctaacgttcttcggttcttacccg

SEQ ID NO: 294125 - DNA, 530 bp, Homo sapiens
  misc_feature: GYAE6OF01E0D6J.36.2.A02.1.454.CMB.1.raw
  modified_base (197)..(197): a, c, t, g, unknown or other
  misc_feature (197)..(197): n is a, c, g, or t
  modified_base (335)..(335): a, c, t, g, unknown or other
  misc_feature (335)..(335): n is a, c, g, or t
  modified_base (355)..(355): a, c, t, g, unknown or other
  misc_feature (355)..(355): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttgcctggtaccagcagaaacctggccaggttcccaggctcatcatctatggtgcatccaccgagggcccatggtactccccagcctacctttagnggcaggtggtctgggacagngttcactctcaccatcagcagcctgcagtctagaagtattttgactagtttattacgtgtacaacagtacaatgtactggtcctctctaccgtttcgggacggtagggaccgtaagggtggaagtacgtacgaaacggacgttggaggcgtggaccaaccgtatccgtgttaccc

SEQ ID NO: 294126 - DNA, 599 bp, Homo sapiens
  misc_feature: GYAE6OF01B9C91.36.2.A02.1.454.CMB.1.raw
  modified_base (295)..(295): a, c, t, g, unknown or other
  misc_feature (295)..(295): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtcncactccaccgacgggccacgtggtactcccagccctaccgtttagcggcagggtgggtctggggacaggagttcacgtctccgacctatcagcacgcctgctagtctgaagtagttttgacgttagttttattacgttgtaccaactagtaactaagtagtacgtcgggtcccttacgttccgtacgtttccgggacgggtaacggggtaacctaaaggggtaggaaggtaaccgtaacgtaaaaccggtaacggttacggtacgggtaccgtcgacctaacccgtagttccggttgttacccg

SEQ ID NO: 294127 - DNA, 775 bp, Homo sapiens
  misc_feature: GYAE6OF01B6E58.36.2.A02.1.454.CMB.1.raw
  modified_base (293)..(293): a, c, t, g, unknown or other
  misc_feature (293)..(293): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccacctctcctgtagggccagtcagagtgtagcagctaattagcctggtaccagcaagaacctggccacggtcccaggctcatcatctagtggtnactactccgaaccgtacgggacccacgttcggtactccccgacgtcccttaaccgttttaggcgggactagggttcggggtcgtacggggaactaggtaacgtttccaaccgtccgttaccaacccgtataccgaacggtacctacgggtccccgttaggacccgttaacgggtttccgtaaggggttaaaacgttttagttttttaccggaaccgtttttaaagggtttttaacccttttaaccggttaccggttaaaccttaaaacggtaaccgtttaaccgtaaacgtttaccggtaaccccggttcgggttaaccccttaccgttacccggtttaaccgggttttcggggaacccgggggtaaacgggtaaacccgtaaagggggtacggaaacggtaacgttaaacccggaaaccggtacggttgggtaccggaccttcggaaccctaacccttgttacccggtttgtttaaccccg

SEQ ID NO: 294128 - DNA, 633 bp, Homo sapiens
  misc_feature: GYAE6OF01BNWDM.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccgaggagaaagcgtcccaccctctcctggtacgggccagtcagagtgttagcagcaacttgcctggtaccagcaacgaaacctggaccaggttcccaggctcgatcatctatggcgctactcccgacgacgggcctacgtcggtacctcccgacgtccgtaccgtttaggtcggcgtagggttcgggtacgtgggaactaggtacgttacaccgttcctacacctagtaccagccacgcctgactacgtcgtaggtagttatttcgacgtttagttttacgttacgtacgtacgtaactacgtaactaagttaccgacgttaccgtaccttccttacgttaccggtttacggaccggggtaacgggaccgtaagggtacggtagtaccgtaacgaaacggtcgttaggtacggaccgttacgaccgtacgttcctgttacgttcccg

SEQ ID NO: 294129 - DNA, 577 bp, Homo sapiens
  misc_feature: GYAE6OF01EY25C.36.2.A02.1.454.CMB.1.raw
  modified_base (364)..(364): a, c, t, g, unknown or other
  misc_feature (364)..(364): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgtagcagcaacttagcctggtaccagcagaaacctggccaggttcccaggctcatcatctatggtgcatccacagggccacgtggtactccccagcctacctttagcggcagtcgggtctgggacagagttcactcncaccatcagcagcctgctagtcgtgtaagtattttggcttaagttttacttactgtactaacgtagtacaatgaccgttgggtacccttcttacctacgttttcgggaccgggaaggggtaacccgtaaaggggtggtaaggtaactaaccgaaaaccggtaacgttcggtagggaccttacgggaccctaacccacttccgtcgtttacccg

SEQ ID NO: 294130 - DNA, 655 bp, Homo sapiens
  misc_feature: GYAE6OF01CPEHI.36.2.A02.1.454.CMB.1.raw
tcagtacgctgtctcacgaccggtgctcgatttagactcatctacaggggggaggaactgctcagttaggacccagacggaaccatggaagccccagcgcagcttctcttcctcctgctactctggctcccagatatcactggagaaatagtgatgacgcagtctccagcccaccctatctgtgtctccgagggagaaaagcgcccaccctctcctggtacgggccagtcagtagtgttagcagacaacgttacgccttaggtaccaggcaacggaaaacccgtgggaccctaacgggttcccaaggtctacactcctaatctagtgggctaccactcccgaccgaacgggcctacgtaggtactcccgacgccttacgttagcggctagggtcggtacgtaggacaggtacgtttccacttcgtaccacctataccgagaccgacgtccctagcgacgttcgtaagtaaagtttgttttacggtacctttaaaggttttacttacgttacgtaacctaataacgttaactaacgtacgtaccgttacggtcccttacgtacgttaccggtttcgggacggtaacgggaccgtaagggacgaagtacgaacgtaaacggtcgttaggtcggactcgacccatacttgtcgttacc

SEQ ID NO: 294131 - DNA, 595 bp, Homo sapiens
  misc_feature: GYAE6OF01E3ZTB.36.2.A02.1.454.CMB.1.raw
  modified_base (398)..(398): a, c, t, g, unknown or other
  misc_feature (398)..(398): n is a, c, g, or t
  modified_base (554)..(554): a, c, t, g, unknown or other
  misc_feature (554)..(554): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagcgtgtcgttttctaggtggctattttaaaaggtgtccagtgtgaggtgcagctggttggagtcgtgggggaggcttggtacagccgtggggggtccctgagactctcctgtgcagcctctggacttcacctttagccagctatcgccatcgaccgttcgggcccaccgacggcctaccggaaggggtaacgggactggaggtcgggtctcggttctagttaggtggtaagtggtaggttataacaaactcgnacgtcctccgtagaacggccgcttcgaccatctaccagacgacttataccaagtacgactacgtctagtactctgacaatagaacagacctggaacgtcgaccgaggaccaccggtaccctatagttacttggtcgagtaaagtggggtagggggnggtacgggggtactaccgttcggtcggtcgtttgtaaccgg

SEQ ID NO: 294132 - DNA, 675 bp, Homo sapiens
  misc_feature: GYAE6OF01D8G9Q.36.2.A02.1.454.CMB.1.raw
  modified_base (176)..(176): a, c, t, g, unknown or other
  misc_feature (176)..(176): n is a, c, g, or t
  modified_base (182)..(182): a, c, t, g, unknown or other
  misc_feature (182)..(182): n is a, c, g, or t
  modified_base (214)..(214): a, c, t, g, unknown or other
  misc_feature (214)..(214): n is a, c, g, or t
  modified_base (243)..(243): a, c, t, g, unknown or other
  misc_feature (243)..(243): n is a, c, g, or t
  modified_base (271)..(271): a, c, t, g, unknown or other
  misc_feature (271)..(271): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagcggtcgtgttctaggtcgctaatttaaggntcagtntgagtgcagctgtgagtgtggggagcttgagngcgtcggtcgtgacgtctcgtcgtgtgcncgctcgtcgtacttactaccgttagtcngctatcgtctacgtcgtccgtcggtccgccgcgtcgtacggacggaggtacgtaggtggtcggtcgtcgtcgtagttaggtaggtaggttggtaggttacgtaacgtaacgtaacgacgtacgtccgtacggtacggtaccggtccgtaccgttaccgtaccgtacctccgtacgtagtacgtaacgttacgtacgaagtacgtactacctacgttacgtacgtcgtacgtaataacgtaacgtaaccgtacgtacgtacgtacggtacgacggtacggaccggtacccgtaccgttaacgttacgttagttacggttacggtaggtaacgggttacggggttacggggtacggggttacgggttcggttaccgttacgggttacggttcggttccggttacgg

SEQ ID NO: 294133 - DNA, 570 bp, Homo sapiens
  misc_feature: GYAE6OF01AXV1I.36.2.A02.1.454.CMB.1.raw
  modified_base (403)..(403): a, c, t, g, unknown or other
  misc_feature (403)..(403): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccacgtggtactcccagccctacctttagtggcaggtcggggtctgggacagtacgttcacttctcaccatcacgcagccttgcagtctagtaagtnttttggctaagtttattacttgtacaactagtaacaatgacctcgggtccttactcctacgttttccggacgggaacggggaccgtaagggttacgggaaggtacgttaccgaaaacgggtaccttgggtacggtcgttcggactacccgtacttcgtgtttacccg

SEQ ID NO: 294134 - DNA, 694 bp, Homo sapiens
  misc_feature: GYAE6OF01AZE6K.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccgaggaagaaagcgacccaccctcctcctggacgggccagtcagagtgttagctagactaactacgccgtaggtaaccagacaacgtaaaccgtcggaccgtacggtttccccgaggtcctacacttacacttacgtatgactaacgactaccctaacgacgggtaccacgtcggactactcccgacgtccgtaaggttcaggtcggacgtaggtcgggtctaggggactaagtcttacacgttcctaccacgactcacgacacgtaccctagaaccgtagtaacgttattgactttagttactacgttcgactagtccgaggtacccggtaaggttacccgggttccggttttaccccggggaacccgtaacggggtaaacccgtaaaggtacggttaaacttaacggttaaaccgaaaaaccgggtaccggtttggaccgggttactacgggtaacccgacttacggttcctacggtttaccttacgtacccttacccggtacccc

SEQ ID NO: 294135 - DNA, 519 bp, Homo sapiens
  misc_feature: GYAE6OF01DGDOE.36.2.A02.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (350)..(350): a, c, t, g, unknown or other
  misc_feature (350)..(350): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgtagcagcaacttagcctggtaccagcagaaacctggccaggttcccaggctcatcatctatggtncatccaccagggccatggtactcccagccacctttagtggcaggtgggtctgggacngtagttcactcgtcaccatcagcagctgcagtctagaagtattttgctagtttattactgtacaactagtacaatggactggtcctctcctacgtttcggcggtacgggacgaagggtggagtagtacgaaacgaacttggtggacgtgacccaccagtctgttacccg

SEQ ID NO: 294136 - DNA, 537 bp, Homo sapiens
  misc_feature: GYAE6OF01BJKU0.36.2.A02.1.454.CMB.1.raw
  modified_base (298)..(298): a, c, t, g, unknown or other
  misc_feature (298)..(298): n is a, c, g, or t
  modified_base (334)..(334): a, c, t, g, unknown or other
  misc_feature (334)..(334): n is a, c, g, or t
tcagtacgctgtctcacgaccggtgctcgatttagactcatctacaggggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagagcccaccctctcctggtagggccagtcagagtgttagcagcaacttagcctggtaccagcagaaacctggccaggttcccaggctcatcatctatggtncatccacagggccatggtatcccagcctactttagngcagtggtctgggacagagttcactctcacatcagcagcctgcagtctagagtatttgctagtttatacgtgtacaatacgtacaatcgactcgggtcctcgtactacggtttcgggacgggtacgggtacccgtaaagggtcggaagtacgtacgaaaacggtactacggtggacgtcgacctacgtacgtccgttgttacc

SEQ ID NO: 294137 - DNA, 774 bp, Homo sapiens
  misc_feature: GYAE6OF01A851W.36.2.A02.1.454.CMB.1.raw
  modified_base (225)..(225): a, c, t, g, unknown or other
  misc_feature (225)..(225): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggtctttttcttgtggcttattttaaaaggtgtccagtgtgaggtgcagctgttggagtcgtggggagcttggtacngccgtgggggtccctgagactctcctgtcgcacgcctcgtggacttcctacctttagcagctatcgccatcgaccgtcgggtcccgccgacggcctccggaaggggaacgggtacctggggaggttcggggttccttcggttacgttagtttagggtacgggtaaggtttgggttagggtttaaactaacctaaaaccgttacgaccgtacggtccccgttaccggtaggaaccggggtcccgtcgtttacccgaaccctacttacccgtaccgaagtaaccggtaaccttaacgttaacccgaaagtacgacctaccttccgttagttaccgttacctacgaactaaaacttcgaaaccgacggtaccccgtaggtacggtccggaacccgggaacgggacccgtaacccgggtaccccttaagttaacgtttaagtttacggtacggtaaccggtaaaggttcgggggttaggggggggtagggttacggggggtaccctttacccgggttaccgggttcgggtttccgggttttcggtaacccggg

SEQ ID NO: 294138 - DNA, 848 bp, Homo sapiens
  misc_feature: GYAE6OF01DLB3D.36.2.A02.1.454.CMB.1.raw
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggtctttttctgtggcttattttaaaaggtgtccagtgtgaggtgcagctggttggagtcgtgggggaggcttggtacagccgtgggggtccctgagactctcctgtgcacgcctcgtggacttcctacctttagcagtctatcgccagtcgaccgtgggtcccgcgacggcctaccggaaggggaacgggacgtgggacggttcgggtccttcggtcttaagttaggtaggtaaaggttgggttaggttaaactaaccgtaaaacgttaccggaccgtaacggtccccgttacccgggtaagggtaaacccgggggtccccgtaccgtttaccgaacccgtaaccgttacccgttaccccgaaaggtaaccggttaaaccctttaaaccgtttaaccccgaaaaggtaaccggtaacctaacccgttaccgttacgtttaacgttacccgttaacggaaaccttaaaacgtacggtaaacccgtaaacggtccccgttagggtaaccggttaccgggaaccccgggaacgggtaacccgtaacccgggtaacccctttaaagttaaaccgtttagttacgggttaacggaaccggttaaagggttcggggggttaaggggggggtaccgggttacgggggtacccgttttaaccggtcccggtttagggggtttcccggttttagggtaaaccccgggg

SEQ ID NO: 294139 - DNA, 676 bp, Homo sapiens
  misc_feature: GYAE6OF01DZ8XF.36.2.A02.1.454.CMB.1.raw
  modified_base (164)..(164): a, c, t, g, unknown or other
  misc_feature (164)..(164): n is a, c, g, or t
  modified_base (168)..(168): a, c, t, g, unknown or other
  misc_feature (168)..(168): n is a, c, g, or t
  modified_base (194)..(194): a, c, t, g, unknown or other
  misc_feature (194)..(194): n is a, c, g, or t
  modified_base (310)..(310): a, c, t, g, unknown or other
  misc_feature (310)..(310): n is a, c, g, or t
  modified_base (632)..(632): a, c, t, g, unknown or other
  misc_feature (632)..(632): n is a, c, g, or t
  modified_base (650)..(650): a, c, t, g, unknown or other
  misc_feature (650)..(650): n is a, c, g, or t
  modified_base (666)..(666): a, c, t, g, unknown or other
  misc_feature (666)..(666): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtcnccancccacctatctgtgtctaccgagganaaaagcgcccaccctctcctggtacgggcccagtcaggtagttgtacgcagctaaacgttgcctggtaccagcaagaaccgtgaccaagttcccaggtctcatcatctagtcggtnacactcccaacgacgggcctaacgttgtacctaccccgagtacccttaccgttttaggcggcgtaagggttcgggtacgtacggggaaacgtacgtaacggtttcccaaccttccgtaaccgtaacctaacgttctaacggaccgaaccgtaccgtgtaaccgtacggtttacgtaagtaaacggtttacgtttcgtaatttacggtttttaactccgttaaggttaacctaaactaggtttaaccaaagtttccggtaaccgtgtacccttccttacgtaccgtttcgggacgggaaccggtaaaccgtaggtacggtaanaccgtaaacgaacgtagngtcgacgtcgacactnttcgagttcc

SEQ ID NO: 294140 - DNA, 547 bp, Homo sapiens
  misc_feature: GYAE6OF01CD0W0.36.2.A02.1.454.CMB.1.raw
  modified_base (197)..(197): a, c, t, g, unknown or other
  misc_feature (197)..(197): n is a, c, g, or t
  modified_base (340)..(340): a, c, t, g, unknown or other
  misc_feature (340)..(340): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagctaacttagcctggtaccagcagaaacctggccaggttcccaggctcatcatctagtggtgcatccacaggggccacgtggtactccccagtccctacctttagnggcaggtcggtcgtgggacaggtagttcacttctcaccatccagcacgcctgcagttctagtaagttatttcgacgttagttttacttactgtacaactaagttacaattgactggtctctctacgtttcggcggtaggaaccgtagggtgaagtactaaccgaaagtacgtggtaggtcgtcgaccaaccgtcttcgtcgttaccg

SEQ ID NO: 294141 - DNA, 701 bp, Homo sapiens
  misc_feature: GYAE6OF01B540B.36.2.A02.1.454.CMB.1.raw
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggtctttttcttgtggctattttaaaaggtgtccagtgtgaggtgcagctgttggagtcgtgggggagcttggtacagccgtggggggtccctgagactctccgtgtgcagcctctggtacttcctacctttagcagctatcgccatcgaccgtcggggtcccgccgacggcctccggaagggggaacgggctgggaggttcgggtccttcggtacttagttaggtaggtaaggtgggttaggttaataacgtaaacgtaccggctaacggcccttccgggtaggtaaccggggcccgtctttaccaccctactcctacccgaaggtacgtaacttaacgttaccaacggtaacgacctaacttccgttagttactccgtagaactaaatacggaaaccacggtccgtaggtacggtacgggacccggaacgggaccgaaccggtacccttaagttaacttagttacggtacgacggtaaagggttggggtagggggggtacggttcggggggtaccttaccggtccgttcgggttcggtttcggtaaccggg

SEQ ID NO: 294142 - DNA, 734 bp, Homo sapiens
  misc_feature: GYAE6OF01CCS4Q.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctctgctactctggctcccagatatcactggagaaatagtgatgacgcagtctccagcccaccctatctgtgtctcgaggagaagcgcccacctctccgtggtacggccagtcagtagtgttagcagactaacttacgccgtaggaccagacgaacgtaaaccgtcggaccgtacggttacccgaggtcctacaactcctattctagtgggtcgacctactacccgaacgacgggaccctacggttacggtacctaccccgacgtacccttaaccgtttaggcggtacgtagggtcggggttacgtacgggaccaggtacgttcaccgttctaccgacctatccgaagccacggtccttgaccgtacggtacgtaaggtaacgtttagttttcgaccgttttaagttttacttacgtacgttaaccaaagttaacgttaactaacgttacggtaaccgtttccgggtacccctttcgttaacccgttaccgggtttaccgggaaccggggtaacgggtaacccggtaaaggggtacggaacgttaacggtaaaccggaaaaccggttacgttgggtaccgtacggttacgacccgtaaccttcgttacgtttcccggttaaccc

SEQ ID NO: 294143 - DNA, 587 bp, Homo sapiens
  misc_feature: GYAE6OF01CWI4G.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtcgcatccacgacgggcctacgtacggtactcccaagtcctaaccgtttaggtcgctaggtcgggtctgggacaggacgtttcactcgtacacatcaacgcagccgtgacctagtctaggaaagttattttgacttaagtttttactacttacggtactaacgtagtaactaagtcgtaacgttggtcccttactctacgttttccggggaggtaacgggtacccgaaagggttggaacgtaacgtaccaaaacggtacagggttagtacgtacgactacccattcgtcgttacc

SEQ ID NO: 294144 - DNA, 639 bp, Homo sapiens
  misc_feature: GYAE6OF01EHL4O.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgatgcagtctccagccaccctatctgtgtctccaggagaaagngcccaccctctcctgtagggccagtcagagtgtagcagcaacttagcctggtaccagcagaacctggccaggttcccaggctcatcattctagtggtcgacactcccgaccgacgggccctacgtacggttacctccccgacgacccttaccgtttaggcgggtcaaggttcggggtactggggaactaaggtacgttcaacctccttaccacctatccgtaacgccacgtcctagcgtacgtagtagtaacgttattttgacttagttttattcgtttagtcgacgttacgtaaggttaacttaagttaaccgtcgggttacccgttacccgggttacgttaccgtttaccggggacggtacggggtaaccgtaagggtacggaagtacgtaacgaaacggtacgtggtaccggtactaccgacctactacgtcgttaccg

SEQ ID NO: 294145 - DNA, 595 bp, Homo sapiens
  misc_feature: GYAE6OF01BRNCM.36.2.A02.1.454.CMB.1.raw
  modified_base (337)..(337): a, c, t, g, unknown or other
  misc_feature (337)..(337): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggtcccaggctcatcatctatggtgcatccaccgacgggccacgttggtactcccagccctactttagnggctaggtcgggtctgggacaggtacgttcacttctaccacatccagcacgtcctgctagtctagtaaacgttagttttcgacttaagtttactttacgtagtactaactagttaacaagttacgtaccgtacgggtcccttcttaccgttccggttaccgggacggggtaacgggtaccgtaaaggggtacgggtaacgtacgtaacgaaacccggtagtggtacggtcgtacgacccaactcgttccgttgttacc

SEQ ID NO: 294146 - DNA, 715 bp, Homo sapiens
  misc_feature: GYAE6OF01BQGT9.36.2.A02.1.454.CMB.1.raw
  modified_base (212)..(212): a, c, t, g, unknown or other
  misc_feature (212)..(212): n is a, c, g, or t
  modified_base (238)..(238): a, c, t, g, unknown or other
  misc_feature (238)..(238): n is a, c, g, or t
  modified_base (296)..(296): a, c, t, g, unknown or other
  misc_feature (296)..(296): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcacgtggagaatagtgatgacgcagtctccagcccacctatctgtgtctccgaggaagaaacgcgtcccacccgtntccgtgtacggccagtcagagtgtancagctaacttagcctggtaccagcaacgaacctggacccgtaggttccccaggcctanactacgactttccgtagtcgggtcgcctacgtacccaaccgtacgggaccctacgtcgggtacctaccccgacgtcccctaccgttttaaggcggtacctagggttcggtacgtacgggacctaggtacttaccgaccttccgtaaccacctagtacccgtacgaccgtaccgtaccgtgaccgtagttaccgtacgtaaacgtttacgttttacgtaacgtttaacgttttacgttaccgttacgtaactaacgttaacgggttaacaacgttacggtaacgtcggtacccttacgttccggtaccggtttcggacgggtaccggtaaccggtaagggtacgtaacgtaacgtaaccgtaacgtaaccggttgtacggtctacggcctaacttactccgttagttacccccccccccg

SEQ ID NO: 294147 - DNA, 580 bp, Homo sapiens
  misc_feature: GYAE6OF01ENKH1.36.2.A02.1.454.CMB.1.raw
  modified_base (555)..(555): a, c, t, g, unknown or other
  misc_feature (555)..(555): n is a, c, g, or t
  modified_base (570)..(570): a, c, t, g, unknown or other
  misc_feature (570)..(570): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagacgcccaccctctccgtgtagggccagtcagagtgttagcagcaacttagcctggtaccagcaagaaacctcggcctaggttcccaggcctcactcatctagtggtcgcactccaccgacgggcccacgttggtacctcccagtccctaccgtttagcggctacggtgggtcgtggggactaggtacgttcaccttcgtacaccatacgacgcacgtcctgacgtagtcgtagtaagttattttcgactttagtttacttactgtactaactagtacaatcgactcggtaccttcgtctacggttacgggacggtaacggaccgtaaggtggaacgtacgtaacgaaacgtacgtaggngtacgtcgacctaancttcgtgtcc

SEQ ID NO: 294148 - DNA, 779 bp, Homo sapiens
  misc_feature: GYAE6OF01CMOH7.36.2.A02.1.454.CMB.1.raw
  modified_base (340)..(340): a, c, t, g, unknown or other
  misc_feature (340)..(340): n is a, c, g, or t
tcagtacgctgtctcacgaccggtgctcgatttagactcatctacagggggaggaactgctcagttaggacccagacggaaccatggaagccccagcgcagcttctcttcctcctgctactctggcctccagatatccatggaagaaatagtgatgacgcagtctccagcccaccctatcgtgtgtctcgaggaagaacgacgcccaccctctccgtggaacggccagtcagtaggtgttagcagtacaaacttgccgttaggaccgagaccgaacgaaaccgtcggacctaacgggttccccaacggcctactactacctatacgttagtcgggtaccnctaaccgttacccgaacccggaccgggtaccctaacggttcggtaacctaccccgtacgtacccgttaacccgttttgggacggtacggtacggggttcggggttaccggtacgggtaccgaaggtacgtttacccaacgttccccgaccgtaaccctaagttaccggaacgacccgtaccggacccgttggaccctaaggttccgtaaaggtaaacgtttagttttagtaccggtttaagttttaacctttaacgtcgttaaacccgtaatacggttaactacggttacgtaccgtacgtcctttacgtaccttaacggggttaccggaacggggtaaacggtcggtaaaggtacggaacgttaaaccgtaagttaaacccggtaggttaccggtgtaccgtcgaacccgactttaacgtccggtttccttaaccccg

SEQ ID NO: 294149 - DNA, 588 bp, Homo sapiens
  misc_feature: GYAE6OF01DWNCT.36.2.A02.1.454.CMB.1.raw
  modified_base (167)..(167): a, c, t, g, unknown or other
  misc_feature (167)..(167): n is a, c, g, or t
  modified_base (205)..(205): a, c, t, g, unknown or other
  misc_feature (205)..(205): n is a, c, g, or t
  modified_base (313)..(313): a, c, t, g, unknown or other
  misc_feature (313)..(313): n is a, c, g, or t
  modified_base (323)..(323): a, c, t, g, unknown or other
  misc_feature (323)..(323): n is a, c, g, or t
  modified_base (348)..(348): a, c, t, g, unknown or other
  misc_feature (348)..(348): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
tcagtacgctgtctcacgaccggtgctcgatttagactcatctacagggggaggaactgctcagttaggacccagacggaaccatggaagccccagcgcagcttctcttcctcctgctactctggcctcccagatatcacgtggaagaaatagtgatgacgcagtcnccagcccaccctatctgtgtctccgaggaagaaaagcncccaccctctcctaggtacgggccagtcagtagtgttagcagactaacttagcctggtaccagcaagaaacctggacctaacggttcccaggctcatcattcagtgcncactccacgnggcagtgactccgatcctacttagngacaggttggtcgtagggactagtagttcactcctacacaatcagcagcctgactgtctagtaaattntttgactttaagttactacgttanacaactagtaactaagtgtaaccgttcggtcccttacgttaccgtacggtttcggggaacccgggtaaaggggtaaccctaaggggtaggtaacgtaaactaacgtaacggtaacgtgtcggaactcgatacccgattctcgttaacc

SEQ ID NO: 294150 - DNA, 881 bp, Homo sapiens
  misc_feature: GYAE6OF01AEDPW.36.2.A02.1.454.CMB.1.raw
  modified_base (243)..(243): a, c, t, g, unknown or other
  misc_feature (243)..(243): n is a, c, g, or t
  modified_base (853)..(853): a, c, t, g, unknown or other
  misc_feature (853)..(853): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggaagaaatagtgatgacgcagtcctccagccctaccctatcgtgtcgtctaccgaggagaaacgcgcccaccctctccgtggtacggccagtcagagtgtancagcaacgttcgccgtacggtaccagacgaacgaaccgtcggaccgtacggttcccgaggcctcgtactcattactaggtggtcgacaccgtacccgacgtacgggtacctacgtcggtaccctcccgggacggtccggtacgacggttacgggcgtacggggtcgggtacggtacgggtacgtaagggttaccgttaccgaccgtccctaccgaacccgtactaccgaccggaccgaccggttccgtaggaaccgtaaggttaacgggttaacggtaaacggttttacccgtttacgggttaacttttaagggtttttaacgtttaacgtttacccgggtaacgaaacggtttaccttaaaacggttttaaaggtttaaaaccccttaccggggttaccccgggttacccggtttaccccgggtttaacccggttaacccgggtttaccggggggaaaccccgggggttaagggggtaaaccccgggttaaaagggggttagggtaaaaccccggttaaccgggtttaaaacccgggaaaaacccgggtttgggtttacccggggtacgggttacccctaaaccgggtacccgttaaaaccccggtttnttttaaccccgggttcggtttttaaccc

SEQ ID NO: 294151 - DNA, 775 bp, Homo sapiens
  misc_feature: GYAE6OF01B3MKS.36.2.A02.1.454.CMB.1.raw
  modified_base (207)..(207): a, c, t, g, unknown or other
  misc_feature (207)..(207): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcacgtggaagaaatagtgatgacgcagtctccacgccctaccctatctgtcgtctccgaggaagaaagacncccaccctctccgtggtacggccagtcagtagtgttacgcagactaacgttacgccgtacggtaaccgagacgaaacgtaaacccgtcggacccgtacggttcccgacggtcctacactcacttcgtagtggtacactacgtacccgaacggtaccgggaccctacgttcggtacctacccgacgtacccttaacggtttacgcgggtacgtaggggtccggtacggtacgggactacggtacgttacctacgtacctaccgacctacgtcgacgcgtaccgtccgtgacgtaacgtcgttaagtaagtttcgtttacgtacttttaaggtttacttaccgtacggttaaacctaaacgttaaccgttaaacgacgttccgggtaacccgttccgttacccttccggttaccgtttaaccgggttcccggggaaacgggggttaaacccggtaacggttaacgggggtaacgtaaaccggtaacgttaaaccccggaaaccgggtcccgggttacgtaccgttaccggacccgttaaccgtcgtttaccgtttcggtaccccttaccg

SEQ ID NO: 294152 - DNA, 666 bp, Homo sapiens
  misc_feature: GYAE6OF01B0S76.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccaccctatctgtgtctccgaggagaaagcgcccaccctctcctgtacgggccagtcagagtgtagcagactaacttgccgtggtaccagacaagaaccgtggccacggtcccaggtcctcatcattcgtagtggtgcactcccgacgacgggtaccacgttcggtacctccccgacgtcccttaccgtttaggcggacgtaggggttcggtacgtgggaactaggtacgttccacctcgtaccactactacgacgccacgtcctagacctagttctaggtaaacgtttgttttagactttaaggttttacttacgttacgtaactaaacgttaagtaacgtaagttcggtaaccttcgggtacccttcgttaccgttaccggttaccgggacgggtaacgggtaacggtagggtacggaacgtacgtaaaccgaaacgggttaccgttgggtaacggtccttacgacccgttaacctcgttaccgttcgttacccg

SEQ ID NO: 294153 - DNA, 750 bp, Homo sapiens
  misc_feature: GYAE6OF01BS0QC.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatactcactggagaaatagtgatgacgcagtctccagcccaccctatctgtgtctccgaggagaaagcgtcccaccctctccgtggtacgggccagtcagtagtgttagcagctaacttagccttggtaccaggcaagaacccgtggccacggttcccaggcctcatccatctagtggtcgcgtacctccgaccgagggccctacgtcggtaacctcccgaacgtccctaaccgtttaggtcggactacgggtgggtccgtaggggacctaaggtactttccgaaccgttccgtaccaaccgtacaccgtacgtaccgaaccgtccgtacggtcgtaacggttaccgtaaggttaaacgtttacgttttacggtacttttaaacggtttaacgttttaacgtaccgttaaccgaaacgttaacgttaaacccgaagtttaccgggtaaacgttcccgggttacccctttacgtttaccccgttaaccgggttttaccgggaaccggggtaacggggtaacccgtaaaggggttacgggaacgtaaccgtaacccggtaaaacgtcggttaccggtaggtaccgtacggtaccaacccggttacttccgttggttaccc

SEQ ID NO: 294154 - DNA, 729 bp, Homo sapiens
  misc_feature: GYAE6OF01CR2VS.36.2.A02.1.454.CMB.1.raw
  modified_base (680)..(680): a, c, t, g, unknown or other
  misc_feature (680)..(680): n is a, c, g, or t
  modified_base (722)..(722): a, c, t, g, unknown or other
  misc_feature (722)..(722): n is a, c, g, or t
tcagtacgctgtctcacgaccggtgctcgatttagactcatctacgagggggaggaactgctcagttaggacccagacggaaccatggaagccccagcgcagcttctcttcctcctgctactctggctcccagatatcactggagaaatgtgatgacgcagtcctccagcccaccctatctgtcgtcctacgaggaagaacgcgcccaccctctccgtggtacggccagtcgagtagtgtagcagactacgttcgcctacggtaccagacgaacgtaaccgtcggaccgtcggttaccgcggtacctacgtactacgtattccgtagttggacctaccacctacccggaccgacggggacccctaggttaccggtaaccctccgtaaccgaccctttacggtttaggccggacgttagggttcgggtcgtagggactaggttacgtcctaccgttacccaccgaacctgtacccgagacccgtaccgtccggtacgtacgttacggttacgtaacggttaagttttacgtttaacgtaccgttttaaagttttaaccgtacgtttaaccgtaacgtaaacgttaaacggttaactaaacggttcccgtaacgtttccggtaccctttacccgttacgtttaccggggtaccgggaacgggtaacggtaccgtaggggtanacgtaacgtacaacgtgtcggtgactacgactagtcttcgtnttacccg

SEQ ID NO: 294155 - DNA, 607 bp, Homo sapiens
  misc_feature: GYAE6OF01DAK25.36.2.A02.1.454.CMB.1.raw
  modified_base (285)..(285): a, c, t, g, unknown or other
  misc_feature (285)..(285): n is a, c, g, or t
  modified_base (301)..(301): a, c, t, g, unknown or other
  misc_feature (301)..(301): n is a, c, g, or t
  modified_base (310)..(310): a, c, t, g, unknown or other
  misc_feature (310)..(310): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctcagccacctatctgtgtctccaggagaagacgcccacctctcctgtacgggccagtcagagtgttagcagactaacgttagcctaggtaccagcaagaaacctggccaggttcccaggctnactctagtctatggtncatccacgngggcctacgtgtactccgacgtccaaccgtttaggcggtcgtacggtgggtcctgggacaggtagttcacgtctacaccatcagcacgcctgacagttacagtaagtctttacgcttagttttactactcgtaactaacgtacttaacgtaaagtgtaaccgtcgggtaccttcgttactaccggtttcggacggggtacgggtaaccaagggtcggtaacgaacggttaaccgaaaccggttaacgttcgggtacgtaccgtacggaacctaccgtaacttccgtaggtttacccc

SEQ ID NO: 294156 - DNA, 967 bp, Homo sapiens
  misc_feature: GYAE6OF01CG06M.36.2.A02.1.454.CMB.1.raw
  modified_base (181)..(181): a, c, t, g, unknown or other
  misc_feature (181)..(181): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccacctatctgtntctccaggagaaagcgccaccctcgtcctggtacgggccagtcagtagtgttagcagactaacttagccgtaggtaccagaccgaacgtaaacccgcggtacccgtaacgggtttaccccgagggtcctaccgtaacgtaccgttaaccgttcgttacggttcgggtacgtaccgtaccgttacccccgtaacccgggaccggggtacccctaaccggttcggtaacccgttaccccgtaaccgtaccccggttaaccgtttttacgggttcgggtaccggttaacgggttaccgggggtttaccgtaacggggggtacctaacgggttacggttttacccaaccgtttaccgtaccgaacccgttaaccgtaacccgtaacggacccgtaacgggtcccgttagggacccgttaaacgggttcccttaaggggttaaacgtttacgtttttaaccgggtaccgtttaaacggtttttttacccgtttaacggtttacggttaaaccttaaaccggttaaaccggtttaacccgttaaacggttaaccggttaccccggtttaccgggtaccccttttaccggttaccccggttttaacgggtttacccgggggaacccggggttaaaaccggggtaccccgggtttaaacgggggtaaccggtaaacgggttaaccttaaaacccggggaaaaccggtttaaccgggtacggtttaccgggaccccggtttacggaaccccgttttacccgtaacccgttttacgggttcccgttttaaacccgg

SEQ ID NO: 294157 - DNA, 691 bp, Homo sapiens
  misc_feature: GYAE6OF01A1NHN.36.2.A02.1.454.CMB.1.raw
  modified_base (413)..(413): a, c, t, g, unknown or other
  misc_feature (413)..(413): n is a, c, g, or t
  modified_base (663)..(663): a, c, t, g, unknown or other
  misc_feature (663)..(663): n is a, c, g, or t
tcagtacgctgtctcacgaccggtgctcgatttagactcatctacgagggggaggaactgctcagttaggacccagacggaaccatggaagccccagcgcagcttctcttcctcctgctactctggctccagatatcactggaagaaatagtgatgacgcagtctccagcccacctatctgtcgtctcgaggaagaaacgcgcccaccctctccgtaggtacggcctagtcaaggtagttgttaacgcgagctaacttacgccgtaggtaccagacgtaacggaaccgtcggaccgtaccgggttacccgaggtcctacagtactagttacgttacgtggtacgactaccgtacccgaaccggacggcctaacgtcggtaccctaccgtacgtacccgttacgttaggtcggnggtacggttcggtcgtagggactggtacttcacgttaccacactcacgagccacgtcacgcgttagtcgtagtagtttacgtttgacgtttaagttacgttacgtctaacgtaactaacgtactacggtacgtccggttacgtccttacgtaccggttaccggggttacggaccgggggtaacggtaaccgggttaggtaccgggaaataaaccggtaacgtaaccggtaggttcggacgtaccgtaacnccgttacctagttcccgtcgttaacccg

SEQ ID NO: 294158 - DNA, 846 bp, Homo sapiens
  misc_feature: GYAE6OF01BCIG6.36.2.A02.1.454.CMB.1.raw
  modified_base (147)..(147): a, c, t, g, unknown or other
  misc_feature (147)..(147): n is a, c, g, or t
tcagtacgctgtctcacgaccggtgctcgatttagactcatctacagggggaggaactgctcagttaggacccagacggaaccatggaacgccccagcgcagcttctcttcctcctgctactctggctcccagatatcacgtggaanaaatagtgatgacgcagtctccacgccctacctatctgtcgtcctaccgaggaagaaacgcgcccacctctcgtggtacggcctagtcaggtagttgtagcagactaactcgccgtacgtaccacgacgaaacgtaaccgtcggtaccgtaaccggttcccgaaggtcctactacgtctaacttccgttagttcgggtacacccgtactaccccgaaccggtaccgggaccctacggttaccggttaaccctacccccggtaacgtaccccgtttaacggtttacgggccggtacggttacggggttcggggtcggttacgggaacgttacggttacgtttacccgccgtttaccctaacccgtaaaccgtacgttaacccgaccgtaccgtcccggtaccgttacggtaccgttaacgtttacgtaaaggttaaacgttttaggttttacgtaaaccgttttttaagggtttaacctttacgtaacgttaaaccgtaaaccttaacgtttaaactaaccggttacggttacccgttacccgttaccgtttacccgttacggttaccggggttccggggtaaccgggtaacggggtaaccggtaaaggggtaccgtaaacgtaacccgtaaaccgttaaacgggttcgtagggtccgtaccgtaccacccgttaaccttcgttccgtttccggttaccc

SEQ ID NO: 294159 - DNA, 620 bp, Homo sapiens
  misc_feature: GYAE6OF01BP1X4.36.2.A02.1.454.CMB.1.raw
  modified_base (371)..(371): a, c, t, g, unknown or other
  misc_feature (371)..(371): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccaccctatctgtgtctccgaggagaaagagcccaccctctcctggtagggccagtcagagtgtagcagcaacttgcctggtaccagcaacgaaacctggccaggttcccaggctcactcatctagtggtcgcactcccgaccgacgggcccacgtcggtactccccgagccctaccgttttaggcggcgtaggttgggtcngggacaggtattcactctcaccatcacgcacgcctgctagtctagtaagttatttgacttagttttactacgtgtaaccaactaagttacaattgaccgttacgggccctttaccgttaccttacggtttccgggaaccggggtaacgggtaaccgtaggggtacgggaacggtaactaacccgaaaacggttaacgttgggtaccggtacgtacggacccaacccgtagtttcccgtgtttaaccccg

SEQ ID NO: 294160 - DNA, 798 bp, Homo sapiens
  misc_feature: GYAE6OF01BHIHX.36.2.A02.1.454.CMB.1.raw
  modified_base (89)..(89): a, c, t, g, unknown or other
  misc_feature (89)..(89): n is a, c, g, or t
  modified_base (373)..(373): a, c, t, g, unknown or other
  misc_feature (373)..(373): n is a, c, g, or t
  modified_base (376)..(376): a, c, t, g, unknown or other
  misc_feature (376)..(376): n is a, c, g, or t
  modified_base (517)..(517): a, c, t, g, unknown or other
  misc_feature (517)..(517): n is a, c, g, or t
  modified_base (523)..(523): a, c, t, g, unknown or other
  misc_feature (523)..(523): n is a, c, g, or t
  modified_base (533)..(533): a, c, t, g, unknown or other
  misc_feature (533)..(533): n is a, c, g, or t
tcagtacgctgtctcacgaccggtgctcgatttagactcatctacagggggagaactgctcagttaggacccagacggaaccatggaanccccagcgcagcttctcttcctctagctactctggcctaccagtatactcacgtgggaataaagttacggtgacgtcggaaccgtcgtacgttccgtaccacggtacccctaacccgttgtccgttgtacgttccgtacggaaggtaacggaaaacgtccggaccctaccccgttcttccggttaggaccggacctaggtcgaagtacggttgtacgacacgtactaacgtcgcgtacggtaccaggccaaacgacgtcggaccttacggtccgacgtctacanctnttacgtgtggtcacctaccaccggacggcctacgtaacgttcggtcctaccgtacgttaccgttacgtttacgggggtacccgttaggggtcggttaccggtacggaaagtcgttaccgtaccctacgtacctagtacccnggaacncgtacggacnccgtagtcgagttacgttaagttacgtttaccgttgttaacgtttaacgtttcgtaacggtacttaaacgtacgttaaccgtacgttaacggtaccgtttacgttacccggttactttaaccgggtttaccgttaacgggggtacccgggacgggggttaaaccgacggggttacggtaaccgtacggtaaccgttaaacggttacggcggttacgggttacaacccgtcggaacccttacttacgttaccgttcgtttaacccg

SEQ ID NO: 294161 - DNA, 774 bp, Homo sapiens
  misc_feature: GYAE6OF01CKH1U.36.2.A02.1.454.CMB.1.raw
  modified_base (310)..(310): a, c, t, g, unknown or other
  misc_feature (310)..(310): n is a, c, g, or t
  modified_base (579)..(579): a, c, t, g, unknown or other
  misc_feature (579)..(579): n is a, c, g, or t
tcagtacgctgtctcacgaccggtgctcgatttagactcatctacgagggggaggaactgctcagttaggacccagacggaacatggaagccccagcgcagcttctcttcctcctgctactctggcctcccagtatatcacgtaggaagaaatagtgatgacgcagtcctccacgccctacctatctgtcgtccgtacgaggaagaacgacgaccctaccctctcgtgtacggctagtacgagtagttgtagacacgactacgtcgcgtacgacagacgaactaacgtcggaccgtacgtccgagtctanactacgtattacgtagtcggtcacctaccgtaccgtaaccggacgggtaccctacggttcgtaacccgtccccggtaaccgtacccgtttacgggttagggccgtacgggttaagggtcgggttaccggtaacgggaacgtacgttacgtacctacgttaccccactacgtacgaccgacgtaccgacgtcccgtagtaccgttagttacgtaaggtaagttttcgttacgttacgtttaacgtttacgtttacgtaaccggtttaaanaacgttacgttaacgaacgttaccggtaacccgttacgggttcccttaccggtttacccgggtttaaccggggttacgggaacgggttaacccggggaaacggtacgggtaaggaaaccctaaacggtaaacccggtaaggtacgttcgggtacaacgggtactaacccgttcttacgtccgttcttaaaccccg

SEQ ID NO: 294162 - DNA, 739 bp, Homo sapiens
  misc_feature: GYAE6OF01ASSW4.36.2.A02.1.454.CMB.1.raw
  modified_base (477)..(477): a, c, t, g, unknown or other
  misc_feature (477)..(477): n is a, c, g, or t
  modified_base (720)..(720): a, c, t, g, unknown or other
  misc_feature (720)..(720): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccacgcccacctatctgtcgtctccaggagaaacgcgccacctctctggtacggccagtcgagtagtgtagcagactaacttagcccgttcgggtaacccagaccgaaacggaaacccgtcggacccgtacgggttccccgaggtcctacgactaccatttacgtacgtggtcgaccacgtaccccgaccggacgggaccctacgttcggtacctacccgaccgtacccttaccggtttggtcggccgttagggtcggggtcgtacgggacgtaggttacgttccaccgttcctacccaacctcgtacgaccncggtaactcccgtagtccgtaacgttcgtaagttaacgtttagttttcgactttaagttttacttacgtccgtaactaacgtagtaacagttacgaccggttcgtacccttcgttacccgtttcgggtttacccggggacgggtaacgggtacccggtaaaggggtagggaaacggtaacgttaacccgaaacggttaccggttcgggtacgggtacccttaccggtaccctaaacccggttnttccccgtttccgttaccg

SEQ ID NO: 294163 - DNA, 780 bp, Homo sapiens
  misc_feature: GYAE6OF01BAZQ0.36.2.A02.1.454.CMB.1.raw
  modified_base (179)..(179): a, c, t, g, unknown or other
  misc_feature (179)..(179): n is a, c, g, or t
  modified_base (201)..(201): a, c, t, g, unknown or other
  misc_feature (201)..(201): n is a, c, g, or t
  modified_base (541)..(541): a, c, t, g, unknown or other
  misc_feature (541)..(541): n is a, c, g, or t
tcagtacgctgtctcacgaccggtgctcgatttagactcatctacagggggaggaactgctcagttaggacccagacggaaccatggaagcccagcgcagcttctcttcctcctgctactctggcctcccagatatcacgtggaagaaatagtgatcgacgcagtctccagcccacctntctgtcgtcacgagagaacgcnccacctctcgtggtacggcagtgagtgtgtacgcagactatacgctagtaccgagacgaacgtaaccgtcggaccgtacggttacccgagtaccactactacgagttacgttaggtcgggttccaaccgaccgtcccggaaaccggaccgggcccttaacgtacccggttaaccaccccgttaaccggtacccttaacggttttacggacgggttaccggtaagggggttcggttaacgggtacggaacggtaccggttacgtcctaaacccggttctaaccgtacccgtacgaccgacgtccgtacgtcgtaccacgttacggtactaagtttaagttntttaacgttaacgtttaacgtttacttacgttacgtaaacgtacgtaacgttaacgtacgttaacggtacccttacgggttcccttaacggttaccgttaccggggtacggaaccgggtaacgggtaaccggtacgggttaagaaccgggttaaccgtaaaacggtaccggttaaacggtcgggttaacccgtacgtacgtaacccgtacgttacccggttaacgttcgtttaacccgg

SEQ ID NO: 294164 - DNA, 789 bp, Homo sapiens
  misc_feature: GYAE6OF01BR5CM.36.2.A02.1.454.CMB.1.raw
  modified_base (248)..(248): a, c, t, g, unknown or other
  misc_feature (248)..(248): n is a, c, g, or t
tcagtacgctgtctcacgaccggtgctcgatttagactcatctacaggggagctctgagagaggagcccagccctgggtattttcaggttgttttctatttggtgatcaggactgaacagagagaactcaccagtggtagtttgggctgagctggtctttttcttgtggtacttaagttttaaaaggtgtccgagttggtgaggtgcagcgttggttgggaggtcggtggggggaggtcgttggacgnggtccgggtcgggggtccctggacgtcctccgttccgtgtcgcgacgtcctcgtcgtacttcctaccgtttagctacgtctactcgacctagtccggtaccgtcggggtcccgccgtacggcccgtaccgggaaggggaacgggtacgtggggtacggtcgggttccgtcgttacgttaagttacggtaggtaggtttacgggtaggttaaactacgtaaacgtacggacgtaccgtcccgtacccggtaggacccgggtccccgttacttccgaaccctacgtaccgtaccgtaacgtaacgtaacttaacctaccgaaagaccgcctaccgttacgtagttacttacgtacgaactaacgtacgaaccgtacggaccgtagggtcgtaccggaccggtaacggacccggtaccgtaaccgtttagttacgttaaggttacggttagggtaacgggtaaaggttgggggggttacggggacggggttcggggttaccctacgggtttccggttgggttttcccgggtttagggtacccgg

SEQ ID NO: 294165 - DNA, 927 bp, Homo sapiens
  misc_feature: GYAE6OF01BAVVD.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccacctatctgtgtctcgaggagaagcgccacctctcctgtacgggccagtcagagtgttagcagcaacttagccgtaggtaccagcaagtaaacctcgggaccctagggttccccgagggtcctacacttaccacgtttcctagttggggtctaccgaccttacccgacccggaaccggggccctaacgttcgggttaacccgttccccaacggttccccttaacccggtttttaaggtccggggtaccgtaagggggttcgggggttacgtacgggggtaacctaagggttaaccggtttccctaacccggtttaccctacccgaaaccccgttaacttacccgaacgggtcccgtaaccggtcccccggttaccggtaccgttaacggttacccggttaagggttaaaggtttaccgtttttttacgggaacccgtttttaaaggttttttaacttttaacccggttttaacgtaacccgttaaacgtttaaaccggtttaaacttaaaccggttaaccgggtaacccggtttcccgggttcccccgtttaacgtttaccccgggttttacccgggtttaaccgggggtaaccgggggtaaaccggggttaaaccggggttaaaccgggggaaggtttaaaccggtaaaccgggttaaacccggtaaaaccggttacggggtttacgggtaccgggttaaccggttaccggaacccgttaacccgttaggtttcccgtttaccggttttaacccg

SEQ ID NO: 294166 - DNA, 814 bp, Homo sapiens
  misc_feature: GYAE6OF01BOT2W.36.2.A02.1.454.CMB.1.raw
  modified_base (144)..(144): a, c, t, g, unknown or other
  misc_feature (144)..(144): n is a, c, g, or t
  modified_base (393)..(393): a, c, t, g, unknown or other
  misc_feature (393)..(393): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactgganaaatagtgatgacgcagtcctccacgcccaccctatctgtcgtctccgaaggaagaaacgcaccctaccctccttccgtagggtacggccagtacaggtagttggttagccaagtacctaacgttacgccgtacggtaccagaccaaacgtaaccgtcgggacccgtacggttcccgaaggtccctactaactcctattacgtagtcgggtcaccgactacccgaccgggacgcctacgtcggtaaccncccgtaaccgtaccccgttacggtttaggccggtacgtacgggtttcggaggtaccgggaactacggttaccgttaccctacgttaccctaaccaactccgtaaacacgtaccgtaccgaccgtgtaaccgtggttaaccttagggttaacgttttacgtttagttacggttttaactttttagtaccgtttaacggtaaacctaacgtttaaacgttgtaacggttaccgtacccggtttacccgttaccgttttacccgtttaaccgggttaccgggttaacccggggaacgggttaaaccgggggaaccgggtttaaggggaaccggttaaacgaaacgggtaaacccgttaacgggttacgtgggtacccgtaacgtccgttaacccgtaccgttacggttccctttcgttaccccg

SEQ ID NO: 294167 - DNA, 647 bp, Homo sapiens
  misc_feature: GYAE6OF01BZVOH.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagacgccaccctctcctgtagggccagtcagagtgttagcagcaacttagcctggtaccagcaagaacctggccaggttcccaggctcatcatctagtggtcgcagtcccacgacgggcccacgtggtactccccgagcccttaaccgtttaggcggacgtagggttcgggtacgtagggactaggtagttccaccttctacacctatcagccagcctagctagtctaggtaacttagttttcgacgtttaagtttacgttacgtcgttaacaacgtaagttaacaagttcggtaccgttacggtcccttacgttaccgttaccgggtttacgggaaccgggacgggtaaacccgtaggggtacgggaacgtaacgttaaacgaaaccgggtacgtgggttaaccgggcttaaccgggaccttaaacccggtcgtttcgttcggtttaccccg

SEQ ID NO: 294168 - DNA, 792 bp, Homo sapiens
  misc_feature: GYAE6OF01A6RDQ.36.2.A02.1.454.CMB.1.raw
tcagtacgctgtctcacgaccggtgctcgatttagactcatctacaggggagctctgagagaggagcccagccctgggattttcaggttgttttcattttggtgatcaggactgaacagagagaactcaccatggaggtttgggctgagcgtggtctttttcttgtggtcttaagtttttaaaaggtgtccagtgtggaggtgcagctggttggagtcgtgggggagcgttggtacaggtccgtggggggtccctggacgacctctcctggtgcacgtccttcgtggtacttcctacctttagactacgtctatcgcctagtcgaccgtcgggtcccgccgtacggcctaccggagggggaacgggacgtgggtaggttcgggttcctacggttcgttagttagggtaggtaagtttgggtaggtttaactaaccgtaaaacttacggacctaacggtcccgttaccgggtaggtaaccggggtcccgtccttaccgtaacccgtacgttacccgtaccgaacgtacgtaacctttaaccgttaaccgaaacgtacggacccttaacgttccgttagttacttacgtacgaactaaacgtacgaaacctacggtcccgttaggaacggttccggaacccggtaacggaccccgtaaccgggtacccttaagttaacgtttacttacgggtacggtaacggttaaagggttggggggttacgggggggtacgggttacgggggtaccctttaccgggttccggttaccggggtttggttttacggtacccggg

SEQ ID NO: 294169 - DNA, 782 bp, Homo sapiens
  misc_feature: GYAE6OF01BY3DC.36.2.A02.1.454.CMB.1.raw
tcagtacgctgtctcacgaccggtgctcgatttagactcatctacagggggaggaactgctcagttaggacccagacggaaccatggaagcccccagcgcagcttctcttcctcctgctactctggctcccagatatcactggagaaatagtgatgacgcagtctccacgcccaaccttatctgttctcctaccgaggaaacgaaggacgaccctaccccgtcctccgtacgggtacgggacctaggtcaggtagttcgttacgcgacgtactacctacgtcccgtacggaccgtacgacgaacgaaccgtcggaccgtacggttcccgaggtcctcgtactctagtcgttacgtcggtcacgtaccacccgtaccggacggtaccacggtcgtacctccgaccgtacccttacgtttaggcggtacgttacgggtcggtacggtacggtaacggacgttaaccgtcctaccgtactaaccacctaccgtcaccggtaccgaccggtccgtagtaccgtacgttaacggtaggtttaaacgttacgttttacgtacggttttaatttaccgtttaccggttataaacccgttaccgtaaaggtttaccgacgtttaacgtacccggttacttacccggtttacctaacccgggtttacggttacccggggaacgggtacgggtaacggtaaacggggtaggtaaacgttaaacccgtaaaccggtaaacccggtaggtcggtacggttactacgtaacccgcgttactccggttccttaccg

SEQ ID NO: 294170 - DNA, 861 bp, Homo sapiens
  misc_feature: GYAE6OF01D7VV7.36.2.A02.1.454.CMB.1.raw
  modified_base (333)..(333): a, c, t, g, unknown or other
  misc_feature (333)..(333): n is a, c, g, or t
  modified_base (404)..(404): a, c, t, g, unknown or other
  misc_feature (404)..(404): n is a, c, g, or t
tcagtacgctgtctcacgaccggtgctcgatttagactcatctacagggggaggaactgctcagttaggacccagacggaaccatggaagccccagcgcagtcttctcttcctcctgctactctcggctcccagatatcagtaggagaaatgtgatgacgcagtctccagccctaccctatcctggtcgtacctacgaggaacgaaaagcgcccacccttctaccgtaggtacgggccagtaccgagtagttgtacgcagtacctaacgttgacccgtaggtaccaggactaaacggtaaaccgtggacccgtacggttacccgaggtcctanacttacgattcgtaggttcgggtacacctacgtacccgaccggtaggtaccctacgttcgggttaaccccncccgtaaccgttacccgtttaacggttttacggcgggtacggttaggggtttacggggacggttaaccgggaactacggttaccgtttaccaacgtttccgtaccgaacctaggtaccgtaacgtaccgtaccgtaccgtaccggtaccgttacggttaacgttaagggtttaacgtttaacgttttacggttaaccgttttaagttttaaccgtttaacgttaacgttaaccgtaaacggttaacgttaaaccgttaacgtaccggttaccggttcccggttaccctttaccggttaccggttaccgggttaccggggaacgggtaaccgggtaaaccgggtaaagggtaccggttaaacgtaaaccggttaaaccggtaaacggttaccggttacgggttaccggtaccgttaccggaacccttaaccggttacgtttccggtttaccgttaccg

SEQ ID NO: 294171 - DNA, 491 bp, Homo sapiens
  misc_feature: GYAE6OF02I7W1F.36.2.A02.1.454.CMB.1.raw
  modified_base (333)..(333): a, c, t, g, unknown or other
  misc_feature (333)..(333): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtactcccagccacctttagnggcaggtgggtctgggacagagttcactctcaccatcagcagcctgcagtctgaagtatttgctagtttattactgtcaacagtacaatgactgcctctctacgttcggcggagggaccagggtggagatacaaacgactgtggctgcaccatctgtc

SEQ ID NO: 294172 - DNA, 498 bp, Homo sapiens
  misc_feature: GYAE6OF02I1CG7.36.2.A02.1.454.CMB.1.raw
  modified_base (333)..(333): a, c, t, g, unknown or other
  misc_feature (333)..(333): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttccccaggctcatcatctatggtgcatccaccagggccactggtatcccagccacctttagnggcagtgggtctgggacagagttcactctcaccatcagcagcctgcagtctgaagtatttgctagtttattactgtcaacagtacaatgactggcctctcactttcggcggagggaccagggtggagataccgaaacggacttggtggctgccaccattctgttc

SEQ ID NO: 294173 - DNA, 529 bp, Homo sapiens
  misc_feature: GYAE6OF02IW8YC.36.2.A02.1.454.CMB.1.raw
  modified_base (259)..(259): a, c, t, g, unknown or other
  misc_feature (259)..(259): n is a, c, g, or t
  modified_base (263)..(263): a, c, t, g, unknown or other
  misc_feature (263)..(263): n is a, c, g, or t
  modified_base (296)..(296): a, c, t, g, unknown or other
  misc_feature (296)..(296): n is a, c, g, or t
  modified_base (330)..(330): a, c, t, g, unknown or other
  misc_feature (330)..(330): n is a, c, g, or t
  modified_base (384)..(384): a, c, t, g, unknown or other
  misc_feature (384)..(384): n is a, c, g, or t
  modified_base (397)..(397): a, c, t, g, unknown or other
  misc_feature (397)..(397): n is a, c, g, or t
  modified_base (455)..(455): a, c, t, g, unknown or other
  misc_feature (455)..(455): n is a, c, g, or t
  modified_base (480)..(480): a, c, t, g, unknown or other
  misc_feature (480)..(480): n is a, c, g, or t
  modified_base (522)..(522): a, c, t, g, unknown or other
  misc_feature (522)..(522): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagcgtggtcgttttctaggtggctatttaaaaggtgtcagtgtgaggtgcagctgttggagtcgtgggggagcttggtacagcctgggggtccctgagctctcctgtgcagcctntggnttcacctttgcagctatgccatgacctggtccnccaggctccagggaaggctggagtgggtctcgtntattagtggaagtcggtggtatacgaactacggcagcctccgtgaacggggccncttcaccattccnccagtacgacttacttaccaagacgcaacttctgtctctgaccaatgaacaacctganacgcgagaccgacgccctatactangtaccgaaattcggactacggatactgactactatgggtacngttaacg

SEQ ID NO: 294174 - DNA, 562 bp, Homo sapiens
  misc_feature: GYAE6OF02I4DYN.36.2.A02.1.454.CMB.1.raw
  modified_base (352)..(352): a, c, t, g, unknown or other
  misc_feature (352)..(352): n is a, c, g, or t
  modified_base (422)..(422): a, c, t, g, unknown or other
  misc_feature (422)..(422): n is a, c, g, or t
tcagtacgctgtctcacgaccggtgctcgatttagactcatctactagggggtagggaactgctcaggttacggacccagacggaaccatggaagccccagcgccagcttctcttcctcctgctactctggctcccaggatatccactggagaaagtagtgatgacgcagtctccagccaccgtatctgtgtctccaggagaaacgagccaccctctacctaggtacgggccagtcagagtgttagcagcaacttgcctggtaccagcagaaacctggccaggttcccaggctcagtcatctagtcggtgcagtccaccgagggccagtggtactccgagccaacgtttagnggctagtcggtctgggacaggacgttcactctcaccgtatcgacgcagcctcgcgtagttcctagaagtnttttcgcctaagtttactactgtacaacgtagtacaagtgacctggaccttctcgtacgttcggacggacgggacctaggtggagtacgtacaaacggtactggtcggacttcggacctaaccgtacttcgtgttaccgg

SEQ ID NO: 294175 - DNA, 530 bp, Homo sapiens
  misc_feature: GYAE6OF02HP6PG.36.2.A02.1.454.CMB.1.raw
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggtacagccgtggggggtccctgagactctcctgtgcagcctctggattcacctttagcagctatgccatgacctgggtccgccgaggctccaggggaaggactggagtgggtctcgtctattagtggaagtggtggttatacaaactacgcagcctcgtgaagggccgcttcaccatctccagagactataccaagagcactctgtattctgacaaatgaacagcctgagtgccgaggacacggccctatattattgtgacgaaagtggtagggggaggtgggggctacgtcgtggtcgtttagtacgg

SEQ ID NO: 294176 - DNA, 564 bp, Homo sapiens
  misc_feature: GYAE6OF02HRZYL.36.2.A02.1.454.CMB.1.raw
  modified_base (338)..(338): a, c, t, g, unknown or other
  misc_feature (338)..(338): n is a, c, g, or t
  modified_base (375)..(375): a, c, t, g, unknown or other
  misc_feature (375)..(375): n is a, c, g, or t
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcaagaacctggccaggttcccaggctcatcatctatggtgcatccacgacgggccacgtggtactccccagccctacgtttagnggcaggtggtcgtgggacagtacgttcactctcactntacagcagcctgctagtctagaagtatttgnttagttttatactgtacaanagtaactaagtgtactcggtcctacgttcgtacggtttcggacgggacgggtaccgagggtggaagtaactaaccgaaaacggtaacggttggtacgggtaccttaggacctaacccgtaattccgttagtttacccg

SEQ ID NO: 294177 - DNA, 510 bp, Homo sapiens
  misc_feature: GYAE6OF02JZS0S.36.2.A02.1.454.CMB.1.raw
  modified_base (218)..(218): a, c, t, g, unknown or other
  misc_feature (218)..(218): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (446)..(446): a, c, t, g, unknown or other
  misc_feature (446)..(446): n is a, c, g, or t
  modified_base (503)..(503): a, c, t, g, unknown or other
  misc_feature (503)..(503): n is a, c, g, or t
tcagtacgctgtctcacgaccggtgctcgatttagactcatctacaggggcgagaagtctctctcagtcaggacacagcatggacatgagggtccctgctcagctcctgggactcctgctgctctggctcccagataccagatgtgacatccagatgacccagtttccatcctcctgtctagcatctgtaggagacagacgtcacatctcttgccggnaagtcaggcatacatcattagactcgtatctagacagaaaccaggaacgtacttaagctaccgtagattanatgactcgtattcactgtncaatcggggtccatctcggttcagtgctagtggactagtggacaggtatttcacgttcactaccgatcagcacgcctgcagtcctagacgattgtagctaactttatcttagtactaaagtataacgtagtcgccctnttaccacggtttacgcgggaacgtacgtaaggtaggacgagttaccgaaacttacgngttacgg

SEQ ID NO: 294178 - DNA, 512 bp, Homo sapiens
  misc_feature: GYAE6OF02GGMPH.36.2.A02.1.454.CMB.1.raw
  modified_base (330)..(330): a, c, t, g, unknown or other
  misc_feature (330)..(330): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccacagggccactggtactccagccactttagnggcagtggtctgggacagagttcactctcaccatcagcagcctgcagtctgaagtatttgctagtttattactgtacaacagtacaatcgactggccttctctacgtttcggcggtacggaccgagggtggagagtaccgaaaggaacttggtaggcttcggactaccgattcgtgttaccg

SEQ ID NO: 294179 - DNA, 569 bp, Homo sapiens
  misc_feature: GYAE6OF02I9J2V.36.2.A02.1.454.CMB.1.raw
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtcgtgggggaggcttgggtacagccgtggggggtccctgagactctcctgtgcagcctctggattcacctttagcagctatgccatgacctgggtccgccaggctccgaggggaaggactgggagtgggtctcgtctagttagtggaagtggtggttatacaaactacgcagcctcgtggaacggccgcttcaccatcctccagacgactataccaagacgaccactctgtatctcgacaaatcgaaacacgcctagaggtcgacccgtaggaccaccggaccctaattattattggtggacgtaaagtgggtaggggggtaggtcgggggtacttaaccgtccggtgggtcgttttggtaccgg

SEQ ID NO: 294180 - DNA, 578 bp, Homo sapiens
  misc_feature: GYAE6OF02HVYO1.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaacctggccaggttcccaggctcatcatctatggtgcatccaccagggccactggtactccccgagccctacgtttagcggctaggtgggtctgggacaggtagttcactctccaaccatcagcacgccgtgcagtcgtagaagttattttgacttaagttttattacttcgtacaactagtaactaagtacgtactcggtcctcttcgtacgtttcggacgggtacgggaaccgtagggtacggaggtaacgtaccgtaaaacggtaccgttaggttacggacgttacggacctacccgtaacgttccgttagttacccg

SEQ ID NO: 294181 - DNA, 577 bp, Homo sapiens
  misc_feature: GYAE6OF02GZID5.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgacgggccacgttggtactccccgacgtccctaccgtttaggtcggccgtagggttcggggtcttaggggacctaggtacgtttcgaaccttccgtcaacctatcacgcagcctgcagtctagaagtatttgcttagtttattactgtacaactagtacaatgactcggtccttctctacgtttcgggacggtacgggaccgtagggtcggtaagtacgtacgaaacggtacgtacggtaggtacgtacgacctaccgtactccgttagttaccg

SEQ ID NO: 294182 - DNA, 571 bp, Homo sapiens
  misc_feature: GYAE6OF02GO34V.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacggagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgagggccacgtggtactcccagccctacctttagcggcaggtgggtctggggacaggagttcactctcaccatcagcacgcctgcagtctagaagtatttgcttagtttattacttgtacaactagtaacaattgacgtcggtcccttcgtaccttacgtttcgggacggtaacggggtacccgtaagggtcggaaggtaacgtaaccgaaaacggtacgttggtacggtcgttacggacctaaccgtattcgttacgttccttacccg

SEQ ID NO: 294183 - DNA, 512 bp, Homo sapiens
  misc_feature: GYAE6OF02HNHZB.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccacgtggtactcccagcctacctttagtggcaggtgggtctgggacagtagttcactctcacatcagcagcctgcagtctagaagtatttgcttagtttattactgtacaacagtacaatgactgcctctctacgttcggcggtacggaccgaggtggagagtaccgaaacgtaacgtggtggctcgaccaccattccgtgttcc

SEQ ID NO: 294184 - DNA, 533 bp, Homo sapiens
  misc_feature: GYAE6OF02GAIZQ.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccacctctcctgtagggccagtcagagtgttagcagcaacttagcctggtaccagcagaaacctggccaggttcccaggctcatcatctatggtgcatccaccgagggccctacgtggtactcccagcctacctttagtggcagtgggtctgggacagagttcactctcaccatcagcagcctgcagtctagaagtattttgacttagttttattacgttgtacaatacgtaacaatgacttgccttctctactttcggacgggagggtaccgagggtggagtacgtacaaacggtacgttaggtcgcgtcggaccacctacgttcgtacgttcc

SEQ ID NO: 294185 - DNA, 555 bp, Homo sapiens
  misc_feature: GYAE6OF02H0U6J.36.2.A02.1.454.CMB.1.raw
  modified_base (209)..(209): a, c, t, g, unknown or other
  misc_feature (209)..(209): n is a, c, g, or t
  modified_base (293)..(293): a, c, t, g, unknown or other
  misc_feature (293)..(293): n is a, c, g, or t
  modified_base (336)..(336): a, c, t, g, unknown or other
  misc_feature (336)..(336): n is a, c, g, or t
  modified_base (401)..(401): a, c, t, g, unknown or other
  misc_feature (401)..(401): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccacctctccngtagggccagtcagagttgttagcagcaacttagcctggtaccagcagaacctggccaggttcccaggctcatcatctatggtncactccacgacgggccactggtactcccagcctacgtttacgnggctaggtgggtcgtgggacaggtacgttcactctcacatcagcagcctgctagtcaggtaagtnttttgacttaagttttatttacgtcgttaacaacagttaacaactgacctcgtacctctacgtacgttcggacggtacgggacgagggtcggagtaactaccgaaacgtacgttacggtacggtcgtacggacctaccgtattccgtgttaccg

SEQ ID NO: 294186 - DNA, 530 bp, Homo sapiens
  misc_feature: GYAE6OF02F35EX.36.2.A02.1.454.CMB.1.raw
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggctttttcttgtggctattttaaaaggtctcctgtgaagcctctggattcacctttgacaagtgtgccatgacctgggtccgccaggctccaggggaaggggctggagtgggtctcagttattagtggtagtggtagtagcacagattacgcagactccgtgaagggccggttcaccatctccagagacaattccaacagcacgctgtatttgcacatgaacagcctgagagcgaggacacggcatatattattgtgcgaaacttctttgacttggttattatccctagtcaccactcgggccagggaaccctggtcacgtctcctcagcctccaccacgggcccagtccggtccttcccctcggccaccctcctccaacg

SEQ ID NO: 294187 - DNA, 508 bp, Homo sapiens
  misc_feature: GYAE6OF02GUXJK.36.2.A02.1.454.CMB.1.raw
  modified_base (206)..(206): a, c, t, g, unknown or other
  misc_feature (206)..(206): n is a, c, g, or t
  modified_base (334)..(334): a, c, t, g, unknown or other
  misc_feature (334)..(334): n is a, c, g, or t
  modified_base (503)..(503): a, c, t, g, unknown or other
  misc_feature (503)..(503): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctntcctgtagggccagtcagagtgttagcagcaacttagcctggtaccagcagaaacctggccaggttcccaggctcatcatctatggtgcatccaccagggccactggtactccccagccacctttagnggcagtgggtctgggacaggagttcacgtctcaccatcagcagcctgcagtctgaagtattttgcttagtttattactgtacaatagtacaatgactcgctctctctttcggcggacgggaccaggtggagaactacgaaacgtactgtacggactgccaccattcgtnttacc

SEQ ID NO: 294188 - DNA, 507 bp, Homo sapiens
  misc_feature: GYAE6OF02ILSST.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaaccctggccaggttcccaggctcatcatctatggtgcatccacagggccacgtggtactccccagcctacctttagtggctagtgggtctgggacagagttcactctcaccatcagcagcctgcagtctagagtattttgcttagtttattacgtgtacaacagtaacatgtactgcctctctacgttcggacggagggaccaggtggagagtacaaacgtatgtaggctcgacaccgtatctgtacc

SEQ ID NO: 294189 - DNA, 590 bp, Homo sapiens
  misc_feature: GYAE6OF02GVVJE.36.2.A02.1.454.CMB.1.raw
  modified_base (197)..(197): a, c, t, g, unknown or other
  misc_feature (197)..(197): n is a, c, g, or t
  modified_base (294)..(294): a, c, t, g, unknown or other
  misc_feature (294)..(294): n is a, c, g, or t
  modified_base (413)..(413): a, c, t, g, unknown or other
  misc_feature (413)..(413): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtncactccacgagggccacgtggtactcccgacgtcctactttaggcggcgtaggtcgggtctggggactaggtagttccactctaccaaccatcaagcacgtcctgcagtctaggaattnttttgacttaagttttacttacgtgtactaacgtagtaactaagtcgtacgtcggcccttcgtaccgttacggtttcgggacgggtaacgggtaacccgtaaggggtcggtaagtacgttaaaccgaaacggtaacgttggtacggcgttacgacctaaccgtagttcctggttacc

SEQ ID NO: 294190 - DNA, 541 bp, Homo sapiens
  misc_feature: GYAE6OF02H14FM.36.2.A02.1.454.CMB.1.raw
  modified_base (356)..(356): a, c, t, g, unknown or other
  misc_feature (356)..(356): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggctttttcttgtggctattttaaaaggtgtccagtgtgaggtgcagctgttggagtctgggggaggcttgggtacaggccgtggggggtccctggagactctcctgtgcagcctctggattccacctttagcagctatgccatgacctggtccgccaggcctccgagggaggactggagtgggtctcgtctatgtggagtggtgtanactaaactacgcagcctcggtgaacgggccgcttcaccgatcctaccagacgacttataccaagacgcacttctgtatctgacaaatgaacagccgtagacgtgaccgaaggaccgacgaccctatatttagtgtgaccgtaagtgggtggggaggtggggcttacgtccgtggtcgtttgtacg

SEQ ID NO: 294191 - DNA, 632 bp, Homo sapiens
  misc_feature: GYAE6OF02J1GNT.36.2.A02.1.454.CMB.1.raw
  modified_base (296)..(296): a, c, t, g, unknown or other
  misc_feature (296)..(296): n is a, c, g, or t
  modified_base (375)..(375): a, c, t, g, unknown or other
  misc_feature (375)..(375): n is a, c, g, or t
  modified_base (395)..(395): a, c, t, g, unknown or other
  misc_feature (395)..(395): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagacgcccaccctctcctggtacgggccagtcagagtgttagcagcaacttgcctggtaccagcagaacctggccaggttcccaggctcatcatctatggtncactccaccacgggccacgtggtactccccgacgtcctaccgttaggtcggcgtaggtgggtcctgggacagtacgtcnctctccacctatcagcgacncgtcgacacgttcgtacgtaaggttacttttcggacttacgtttttacgtttctcgaccctaaggaccttaacttagttaaactttaccggtcggtacccgtttccgtaacggttcgggtaacccggtttaccgggaccgaaccgggtacgaaacggggttagtaaaacgtaccgtaaacggaacgtttacgggaccggttactacgggcctaaaccgtcgtttaccgtcgtttacc

SEQ ID NO: 294192 - DNA, 716 bp, Homo sapiens
  misc_feature: GYAE6OF02HI2NT.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatactcacgtggaagtaaattagtagatagacgtccagtcctacccagccctacccgtatccttcgtaggtactaccgaggacgaaacgacgtccctaccctctccgtcgtacgggccaggtcagagtcgttagcagtacaacttagcctagtaccgagacgaacgaaccgtcggacccacggttcccaggctacatacatctagtcgtacgcacgtccacgacgggacctacgtacgtactaccgtacgccgtacgtttaggcggtcgtagggtcggtcgtaggacctagtacgttccaaccgttcctaccaaccgtactaccggacgtaccgtacggtccgttagaccgtaacgttaccgttagggtaaatttacggtttttacgaacgttttaaggttttaccttaaccggttacgtaactaaaccgttacgtaactaaaggttccgtaaccgttccggtaccttaccgttacgttaaccgggttcggaaccgggtaccgggaaccggtagggtacggtaacgaactaaccggaacgtacgttcggacgtctaccgacgtaaccctcttaccgtgttaccc

SEQ ID NO: 294193 - DNA, 544 bp, Homo sapiens
  misc_feature: GYAE6OF02FKMJH.36.2.A02.1.454.CMB.1.raw
  modified_base (295)..(295): a, c, t, g, unknown or other
  misc_feature (295)..(295): n is a, c, g, or t
  modified_base (319)..(319): a, c, t, g, unknown or other
  misc_feature (319)..(319): n is a, c, g, or t
  modified_base (339)..(339): a, c, t, g, unknown or other
  misc_feature (339)..(339): n is a, c, g, or t
  modified_base (403)..(403): a, c, t, g, unknown or other
  misc_feature (403)..(403): n is a, c, g, or t
  modified_base (493)..(493): a, c, t, g, unknown or other
  misc_feature (493)..(493): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttccccaggctcatcatctatggtncatccacgagggccacgtggtacncccgacgccctacgtttagnggcgaggtcgggtctgggacagagttcactctcaccatcagcagcctggcagtctaggtaagtntttggacttagtttactttacgtcgtacaacgtagtaactaagtcgtacgtcgtccttcttactacgtttcgggcggtacgggactaggnggagaactacgaaacgtcgttagtcggctcgaccacgtcttcgtcgttacc

SEQ ID NO: 294194 - DNA, 503 bp, Homo sapiens
  misc_feature: GYAE6OF02I1014.36.2.A02.1.454.CMB.1.raw
  modified_base (150)..(150): a, c, t, g, unknown or other
  misc_feature (150)..(150): n is a, c, g, or t
  modified_base (171)..(171): a, c, t, g, unknown or other
  misc_feature (171)..(171): n is a, c, g, or t
  modified_base (173)..(175): a, c, t, g, unknown or other
  misc_feature (173)..(175): n is a, c, g, or t
  modified_base (179)..(179): a, c, t, g, unknown or other
  misc_feature (179)..(179): n is a, c, g, or t
  modified_base (181)..(181): a, c, t, g, unknown or other
  misc_feature (181)..(181): n is a, c, g, or t
  modified_base (188)..(188): a, c, t, g, unknown or other
  misc_feature (188)..(188): n is a, c, g, or t
  modified_base (194)..(194): a, c, t, g, unknown or other
  misc_feature (194)..(194): n is a, c, g, or t
  modified_base (202)..(202): a, c, t, g, unknown or other
  misc_feature (202)..(202): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
  modified_base (221)..(221): a, c, t, g, unknown or other
  misc_feature (221)..(221): n is a, c, g, or t
  modified_base (232)..(232): a, c, t, g, unknown or other
  misc_feature (232)..(232): n is a, c, g, or t
  modified_base (341)..(341): a, c, t, g, unknown or other
  misc_feature (341)..(341): n is a, c, g, or t
  modified_base (356)..(356): a, c, t, g, unknown or other
  misc_feature (356)..(356): n is a, c, g, or t
  modified_base (387)..(387): a, c, t, g, unknown or other
  misc_feature (387)..(387): n is a, c, g, or t
  modified_base (400)..(400): a, c, t, g, unknown or other
  misc_feature (400)..(400): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagcggngtgttcaggcgctattaaggncnnngagncngctgtgnctgggngctggacngcgtggggtccngagntcnctgtgcagctngattcacttagcagctatgccatgacctgggccaccaggctccgagggaaggctggagtgggctgtctatagtgagtggtcgtatacgaaactcggcagccgtccgtanagggccctatcacanctacaggacactattccaaagcgtacacttntagtatcgtacanatacgacgacgtacgagtagtcgacgacgacgacgtactactattatgtagtacgtagtaggtagggtaggtcgggtacgtacgtacgtcggtcgttagtacg

SEQ ID NO: 294195 - DNA, 564 bp, Homo sapiens
  misc_feature: GYAE6OF02HNM0U.36.2.A02.1.454.CMB.1.raw
  modified_base (335)..(335): a, c, t, g, unknown or other
  misc_feature (335)..(335): n is a, c, g, or t
  modified_base (551)..(551): a, c, t, g, unknown or other
  misc_feature (551)..(551): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgtagcagcaacttagcctggtaccagcagaaacctggccaggttcccaggctcatcatctatggtgcatccaccgagggccactggtactcccagccctacctttagnggctaggtggtcgtgggacagtagttcactctcacatcagcagcctgcagttctaggaagttagttttgacttaagttttactacttggtacaaacgtagtaactaagtagtactcggtccttctaccttacgtttcggacgggtacgggaccgtagggtcggaagtacgtaccgaaacgtaccgttggtacggtaccgtacgacccgtaaccgtnttaccgtgttacc

SEQ ID NO: 294196 - DNA, 585 bp, Homo sapiens
  misc_feature: GYAE6OF02H97UQ.36.2.A02.1.454.CMB.1.raw
  modified_base (329)..(329): a, c, t, g, unknown or other
  misc_feature (329)..(329): n is a, c, g, or t
  modified_base (432)..(432): a, c, t, g, unknown or other
  misc_feature (432)..(432): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtacgggccagtcagagtgttagcagcaacttagcctggtaccagacaagaaacccgtggccacggttcccaggctcatcatctagtggtgcactccaccgacgggccacgtggtaccnccgacgacctaccgtttaggcgggtactagggttcgggtcgtagggacaggtacgttcacttctaccacctatcagcacgcctgactagtcgtagtaacgttnttttcgacttaagttttattacttgttacaacgtagttaacagttagacgtcgtccttcttacttacgttcgggacggtacggacgtagggtaggaagtacgtaacgaaacggtacgtaggtcggacgtcgacctacctagtaccttgttacc

SEQ ID NO: 294197 - DNA, 566 bp, Homo sapiens
  misc_feature: GYAE6OF02G6ZCS.36.2.A02.1.454.CMB.1.raw
  modified_base (304)..(304): a, c, t, g, unknown or other
  misc_feature (304)..(304): n is a, c, g, or t
  modified_base (337)..(337): a, c, t, g, unknown or other
  misc_feature (337)..(337): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgngggccacgtggtactcccagcctaccgtttagnggcaggtgggtctgggacagtagttcactctcaccatcagcacgcctgcagtctagaagtatttgcttagtttattactgtactaatagtataatcgaacgtacggtccgttaccgggttaaccgttttgggacccggtacgggggacctaaggtccgttaggggaacgtactaaccgaaacggtaaccgtacggtggtacgtcgaccgtaccacgttacgttgttccg

SEQ ID NO: 294198 - DNA, 668 bp, Homo sapiens
  misc_feature: GYAE6OF02FMR96.36.2.A02.1.454.CMB.1.raw
tcagtacgctgtctcacgaccggtgctcgatttagactcatctaccacgggggaggaactgctcagttaggacccagacggaaccgatgggaagaccccgagcgcagcttctcttcctcctgctactctggctcccagatatcactggagaaatagtgatgacgcagtctccagccaccctatctgtgtctccaggagaaagagccacctctcctgtagggccagtcagagtgttagcagcaacttagcctggtaccagcagaaacctggccaggttcccaggctcatcatctatggtgcacgtccaccgagggccacgtcgggtactccccaggtccctaaccttttaggtcggcctagggttcggggtcctagggggacctaggagtttccgacttcctcaaccatccagtccacgcctgcctagtcctagtaaacgtcttttaggccttaagtttttacgttaaccgttcggttaaccctaaaccgtaaggtttaacctaaagttcggtaacccgtttcgggtacccttccgttaccgttacccggttttccggggaccgggtaacggggtaacccgtaagggtcggaacggttaacgtaaccgtaaaaccggtaacgttgggtaccggacttcggacctaaccggtactttccgtggtttaccc

SEQ ID NO: 294199 - DNA, 568 bp, Homo sapiens
  misc_feature: GYAE6OF02GDAXK.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagcagaaacctggccaggttcccaggctcatcatctatggtgcatccaccgagggccactgggtactccccagtcctaccgttttagcggcaggtgggtctggggacaggtacgttcactctacaccatcgagcagcctgctagtctagtaagtatttcgcttaagttttattacgtgtacaactacgtacaatgactcggtcctcttctacgtttcggacgggacgggtaccgagggtggaacgtaacgtaccgaaaaccggtacgttaggtacggtaccgtacggacctaccgtaacgttcgtacgtttacccg

SEQ ID NO: 294200 - DNA, 609 bp, Homo sapiens
  misc_feature: GYAE6OF02JGNDQ.36.2.A02.1.454.CMB.1.raw
  modified_base (168)..(168): a, c, t, g, unknown or other
  misc_feature (168)..(168): n is a, c, g, or t
  modified_base (285)..(285): a, c, t, g, unknown or other
  misc_feature (285)..(285): n is a, c, g, or t
  modified_base (323)..(323): a, c, t, g, unknown or other
  misc_feature (323)..(323): n is a, c, g, or t
tcagtacgctgtctcacgaccggtgctcgatttagactcatctacaggggagctctgagagaggagcccagccctgggatttcaggtgtttcatttggtgatcaggactgaacagagagaactcacatggagttggctgagcgtggctttctgtggctatttaaaggngtcagtgtgagtgcagctgtggagtcgtggggagcttggacagccgtgggggcctgaacgactctccgtgtagcagcctgtggatcgacttagcagctatcgccatcgactggtccncaggctcgaggagctggagtggtctcggtatacgtagnggtaagtggtcggtataccgaaatcggctaacgcgttaccgtgaaacgggcctacgttaccgaccgtaagtcgtacccgaagtacggtaacttacgttacgtaacgacggtctaacgtcgttacgtaacgtactacggttacaaaacgttgaaacccgtagtacccgttagacgttacgaccgtaaggaccgtaacgtacccgtagtactttacgtagttacggaacgtaacgtggtaacggggtgacggggtctaaccgttcgtacggtacgtttagaacccggg

SEQ ID NO: 294201 - DNA, 588 bp, Homo sapiens
  misc_feature: GYAE6OF02GE5HD.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccgaggggcccactgggtactccccgacgccctacctttaggtcggctaggttggggtctggggacaggtacgttcactctcacccatcagcacgcctgcagtctagaagtattttgacttagtttattactgtacaactagtaacaatagacgtcgtccttcttcgtaccgtttcgggacggtaacgggacccgtagggtaggaacggtaacgtaccgaaaaccggtaacgttacgggttacgggtccgtacggtacccgaacccgtacgttaccgtagtttacccg

SEQ ID NO: 294202 - DNA, 599 bp, Homo sapiens
  misc_feature: GYAE6OF02HA9O9.36.2.A02.1.454.CMB.1.raw
  modified_base (335)..(335): a, c, t, g, unknown or other
  misc_feature (335)..(335): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtacgggccagtcagagtgttagcagcaacttagcctggtaccagcagaacctggccaggttcccaggctcatcatctatggtgcatccacgagggccacgtggtactcccagcctacgtttagnggcaggtggtcgtgggacagacgttcactctacaccgatcacgcacgcctgctagtctagtaacgtgttttgcttagttttacttacgtgttactaactaggtaactaagttacgtaccgttcggtcccttaccgttccgttaccgttttccgggacgggtacgggacccggtaagggttcggtaacggtaagttaacccgaaaacgggtaaccgttcgggttacgggacttacggaccctaccgtacgttaccgttcgttacc

SEQ ID NO: 294203 - DNA, 505 bp, Homo sapiens
  misc_feature: GYAE6OF02F2FNP.36.2.A02.1.454.CMB.1.raw
  modified_base (472)..(472): a, c, t, g, unknown or other
  misc_feature (472)..(472): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatccccagcctactttagtggcaggtgggtctgggacagattcactctcaccatcagcagcctgcgagtctgaagtattttcgccgttgtattactgtacaacactatcgtaccttctctgttactactttcggaccgtagggaccgaagcgaggagntacaaacgtaacgtgtggctggcacactctgtc

SEQ ID NO: 294204 - DNA, 625 bp, Homo sapiens
  misc_feature: GYAE6OF02G3JK9.36.2.A02.1.454.CMB.1.raw
tcagtacgctgtctcacgaccggtgctcgatttagactcatctacagggggaggaacctgctcagttaggacccagacggaaccatggaagccccagcgcagcttctcttcctcctgctactctggctcccagatatcactggagaaatagtgatgacgcagtctccagccaccctatctgtgtctccaggagaaagacgccacctctcctggtagggccaggtcagagtgttagcagacaacttagcctggtaccagacaacgaaaccgtggacctacggttcccaggctcatcatctagtggtgcactaccaccgcgggccacgtggtacctccgacgcctactttagtcggacgtaggtgggtcgtgggaacagtagtccactctacaccatcgagcgacgctcgacgtacgtcgtacgtaagttactttcgacttacgtttaacttacgtagtacctaactacgttaacaagtacgtacgtcgtaccttacgttaccgttaaccgttttacgggacgggtaacgggtaaccgtaagggtagggaacgtaacggtaacgaaaccgtaacggttacggttacggtacgtacggtaccgtaaccgtacgttacttacgttaccg

SEQ ID NO: 294205 - DNA, 596 bp, Homo sapiens
  misc_feature: GYAE6OF02IY05T.36.2.A02.1.454.CMB.1.raw
  modified_base (197)..(197): a, c, t, g, unknown or other
  misc_feature (197)..(197): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctgtagggccagtcagagtgttagcagcaacttagcctggtaccagccaagaaacctggccaggttcccaggctcatcatctanggtncatccaccgagggccacgtggtactcccgaagtcctaccgttttaggcggactaggttgggtactggggaactaggacgtttcaaccgttcgtaccaacccgtatcgagtcacgcctacgcagtctagtaagtatttgtctagtttattacgttgtacaactagtaactaatagtacgtcgtcctcttacctacgttttcgggaccgggtacggggtaaccgtagggtaggtacggtaagttaccgtaaacggtacgttaggtaggtacgtacggacctacccgtaatccgttgttaccg

SEQ ID NO: 294206 - DNA, 624 bp, Homo sapiens
  misc_feature: GYAE6OF02F3KA8.36.2.A02.1.454.CMB.1.raw
tcagtacgctgtctcacgaccggtgctcgatttagactcatctacaggggggaggaactgctcagttaggacccagacggaaccatggaagccccagcgcagcttctcttcctcctgctactctggctcccagatatcactggagaaatagtgatgacgcagtctccagccacctatctgtgtcctccaggagaaagagccaccctctcctggtagggccagtcagagtgttagcagacaacttagccttggtaccagcaagaacctggccaggttcccaggctcatcatctatggtgcactccacgagggcctacgtcggtactccccagccctaccgtttaggcggacgtaggttcggtcgtgggactacggtagttccactctccacctatcgagcagtccctgctagtctaggtaacgttgtttgactttagtttacttactcgtaacaacgtacgtaataatcggacgttcggtacccttcgttacccgttaccggtttaccggggacgggtaacggggtaaccgaggggtacggaacggtaacgtaaccggtaaaaccggtggtacggtttacggccgtacgtaacccgtacgttaccgtttaccgttcctttaaccg

SEQ ID NO: 294207 - DNA, 651 bp, Homo sapiens
  misc_feature: GYAE6OF02G38IX.36.2.A02.1.454.CMB.1.raw
  modified_base (300)..(300): a, c, t, g, unknown or other
  misc_feature (300)..(300): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagcgccaccctctcctggtacggccagtcagagtgttagcagcaacttgcctaggtaccagcaagaaaccgtggcctacggttcccaggctcatcatctagtggtnctactccgaccgagggcctacgtcggtactccccgacgtcctaccgtttaggcggacgtagggttcgggtacgtcgggaacctaggtacgttacctacttcctacctaccctattaccgacgtaccgtacgccgttcggactagttcgtaagtaacgtttacgttttcgacgtttaaggttttacttacgttcgtaactaacgtaagttactaagtcgtacgttcgtccttacgttacttccggttaccgggacgggtaacggtaccgtagggtacggtaacgtaacgtaaccggtaaacggtacgttgggtacgtcgtacgtacccgtacgtactttcggtcttaacccg

SEQ ID NO: 294208 - DNA, 665 bp, Homo sapiens
  misc_feature: GYAE6OF02F7IMF.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagngccaccctctcctggtagggccagtcagagtgttagcagcaacttagcctggtaccagcagaaacctggcctaggttcccaggctcatcatctatggtgctactccaccgagggccacgtcggtactcccgagccctaccgtttagtcggctaggtcgggtcgtgggacaggtacgttcacctcctaccaacctatcgacgcacggcctaggctaagttctaggtaacgttgttttacgactttaagttttacttacgttacgtacctaaaccgtagttaacctaagtaccgtaacgtccggtacccttaccgttacccgttaacccggttttccggggaaccgggggtaacgggtaacccggtaacgggggttacggtaacggtaacggtaacccggtaaaaacgggtaccgttcgggtacggtaccgttacggaaccctaacctagttacccggttggtttaaccc

SEQ ID NO: 294209 - DNA, 686 bp, Homo sapiens
  misc_feature: GYAE6OF02H5ABL.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggaagaagcgccacctctcctgaggccagtcagagttgtagcagcaacttagctggtaccagcaacgaaccgtgccacggttcccaggctacactcactctagtcggtatactcccgacgacgggtcctacgtcggttactcccgacgtacccttacgtttagttcggaccgttaggtccggggtctggggtaacctaggtacgttacgactttcctacctaaccgtattccgacggtcgacgtacccgttcgccgtaacgttacttacggtaaacggttacgtttttacggacctttttaacgttttacgttttaaccgttcggttaaccttaacgtaacgttaacgtaagtacggtaacgttcgtacccgttcgttacttaccggtttccgggacggtaaccggaacggtacgggtaggaacgtacgttaaccgaaaccggttcgtacggttccggacggtacctccggaacctgtaccgtttcgtaccgtttacc

SEQ ID NO: 294210 - DNA, 688 bp, Homo sapiens
  misc_feature: GYAE6OF02IC67L.36.2.A02.1.454.CMB.1.raw
  modified_base (294)..(294): a, c, t, g, unknown or other
  misc_feature (294)..(294): n is a, c, g, or t
  modified_base (304)..(304): a, c, t, g, unknown or other
  misc_feature (304)..(304): n is a, c, g, or t
  modified_base (319)..(319): a, c, t, g, unknown or other
  misc_feature (319)..(319): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccacctatctgtgtctccaggagaaagagccaccctctcctgtacgggccagtcagagtgttagcagcaacttgcctggtaccagcagaaccgtggccacggttcccaggctcatcatctatggtncactccacgngggccagtcggtacnccacgtcctaacctttaggcgcgtaggtcgggtacgtggacaggtacgttcacgtcctacaccgtatcgacgccacgtccctagctagttcaggtaaacgtttgtttttcgacttttaggttttaacttacgttacgtaacctaaacgtaaggttaaacctaagttacgggtaccgttaccgggtccccctttacgttacccgtttaaccgggttttcccggggaaccggggttaacggggtaaccccgtaaggggtaccgggtaacgttaaccggttaacccggaaaaacccgggtttacgttacggggtaccggttacgttaccgggtaccctaacccgtacgttttacccggtcggttttaacccc

SEQ ID NO: 294211 - DNA, 533 bp, Homo sapiens
  misc_feature: GYAE6OF02F3W5Y.36.2.A02.1.454.CMB.1.raw
  modified_base (258)..(258): a, c, t, g, unknown or other
  misc_feature (258)..(258): n is a, c, g, or t
  modified_base (334)..(334): a, c, t, g, unknown or other
  misc_feature (334)..(334): n is a, c, g, or t
  modified_base (488)..(488): a, c, t, g, unknown or other
  misc_feature (488)..(488): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaaagcgcccacccttctcctggtacggcccagtccagagtgttagcagcaacttgcctggtaccngcagaacctggccaggttccccaggctcatcatctatggtgcatccaccgacgggccacgttcggtactccccganccctaccgtttagtcgcgtaggtgggtctaggggacaggactttcgacctctacgaccatcagcacgcctgcagtctagtaagttatttgcttatttattactgtacaatagtacaatgacgtgcctctctacgttcggcggacggacgtaggngagactacgaaacgtacgtgtacgtcgtagaccacattctgttac

SEQ ID NO: 294212 - DNA, 680 bp, Homo sapiens
  misc_feature: GYAE6OF02F8JQ7.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggaagaagagccaccctctccgtggtacgggccagtcagagtgttagcagctaacttagccgtggtaccagcaagaaacctggcctacggtccccaggtcctcatcatctagtggtcgcactcccgaccgacgggcctacgttggtacctccccgacgcctaacctttaggtcggcgtagggtcgggtcgtagggacgtagtacgttaccacgttcctactcctaactcacgccgacgtcctggtaccgtaggtacttaggaaacgtttagttttgaccgtttaagttttacgttacgtacgttactaaacgtacgtaacctaagttcgaacgttcggtaccctttcgtacgtttaaccgggttccgggtaaccgggaacggggtaaccgtaaggggtcggaaagttaccgtaaacggtaaaaccgggaacgtttgggtaaccggcgttacccggtaaccgtaacccgtggtttaccgttccgtttaacccg

SEQ ID NO: 294213 - DNA, 552 bp, Homo sapiens
  misc_feature: GYAE6OF02HTOZ5.36.2.A02.1.454.CMB.1.raw
  modified_base (323)..(323): a, c, t, g, unknown or other
  misc_feature (323)..(323): n is a, c, g, or t
  modified_base (341)..(341): a, c, t, g, unknown or other
  misc_feature (341)..(341): n is a, c, g, or t
  modified_base (405)..(405): a, c, t, g, unknown or other
  misc_feature (405)..(405): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagagccaccctctcctgtacgggccagtcagagtgttagcagcaacttgcctggtaccagcaagaaacctggccaggttcccaggctcatcatctagtggtgcatcccacgagggcctacgtggtacncccagccctacgtttagnggcaggtcgggtctagggacagtacgttcactctcaccatcagcagcctgcagtctagaagttntttgcttagttttatctgtacaatagtacatgtactgtacctctcgtacgtttcggaccgggagggtaccgagggtggaagtacgtaaccaaacggtacgttaggtacggtcttaccggacctaccttaacttccgtagtttacccg

SEQ ID NO: 294214 - DNA, 765 bp, Homo sapiens
  misc_feature: GYAE6OF02FTJIM.36.2.A02.1.454.CMB.1.raw
  modified_base (207)..(207): a, c, t, g, unknown or other
  misc_feature (207)..(207): n is a, c, g, or t
tcagtacgctgtctcacgaccggtgctcgatttagactcatctacagggggaggaactgctcagttaggacccagacggaaccatggaagccccagcgcagcttctcttcctcctgctactctggcctcccagatatcactggaagaaataggtgatgacgcacgtctccagcccaccctatctgtgtctccgaggaagaaacgacncctaccctctcctggtacggcctagtacagagttgttacgacgagacctaacttcggccgttacggtaccagccgaacggtaaacccgtgggaccgtacgggttccccaggcctacatccattcgtagtggtcgacctactacccgaaccggacggacctaccgttacggttaccaccccgtacgccccgttacggtttacggcgggtacgtcgggttccgggttacggtacgggtaacgtacggtacgtttacccaccctttaccgaccctaacgtctaccggtacgaccgtacgtaccccgttggaaccgttacggttaccgtaaggttaaacgttttagttttcccggtaacgttttaaagttttacctttacgttaccggtaactaacgtaacttaacgtagtacggtaccgttcgtccgttacccgtttagtaacccgggtttacgggaacgggtaccggtaacggtacggtagtaaccggtaaccgtaaccggtaaacgtcggttcgggtacgtaccgttcgaacccgtaaccttggttaccgttgttaccc

SEQ ID NO: 294215 - DNA, 719 bp, Homo sapiens
  misc_feature: GYAE6OF02JV11S.36.2.A02.1.454.CMB.1.raw
  modified_base (355)..(355): a, c, t, g, unknown or other
  misc_feature (355)..(355): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatccactggagaaatagtgatgacgcagtctcacgtcccaccctatccgtgtacgtcctaccgagggaagaaacgacgcccctacccttcctaccgttggtacgggccctaagtccagggagttgttagcagtcctaacttacgccgtcggtaccagcgaacgtaaacctcggacctacggttacccgacgcgtaccacgtcaccttcgtacgtcgggtanccgtacgtaccccaaccggacgggtcccacgttacgggtacctccccggaaccgtcccgttaacccggtttaggttccgggaaccttgggttccgggagttacggggactacggtacgttcctaccgtacctaccgaccgtataccacgtcacgtccgtacgcgtacgtaccttagtagttcgttttcgacgttacgtttacgttactccgttaacgtactaggttacaagtactacgtagtcccgttacttaccgtaccgttacgggaccgggtaacggtaccgtacgggtcggaacggtaacgtaacccgtaaggtacggtaccgtaggtcctaacggtccgtacttacgccgtttgtaccc

SEQ ID NO: 294216 - DNA, 687 bp, Homo sapiens
  misc_feature: GYAE6OF02GR1I0.36.2.A02.1.454.CMB.1.raw
  modified_base (208)..(208): a, c, t, g, unknown or other
  misc_feature (208)..(208): n is a, c, g, or t
  modified_base (230)..(230): a, c, t, g, unknown or other
  misc_feature (230)..(230): n is a, c, g, or t
  modified_base (243)..(243): a, c, t, g, unknown or other
  misc_feature (243)..(243): n is a, c, g, or t
  modified_base (266)..(266): a, c, t, g, unknown or other
  misc_feature (266)..(266): n is a, c, g, or t
  modified_base (293)..(293): a, c, t, g, unknown or other
  misc_feature (293)..(293): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (328)..(328): a, c, t, g, unknown or other
  misc_feature (328)..(328): n is a, c, g, or t
tcagtacgctgtctcacgaccggtgctcgatttagactcatctacaggggagctctgagagaggagcccagccctagggattttcaggtgttttcatttggtgatcaggactgaacagagagaactcaccatggagtttgggctgaggcgtgtcgtttctaggtcggctaatttaaaaggtgtcgagtgtgaggtgcagtctgttggngtcgtgggggagctggtacganccgtgggggtccngacgactctcctgtcgcagcctntaggacttcaccttagcagtcctatcncaagtnatcgtggccncgagcnccgaagggaggtntggagtgggttcacgagactaaagttagtagggtggggtactattaccgaactaacaacgtttacggacgttaaccgttcggggtagggggggtacccctttacaacccgttaacgtaccaaccgaggaacggaaccaaaccgcccggaagtacgggaccctaacggtacccgttaatttaaacgtcgtaacgtaaacgtaacgtacgacgaaccgtaacgtacgtacggacgtaacggtacggtaacggaaccggtaccggtacggttagttagttaaggttaacggtacggtacggtaacgtaacgaaccgtaccggtaaccggtaaccgtaaccgtaacgttacggttaggttacg

SEQ ID NO: 294217 - DNA, 726 bp, Homo sapiens
  misc_feature: GYAE6OF02I1MZ7.36.2.A02.1.454.CMB.1.raw
  modified_base (193)..(193): a, c, t, g, unknown or other
  misc_feature (193)..(193): n is a, c, g, or t
  modified_base (224)..(224): a, c, t, g, unknown or other
  misc_feature (224)..(224): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggagtttgggctgagctggtctttttctggtggcttagtttaaaggtgtcagtgtgaggtgnagctgtggagtcgtgggggagtcgttggacnggcggtcggggggtccctggagctctcctgtcgcacgcctgtaggcttcgtaacctttagcgagtctatcgtaccagttcgaccgtcgggtcccgaccgtcggaccgtaccggaagggtacggggacgtgggacggttcgggtcgtccggttacgttaagttagggtaggtaaggttggtttacgggttactaaacgtaacgtacggcgtacgtacccgttacgggtaggaaccgggcccttacgttaccgtactaccgttacctaccgtaaggtaaccgtaacgttacttaaccgaaacggtaccgtaacgtaccttcgtaacgttacgtacgtacgtaaactaaacgtaacgtaaccgtacgtaccgttcgggacgttccggaaaccggtcggaaaccgtaccggtacccttaattacgttacttaggaggtaaccggtaggtacggggtaggggtacggtcgggacttccggtcggtcggttccgtttaggtacccggg

SEQ ID NO: 294218 - DNA, 611 bp, Homo sapiens
  misc_feature: GYAE6OF02F906T.36.2.A02.1.454.CMB.1.raw
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagtacgctgtctcacgaccggtgctcgatttagactcatctacaggggggaggaactgctcagttaggacccagacggaaccatggaagccccagcgcagcttctcttcctcctgctactctggctcccagatatcactggagaaatagtgatgacgcagtctccagcccaccctatctgtgtctccaggagaaagcgcccaccctctcctgtagggccagtcagagtgtagcagcaacttagccttaggtaccagacaacgaaaccgtggacctacggttcccaggcctcatcatctagtggtcgcactaccgaccgacgggccacgtggtactacccacgcctacgtttaggcggcgtaggtcgggtcgtgggacngtacgtctacttcncaccatcgacgcaggtcctgactagtcgtaggtaatttgtttcgtacgtttaagttttacttacgttagtacctaaagtacgtaactaatccggtacttccggtccttcgttaccgttaccggttcgggccgggtacggtacgtagggcggtaacgtagtaaccgtaacgtacgttcggtagtcgttaaccgcctaacccgtgttacccgttagtcc

SEQ ID NO: 294219 - DNA, 718 bp, Homo sapiens
  misc_feature: GYAE6OF02IOHC7.36.2.A02.1.454.CMB.1.raw
tcagtacgctgtctcacgaccggtgctcgatttagactcatctacagggggaggaactgcctcagttaggacccagacggaaccatggaagccccagcgcagcttctcttcctcctgctactctggctcccagatatcactggagaaatagtgatgacgcagtctccagccaccctatctgtgtctccaggagaaagcgcccaccctctcctggtagggccagtcagagtgttagcagcaacttgcctaggtaccagacaacgaaaccgtggacctacggttcccaggctacatcgatctagtggtgcactccgacgacgggccacgtggtacctcccgagtccctacgtttgcgcgtaggtcggtcgtaggggaactaggtacgttaccacttcccgtactaaccgtacgtaccgaacgtccaacggcccgttggaccgtaacggttacgtacggtaaagtttcgttttacggacgtttaaaggtttttacttaccgttcgttaaccgtaacgttacgttaaactaagttaccggtaaccgttcgggtaccctttaccgttaaccgtttaccgggtttaccgggaaccggggtaaccggggtaaccgtaggggttacgggtacgtaaaccggttaacccgtaaaacgggttaaccgttgggttaccggtaccttacgggtaaccctaccggttaacgtttcccgttagtttaccccg

SEQ ID NO: 294220 - DNA, 680 bp, Homo sapiens
  misc_feature: GYAE6OF02H195B.36.2.A02.1.454.CMB.1.raw
  modified_base (554)..(554): a, c, t, g, unknown or other
  misc_feature (554)..(554): n is a, c, g, or t
  modified_base (563)..(563): a, c, t, g, unknown or other
  misc_feature (563)..(563): n is a, c, g, or t
  modified_base (585)..(585): a, c, t, g, unknown or other
  misc_feature (585)..(585): n is a, c, g, or t
  modified_base (616)..(616): a, c, t, g, unknown or other
  misc_feature (616)..(616): n is a, c, g, or t
  modified_base (673)..(673): a, c, t, g, unknown or other
  misc_feature (673)..(673): n is a, c, g, or t
tcagtacgctgtctcacgaccggtgctcgatttagactcatctacaggggagctctgagagaggagcccagccctgggattttcaggtgttttcatttggtgatcaggactgaacagagagaactcacatggagttggctgagcgtggtcttttctggtggtcttaagttttaaaaggtgtccagtgtgtaggtgcagtcttggttggagtcggtggggggagtcttgggtacacggtccggtcggggggtccctggacgaccttcgtccgtgtcgacgagtcctcgtggtacttctaccttagctagctatgcctatcgaccgtcggtccgcgaggtccacggaagggaacgggtcgtgggaggtcgggtcctcgttatagttacggtagtaagtttgggttaagttaaactaaccgtaaaacgtaacgtccaacggtcccgtcggttaacgggaacggtccctaccgttaccacctacgtcctccgaaggaactaacttaacgtaaccgaagaccgtactaccgttacgttagtaactccgtagaactaaanacggtaacncggtacctggacgtcggaccgngaaactcccgtactaagttacttgtcggtanacggtaaggttggggaggggtcggttgggacttccgtaccggtggttacccggttanaaccggg

SEQ ID NO: 294221 - DNA, 846 bp, Homo sapiens
  misc_feature: GYAE6OF02GA00Z.36.2.A02.1.454.CMB.1.raw
  modified_base (197)..(197): a, c, t, g, unknown or other
  misc_feature (197)..(197): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccacctatctgtcgtctcaggagaaagngtccaccctctcctggtaggccagtcagagtgttagcagacaacttacgcctacggtaccagcgaagaaacccgtggacccgtacgggttccccaggtcctacgactctactacgttagtggtacgaccacgtaccccgaccggtaacgggcctaacgtcgggtacctaccccgacggtacccttaaccgttttaggtcgggacgtacgggttcgggttacgtagggggaacctaacgggtacgtttaccctactccgttacccacctaacttcccgaaggtccctacggcccgtttacgaccgttaacggtttacgtaaggttaaacgtttacgttttaccggaaacgttttaaaggttttttaccttaaccggtttaaggttaaaccccgtaaaatttaaaccgggttaacgaaaccggttttaaccgggtcgttttaccccgggaacccgtttttcccttaaccggttttcccgggtttaaacccggggtacgggggttaaacccggggaacccgttagggggaaccgggttacggaaaccgttaaacccgggtaaaccggttaaccggttacgggttaaggtaccccgggttaaggaaccccccgttaaacgtttcccggttaccggtttacccgtttaaccccg

SEQ ID NO: 294222 - DNA, 748 bp, Homo sapiens
  misc_feature: GYAE6OF02JF7Y0.36.2.A02.1.454.CMB.1.raw
  modified_base (364)..(364): a, c, t, g, unknown or other
  misc_feature (364)..(364): n is a, c, g, or t
tcagtacgctgtctcacgaccggtgctcgatttagactcatctacagggggaggaactgctcagttaggacccagacggaaccatggaagccccagcgcagcttctcttcctcctgctactctggcctcccagatatcactggagaaataggtgatgacgcagtctccagccaccctagtctgtgtcctccgagggaagaaagcgccctacccttcgtccgtggtacgggcctaagtcaggagtgttacgcgaagtcaaacgtttcgccgttagggtaaccagccaaagtaaaccccgtggggaccctaggggtttacccccaaggtcctacgtacttaccaacttcggttacgttgggtaccnctaaacgtcccgaaccgtaggggcccttaacgttacggtaccacccgtacgtaaccttaccggtttggtagggccttaagggttcggggttacctagggggaaaccacgggttaacttacccgtaaccgttcctacgaaaccccgtggtaccctaacgggacctacgtccgtacgacgtacgtacgtagtacgttactttacgacgttacgtttaacgttcttagtactaactacgtaactagttacggtacctacggtaccttacgtcgttaacgttaccgggtaccgggtacgggaaccgtaggggttaaccgaggtaacgtaaccgaacgttaacggtcggttagacccgttagaccgttacgtaacgttcgtcttaaccg

SEQ ID NO: 294223 - DNA, 738 bp, Homo sapiens
  misc_feature: GYAE6OF02F6TNV.36.2.A02.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccacctatctgtgtctccaggagaaagngcccacctctccgtggtacgggccagtcagagtgttagcagcaacttagcctggtaccagacaacgaaacctcgggccacggttccccaggctcacncatcctagtggtgcactcccgaaccgacgggacctacgttcggtacctacccgacgtaccccttaccggttttaggacgggtacgagggtcggggttacgtaggggtaaccgaaggttacgttaccaaccgtttctaacccctaccgtaacgttaccgagtaccgtaccgtaccgttcggacccgtagttcggttaacggttaaaggttagtttttacggtaaccgtttaagtttttaacgtttaaccgttcggttaacctaaaccgtttaagtaaaccttaacgtaaggttaccgttaccggttaccttccgttacccgttacgttttaccgggaacggggtaaccgggtaacgtaacggggtaggtaacggtacgttaaccgtaaacggtaacgtagggttccgtacgcggtaccgtaaccgtacgttacgttacgtttaccg

SEQ ID NO: 294224 - DNA, 717 bp, Homo sapiens
  misc_feature: GYAE6OF02HY27F.36.2.A02.1.454.CMB.1.raw
  modified_base (187)..(187): a, c, t, g, unknown or other
  misc_feature (187)..(187): n is a, c, g, or t
  modified_base (217)..(217): a, c, t, g, unknown or other
  misc_feature (217)..(217): n is a, c, g, or t
  modified_base (338)..(338): a, c, t, g, unknown or other
  misc_feature (338)..(338): n is a, c, g, or t
  modified_base (430)..(430): a, c, t, g, unknown or other
  misc_feature (430)..(430): n is a, c, g, or t
tcagtacgctgtctcacgaccggtgctcgatttagactcatctacagggggaggaactgctcagttaggacccagacggaaccatggacgccccagcgcagcttctcttcctcctgctactcgtggcctcccagatatcacgtaggaataaatgtgatgaccgcagttcctccacgccccaaccctnttcgtgtgtcctaccgaggaagaaagaccnccctacccttcgtccgtaggacggccagtcaggtagtgttagcagactaacttcgccgtgtaaccagtacaacgaaccgtcggacctacggttcccaggtctacatcattactagtcgtcnctactacccgacgacggcctacgtcgtaccaccacgtaccttacgtttaggcggtagtgggttcggtacgtaggaactaggttactttaccncttccacctacgtactaggactccgacggtctgacgtacgttcgtaagttaacgtttcgtttagtacgtttaacgttttaacttaccgttaagtaaccgtaagtaaacgtacttaacggtaccggtacgtttcccggaaccctttgttaaacccggttttaccgggttaccggggaacgggtaacgggacggttaacgggtgtaaaccggtacgttaaaaccggtaaccgtttacggaggttaccgtaccgtaaccgtacctaccgtttaagtccgttccgttaacc

SEQ ID NO: 294225 - DNA, 677 bp, Homo sapiens
  misc_feature: GYAE6OF02FX09H.36.2.A02.1.454.CMB.1.raw
  modified_base (178)..(178): a, c, t, g, unknown or other
  misc_feature (178)..(178): n is a, c, g, or t
  modified_base (228)..(228): a, c, t, g, unknown or other
  misc_feature (228)..(228): n is a, c, g, or t
  modified_base (546)..(546): a, c, t, g, unknown or other
  misc_feature (546)..(546): n is a, c, g, or t
tcagtacgctgtctcacgaccggtgctcgatttagactcatctacaggggagctctgagagaggagcccagccctgggattttcaggtgttttcatttggtgatcaggactgaacagagagaactcaccatggtagttgggctgagcgtgtcgttttctaggtcggctatttaaaggngtcagtgtgaggtgcagctgtcggagtcgtgggggacgtcttggtaacgngtccgtgggggtcccctgagactctcctgtgcgacgcctctaggacttcgtaccttagcaagtctatcgcctaatcgaccgtcgggtccgcgtaggctaccgagggaacggcgttcggaggttcggtctcggtacttagtaggtaggtaacgttgggtacggtttaacaactaaacgttccgacgacgtacccgtcggtaggaaccggtccgtccgttacaacccgtatcccggtacgaacgaacgtacttaactacccgaagtacgacctaaccgttgtcgttaacgttacctcggaaaccttaagaccggtaaacncgtacgtaggtacgacggaccgaacgtacgtccgttaactaggttacttggtacgtacggtaaggtaacgggtgggggtacggggtacggttcggacctttccggtacggttcgtttacgttcggtaaccg

SEQ ID NO: 294226 - DNA, 790 bp, Homo sapiens
  misc_feature: GYAE6OF02H44OP.36.2.A02.1.454.CMB.1.raw
  modified_base (568)..(568): a, c, t, g, unknown or other
  misc_feature (568)..(568): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcacgtggaagaaatagtgtatgaacgcagtcctccagccaccctatctgtgtcctaccgaggaagaaagacgcccacctctccgtaggtaggccagtcagagttgtagcagctaactagccgtggtaccagacaacggaaaccgtggaccgtaccggttacccgaggccttacgacttacctaacgttccttaaggttcggggtactacccgtacgtaaccccgaacccggaccggggtaccctaacggttacggttaaccctacccccggacgtaccccgtttaacccggttttaggaccgggtacgtacggggttcgggttaccggtaacggacgtaacgtaccggttacctaccttccgtacccaaccctcgttaaccgaccggactaccgtccgttacggaccgttacgtacgtaaggtaacggtttnttttacggacgttttaaggttttacttacgtaaccgttaaccaaacgtaacggttaactaacggttagtaccggttcccgttaccgttaccgttaccgttaccgggttaccggggacggtaaccggggtaaccgtagggaaggtaacgtacgggtaacgtaaacccggtaggttaggaccggttagtaccctaacgtaccgttacgttccgttaacgttccg

SEQ ID NO: 294227 - DNA, 641 bp, Homo sapiens
  misc_feature: GYAE6OF02I0FO9.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctggtacgggccagtcagagttgtttacagcacctacttagcctaggtaccagcaagaacctggaccaggcctcccgaggcctcctctactctagtcggtcgcctactccgaggtaccgggccctaacgtcggacctacgtccccgaagtaccgacggtttccaaggtcggcgtaggttcgggtcgtagggactaagtaccttcaccgtctaccacatcagcagtacgtggtacgcgttaggaacgttgtttcggacgtttagttacttaccgtacgtaacctaactacgttacgtaccgggttaccctcgttacgttacgttacccgttacggtttccggaccggtaacggggacctacgtacgtagggaactaccgtaaacaacggttacggtcggttacggcctaccgactaaccttagttccgttaccg

SEQ ID NO: 294228 - DNA, 689 bp, Homo sapiens
  misc_feature: GYAE6OF02IOUAJ.36.2.A02.1.454.CMB.1.raw
  modified_base (190)..(190): a, c, t, g, unknown or other
  misc_feature (190)..(190): n is a, c, g, or t
  modified_base (344)..(344): a, c, t, g, unknown or other
  misc_feature (344)..(344): n is a, c, g, or t
  modified_base (414)..(414): a, c, t, g, unknown or other
  misc_feature (414)..(414): n is a, c, g, or t
  modified_base (488)..(488): a, c, t, g, unknown or other
  misc_feature (488)..(488): n is a, c, g, or t
tcagtacgctgtctcacgaccggtgctcgatttagactcatctacagggggaggaactgctcagttaggacccagacggaaccatggaacgccccagcgcagcttctcttcctcctgctacctctggcctcccagatactcgactggaagaaatgtgatgacgcagtcctccgagcccacctatctggtntccacgaggaagaacgcgcctaccctctcgtagtacggctacgcagtgttgtacgacagactaacgttcgccgttaggtaaccagtaccaacggtaaaccgtcgggtccgtaacggttcccgaggtactacctatacctattctgttacggganacctactacccgacgggtacggacccttaggtacgtacctaccccgagtaaccccgtttacgtttacggnggaaccgtggggttacgggtacggtaggacggttaagtcttaccaacttccgactacgtataccgcacggtacnccgtacggacgttacgttaagacggtttaacgtttcgtttactaccgtttaaggtttttaactcgtaacgtaacactaagtaccgtaatcgtacgtcgttacctccgtacgttcgtaccggggacgtacgaaacggttgaggaacgtaagaccgttaaacggtgttacggcttcgaccgaacgtctcgttcgtcttacccg

SEQ ID NO: 294229 - DNA, 687 bp, Homo sapiens
  misc_feature: GYAE6OF02GFOAV.36.2.A02.1.454.CMB.1.raw
  modified_base (198)..(198): a, c, t, g, unknown or other
  misc_feature (198)..(198): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagccaccctatctgtgtctccgaggagaaagngccaccctctcctgtaggccagtcagagtgttagcagcaacttagcctggtaccagcagaaacctggccaggttcccaggctcatcatctagtgtgcactccaccagggccacgtggtactcccgacgccctaccgtttaggtcggcgtaggttcgggtcgtggggacaaggtacgttccaacttccgtccaaccctagttaccgacgtcccacggtaccccgttggacctacggttaccgtaggtaaacgtttatttttacggactttaaggttttaacttaccgttagttaccaaacgtagttaacctaagttacgaccgttacgggtccccttcgttaccgttaaccggtttccgggaccgggtaaccgggaacccgttaaggggttcggtaaacggtaacgttaacccgaaaaccgggtaacgttcgggttaaccgggacgttacggacccttaacccgtacgtttcccggttacggtttacccc

SEQ ID NO: 294230 - DNA, 665 bp, Homo sapiens
  misc_feature: GYAE6OF02JGEEC.36.2.A02.1.454.CMB.1.raw
  modified_base (500)..(500): a, c, t, g, unknown or other
  misc_feature (500)..(500): n is a, c, g, or t
  modified_base (655)..(655): a, c, t, g, unknown or other
  misc_feature (655)..(655): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcagtctccagcccaccctatctgtgtctaccgaggaagaaacgacgcccacccttctcctaggtacgggccaggtcagagtgtagcagctaatacgcctaggtaccagacaacgaaccgtcggaccacggttcccgaggctacactacatctagtggtcacactaccgaaccgacgggtaccctacgttacggtacctaccccgtacgtacccgttacctttaggaccggacgttaggtcgggtacgtacgggtaactagggtacttactacgttccaccgtacctacgttacacgaccgtacgtccgtagaccgttagtacgtacggtaatttaccgtttnacgtttaacttttacgttacgtagtaaccaacgtaattacgaacttcgtaccgtcgttacctcgttacttaccgggttacggacgggacggttacgacggttaaggacacgttaacgaacgtaatcgggtacgacgttcgaaccgacgtacgttnttaccgtacc

SEQ ID NO: 294231 - DNA, 746 bp, Homo sapiens
  misc_feature: GYAE6OF02HXPTB.36.2.A02.1.454.CMB.1.raw
  modified_base (105)..(105): a, c, t, g, unknown or other
  misc_feature (105)..(105): n is a, c, g, or t
  modified_base (165)..(165): a, c, t, g, unknown or other
  misc_feature (165)..(165): n is a, c, g, or t
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagtacgctgtctcacgaccggtgctcgatttagactcatctacagggggagaactgctcagttaggacccagacggaaccatggaagccccagcgcagcttcncttcctctgctactctggctcccagatatcacgtggagaaatgtgatgacgctacgttcnccagcccacctatcttgtgtccacgaggtagaaagcnccacctctcgtgacggcagtcagagtgtacgnagctaacgtagcctagtaccagcaacgtaaccgtggccgtacggtccaggtctctacgtacctattcgttaacgtcgggtagaccgtaacttaccccgtacgggaaccggttccccgaacgtttcggttaaccgtacccccgacggttaccccttaaccggttttaacggcgggttaacctggggtccgggttacgtacgggtaacgtaggttaaccgtacccgtaccgttcctaccacgttaccgtacgaacgtcgtaacgttccgaccgtagtaccgttacgtagggtaaactttcggtttactaacgtttaacgtttaacgttacgttaacgtacgtaacgttaacgttaacgtacgtaaccggttacctaccggttccttacggttaacttccgggttacggaaccgggaaccgggtaccgtacggggtacgtaacgtaacgaaccggtaaacgttcggtacggtaccggtccgtacggaccttaccgtacgttaccgtacgtttccg

SEQ ID NO: 294232 - DNA, 789 bp, Homo sapiens
  misc_feature: GYAE6OF02GLFQL.36.2.A02.1.454.CMB.1.raw
  modified_base (514)..(514): a, c, t, g, unknown or other
  misc_feature (514)..(514): n is a, c, g, or t
tcagtacgctgtctcacgaccggtgctcgatttagactcatctacgaggggaaagggggaagaagagctgctcagttaggacccagagggaaccatggaaaccccagcgcagcttctcttcctcctgctactctggctcccagaccaccgaccggtaggtaggttcgtgttgaccgtctacgtttccagaccacccgtttgttccttttacgtccttccgaagggacgaacgacggaccgaccccacccttccgtaccgtggccgaacgggcctacggtacagtacgtactacgaaggaaccgcgtaacctaccggtacggaccgttacgggtaaccgacgaacggtaaccgtcggaccacggcccctacccgtacgtccctccgtacacgttaccgtagtcgacttcgacctaacgttaccggaagggtccgggcccgtacgtcggaccctacgtacccgaagtaccggttaggttcgacgggtggacggtagggtcgggtcgtacgggaacncgttaccgtccgaccgtacctaccaacgtctacgacgacgtacggtaccgtaccggtacctaaagggtacttccggttacgtacgttaacgttactttaggtacctacgtcgtaacgtcgttaacgtaacgttacgtaccttaccgtaccggttaccgggtacggttaccggaacggtaaccggtacggtaacgtacgtaaccgtaacggtaaacgtacgtacggtacgtccgtaccgacggttaccgtacgtttcggttaccttcgttaacccg

SEQ ID NO: 294233 - DNA, 697 bp, Homo sapiens
  misc_feature: GYAE6OF02HHTW2.36.2.A02.1.454.CMB.1.raw
  modified_base (565)..(565): a, c, t, g, unknown or other
  misc_feature (565)..(565): n is a, c, g, or t
  modified_base (658)..(658): a, c, t, g, unknown or other
  misc_feature (658)..(658): n is a, c, g, or t
tcagtacgctgtctcacgaccggtgctcgatttagactcatctacaggggagctctgagagaggagcccagccctgggattttcaggttgttttcatttggtgatcaggactgaacagagagaactcaccagtggagtttgggctgagcgtgtcgttttctaggtggacttaatttaaaggtgtaccgagtgtggaggtcgcgagtcttaggttggagttcggtagggggagtccgtttaggacgacggtccggtacgggggtccctaggacgtcctctccgtgtcgcgacgtccgtcgtcggtacttccgtaccgtttagctaggtcttacgtcgcctaacgtcggtacccggttcgggtccgccggtacggtccgtaccggaggggtaacgtacgtgggaggttcggtcgttaccgttagtaattagggtaggtaacggttgggttaacttacgaacgttaaacgccgagtacgcccgtttacggaggacccgggtcctcttccgaacctgtcctacgacgtacgtacgttactacgagacgacctcttcgtaattcgttacngtaaataccgtaagaactacgtacgtgtaacgtcggaccgaacggtaccgacgtaccttaatgttacgtggtcacggtaaggtgggtaagggngtcggtacttcgtcggttacggttccgttaagtaccggg

SEQ ID NO: 294234 - DNA, 843 bp, Homo sapiens
  misc_feature: GYAE6OF02F8Z6R.36.2.A02.1.454.CMB.1.raw
tcagtacgctgtctcacgaccggtgctcgatttagactcatctacagggggaggaactgctcagttaggacccagacggaaccatggaagccccagcgcagcttctcttcctcctgctactctggctcccagatatcacgtggagaaatagtgatgacgcagtctccagcccaccctatctgtgtctccgaggagaaagcgccacctctccgtggtacgggccaggtacaggtagttggttacgcacgactaacgttacggccgttacgggtaaccaaggaccgaaacggtaaaacccgttcggggtacccgtaacgggtttacccccgacggggtcctacgaacttaccgtaagttaccgttaaggttggggttacgaccgtaacctaccccgaacccggaccggggtaccctaacgggttacggtaacctaccccgtaacggtacccgttaaccgttttagggacggtacggtacgggtcggggttaccggtaggggtaacgtaacggtacgtttacaccgttcctaccgtaaccgtactaccgacgaccgtacggtcctacggtcctaggttaccgttaaggtaacgttttagtttacggtaacttttaaaggttttaccgtttaacgttacgtaaccgtaaacgtacggttaaactaagttccgtaccggttacccggttccttaccgttaccggtttaaccgggtttcccggggaacggtaacccggggtaaggtaacgggttaacggaacgttaaccggaaaaccggtaaacgtacggttagggtaccggtacggttaacgtacccgttaacgtactttaccggtcgtttaacccgg

SEQ ID NO: 294235 - DNA, 821 bp, Homo sapiens
  misc_feature: GYAE6OF02IFUJ0.36.2.A02.1.454.CMB.1.raw
  modified_base (145)..(145): a, c, t, g, unknown or other
  misc_feature (145)..(145): n is a, c, g, or t
  modified_base (816)..(816): a, c, t, g, unknown or other
  misc_feature (816)..(816): n is a, c, g, or t
tcagtacgctgtctcacgaccggtgctcgatttagactcatctacagggggaggaactgctcagttaggacccagacggaaccatggaagccccagcgcagcttctcttcctctgctactctggctcccagtatatcagtggaanaaagtagtgaatgacgcagtacgtccaggcccaccttatctgttcgtacctaccgaggaacgaaaagccgaccctaacccttcgttccgtaggtaccgggtacctaacgggtacaacgggtaaggttacgtttaacggcgtaaacgtaccgttaaaccgtttacggaaccccggtttgtaaacccggacgaacccggttaaacggaaaaccccggttgggaaacccccgttacgggtttaccccgaacgggttacttacccgtaaccgtaacttaccttacggtttacggttaccgttacgaaccttaacccgttacccccgaaacggtacccgggtaaaccgtaacccgttacggtaacccgtaccccgaacgtttaccgttaccggttttacggacgtcgggttaacgggtcgggtaacgtaacgggtacacggtttacgtacctaaccgtcccgtaacctacgtaaccttcgaaagcccgtaaccgtcgaccgtacgttaaccgtagttaacggtaagtttaccgttagttaccgttaattttaacgttacgtacgttaactaacgtaacgtactagtaccgtcgtactcgttactacgttacgtcggagggaaccgacggtagagtacaacgacgtaacggtagcgtaggctacgagtctattcgtntaccg

SEQ ID NO: 294236 - DNA, 833 bp, Homo sapiens
  misc_feature: GYAE6OF02HA328.36.2.A02.1.454.CMB.1.raw
  modified_base (242)..(242): a, c, t, g, unknown or other
  misc_feature (242)..(242): n is a, c, g, or t
tcagtacgctgtctcacgaccggtgctcgatttagactcatctacagggggaggaactgctcagttaggacccagacggaaccatggaagccccagcgcagcttctcttcctcctgctactctggctcccagatatcactggagaaatagtgatgacgcacgtctccgagcccacctatctgtgtctccaggagaaagacgcctaccctactcctggtacgggccagtcagtacgtgttaanccagaccaacgttacgccgttacggtaccacgaccgtaacgtaaaccgttcggacctaaccgggttccccgaggtcctacgtactactaactccgttaagttgggtacgtacctaccgtaaccccaccgggaccgggtacccgtacgttaccggtacctacccccggaacgtaccccgttaaccgtttaggtaccggtaccggttaggggttccggggttacgggttaccggggaacgttaacgggttacggtttaccccgtaaccgttcccttaaccccggaacctaccgttaccggaaccgaccgtaacccggttcccgtaacggtacccgttacgttacccggttaaaggtaaacgggttttacgttttaaccggtacgttttaaccgtttttaacgtttaaccggtaccgttaacgtaaaacgttaccgtaaacgtttaacgttacggtaccggttaccgtaccctttagtttacccgtacggtttaccgggacgggtaacgggtaccgtagggtaacggacgtaacgttaaccggaagttaacgtggtccgtacgtacggacctacggtacgtgttaccgttaccg

SEQ ID NO: 294237 - DNA, 810 bp, Homo sapiens
  misc_feature: GYAE6OF02JSXTZ.36.2.A02.1.454.CMB.1.raw
tcagtacgctgtctcacgaccggtgctcgatttagactcatctacaggggagctctgagagaggagcccagcccgtgggattttcaggtgttttcatttggtgatcaggactgaacagagagaactcaccatggagtttgggctgagtcgtggtctttttcttgtggtcttaattttaaaaggtgtaccagtgtgaggtgcagcgtgttggaggtcgtagggggagtcgttggaccgagtccggtgggggtccctggtacgacctcgtcctgtcgcctacgccgtcgtggtcttcctaccgttacgcagctatgactatcgaccgtcgggtcccgccgacggtccgtaccggtagggaagggtaccgtagggtaccggttggtaccgtcgttacgttacgttaaggtacggtaagggttcgggttaaggtttaacgtaaaaccgtaaacggttaaccgacgtaccggttacccgtacccgggtaccgggaaacgggttcccgttccgttaaccgtacccgtaaccgttacccgtaaccgaacggtaacggtaaacccttaacgttaacccgaaacggtaaccgtaccgtaaccgttacccgtttaggtaactccgttacgaaacttaaaccgttacgaaaccgttcgtaaccgtacgggtaagtacggaacccggtaacgacccggaaccggttacccttaattacgttaacgtttcggtaacggtaacggttaggtccgggggttaacgggggtgggttaaccggggtacttaccgggttcgttacggggttacgtttacggtaaccgg

SEQ ID NO: 294238 - DNA, 819 bp, Homo sapiens
  misc_feature: GYAE6OF02I3JOV.36.2.A02.1.454.CMB.1.raw
  modified_base (146)..(146): a, c, t, g, unknown or other
  misc_feature (146)..(146): n is a, c, g, or t
  modified_base (204)..(204): a, c, t, g, unknown or other
  misc_feature (204)..(204): n is a, c, g, or t
tcagtacgctgtctcacgaccggtgctcgatttagactcatctacaggggagctctgagagaggagcccagccctgggattttcaggtgtttcatttggtgatcaggactgaacagagagaactcaccatggagtttgggctgagntggtctttttcttgtggtcttattttaaaaggtgtcagtgtgaggtgcagtctgttgngtcggtgggggagtcgttggtaccgaggtcccgttcggggggtaccctggacgtactccgtccgtgttcgcgacgtcctcgtggtacttccgttaaccgtttagctagcgttactcggtaccagttccggaaccgttcgggggtaccccgtaccgacgggtaccccgtaccgggaaggggggtaaaccgggaccggttagggacgggtttagggtccgtttaccggtcgttaaagttttacggggtgggttaacgggttggggtttagtttaaacgtaaacgtaaaccgtacgtaccgacgtcccgttccgggtaacggtaccggggcccgtacctaccgtacctacgtaccgccgaacgtagaccttaccttaaccgaagtcgtactacgttctttacgtagttaccgtagaacttaaacgttacgaacgttaaccggccgtaaggtccgtaccggaccgggtaaaccggtacccggttaacccgacccgtttaattacccgttttaagttccgggttaaccggtaaccggtaaaaggtgggggttaggggtaaccggggttcgggtacccgttccggttacccggttcgggtttacgttaccggtaacccggg

SEQ ID NO: 294239 - DNA, 493 bp, Homo sapiens
  misc_feature: GYAE6OF01DNAN5.25.67.G01.1.454.CMB.1.raw
  modified_base (305)..(305): a, c, t, g, unknown or other
  misc_feature (305)..(305): n is a, c, g, or t
  modified_base (465)..(465): a, c, t, g, unknown or other
  misc_feature (465)..(465): n is a, c, g, or t
  modified_base (469)..(469): a, c, t, g, unknown or other
  misc_feature (469)..(469): n is a, c, g, or t
  modified_base (486)..(486): a, c, t, g, unknown or other
  misc_feature (486)..(486): n is a, c, g, or t
tcagactgtacagtcacgaccggtgctcgatttagagtatacatattgggtttgggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacatttggtgctttataactatgtctcctggtcccaacaacacccaggcaaggccccaaatcatcatttangatgtcagtcatcgcctctggagtttctgtcgcttctctggctcaagtctggcactcggcctcctgaccatctcgggctccgaggctgagacgaggctacttattatgctatttcatacagagacacacagtctggtgtcgcggaggacagtgaccgtcngtcngccagctcgcccctgcnctctccg

SEQ ID NO: 294240 - DNA, 567 bp, Homo sapiens
  misc_feature: GYAE6OF01BOP7E.25.67.G01.1.454.CMB.1.raw
  modified_base (451)..(451): a, c, t, g, unknown or other
  misc_feature (451)..(451): n is a, c, g, or t
tcagactgtacagtcacgaccggtgctcgatttagagtatacatattgggtttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcattaattttgagaccagtaagcgccctcgtgggtttctagtcgattcactggctccaagtctggcaacacgcctacctaacaatctactggctccaggctgaagacgagtcttgtttattctgtctgttgctatgtgctagaaaactagtttggngtcgtcgggacggacgggaccctaagttcgaccgttacttaagtcaacgccccgaaggtccctcggccccccttcggtccacttcctccgttaccccacccttcccgtcgtaaccg

SEQ ID NO: 294241 - DNA, 743 bp, Homo sapiens
  misc_feature: GYAE6OF01BWZ30.25.67.G01.1.454.CMB.1.raw
  modified_base (229)..(229): a, c, t, g, unknown or other
  misc_feature (229)..(229): n is a, c, g, or t
  modified_base (506)..(506): a, c, t, g, unknown or other
  misc_feature (506)..(506): n is a, c, g, or t
tcagactgtacagtcacgaccggtgctcgatttagagtatacatattgggtttggggggggtcacaagaggcagcgctccgtcgggacgtctccaccatggccgtgggctctgctgactcctcactctcctcactcaggacacgagggtccgtcgggcccagtctggcctgacctcaacctgccctccgtgtcgtgggtcctccgtggacgtcaatccacctatttccngcacgtcggaaccagcacgtgattggttggcttacttcgacctttgtcttcgttacggtaacccaaacaaccgacccggaacaaacggtcctacctaaactctaatttaagttttgaacgaccaagtaacggccggtacccttcggttcggggtttctagtcgtacttcgacgtcggcctaccgaagtcgtaggaccaaccgaccggtccctaccctaaacaacttcctcgtcgggcctccgaggtctagaacgacgaggtctttgtttactttcgngtctttggttcgtacgttagtggtacgtacttaagtaaaacgttagtttgggtcgtccgtacggggtacgggaacgggtacttaccgtaagtttccggtaacccgtttacgttaaacggtaccgtaacggaccccggtaaagggtcccgttacccggtcccccccggttaggttaccccgttacccgtttcccgtttcccgggtttcccccccgtcccccgtttcccgttaaccccg

SEQ ID NO: 294242 - DNA, 989 bp, Homo sapiens
  misc_feature: GYAE6OF01CJZPG.25.67.G01.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
tcagactgtacagtcacgaccggtgctcgatttagagtatacatattgggggtttgggggggggtctaccaaaggagggtccagtcgctctcgggacgtctccaccataggcctgggctctgctgctccgttcgactctcctcacgtctaggtacactagggttaccgtgggcccagtcgtggcctgactcaacctgcctcgtgtgtgggtctcgtggacggtcaagtccaccgtactttccgngccactcggaaccngccaacgtcgtattggttgtcttacgtttcggtactttggttcttcgtttacggttaccgaaacaaccgtacccgggaactaaaacggccgtaccaaaaccgtacctaatttaaacgttttttacggaacggtaacccggtaacggttaaacgggccgggttaccccggttcgttttagggggtttttccgttaaagggttccggttaacgtttaccgtaaccggttacggggtaccgttacccgtaaaggttccgtttagggaccgtaaaccggtacccgggttccccgttaacccgtaaaacgtaacgttccgttacggttacgggtcccgtacccgaacgggttcccgtaacgggtaaaccgggaacgggtaacgggtaccgttttaacggtttttaacgttttacccgtttacggtaccggttttacggtttaacggttaacctttaacggttacgggttaccggttaaccgtttaaacgggtaaaaaccgtttaagggtttttcggggtacggttaccgggttaaccggggggtacgggggtaaacccggggttacccttaaagggttttaccggtaacccgtttaggttttaaaccggtccgtaaaaccggttccccgtaaacggggttccttacccgggttaccccgttacggggttaaccctaccggtttaccggtttacccgttaccccgttaccccgttcccgttaccgttaaccccgggg

SEQ ID NO: 294243 - DNA, 889 bp, Homo sapiens
  misc_feature: GYAE6OF01CJS74.25.67.G01.1.454.CMB.1.raw
  modified_base (219)..(219): a, c, t, g, unknown or other
  misc_feature (219)..(219): n is a, c, g, or t
tcagactgtacagtcacgaccggtgctcgatttagagtatacatattgggtttggggggggtcacaagaggcagcgctctcgggacgtctccaccatggcctggctctgctgctcctcactctcctcactcaggacacagggtcctgggcccagtctggcctgactcgaacctgcctccgtgtcgtggtcctcgtggtacgtcaatccacctatttccngcactacggaaccagccacgttgagtttcgttggtacctttacgtttcgtaccttgttccttaccgtttacggtaaacccaaaaccgaaacccgaaccccgggtaaacaaaccggtcctaaccctaaacttacttaaacttttaagttttacggaaccgtaacccgtaaggtaaccgccccgggttacccgtttagggtttaccggggttttctaacgggttccttaacgttccgaaccgtttccggtaccgttacccgtaaggttccgttacccgggaaaccgtaaaccggaccccggttaaccccttaacccgttaaaactaacgttccgttacggttacggacccgttaccggaaggtacccgtaaggtaaacgggtaccggtaggttaccgtttaacggtttttaacgttcgtcgtcggtttaccgttgtacccgtttgttcggtaccgtaacggttaaaacgtaaaccggttttaaggtttcggaccggttacgggtacggggaaccggttaccgggtaaacccgttaacgggtttacgtaaccggtttacctaacggttccgaaaaccgttcccggaaacggtcccttacccgggacccccgtttcggtaaaccccgtctttacccggtaccctttacccccgcccttcccggtaaccttacgg

SEQ ID NO: 294244 - DNA, 563 bp, Homo sapiens
  misc_feature: GYAE6OF02GQR0T.25.67.G01.1.454.CMB.1.raw
  modified_base (216)..(216): a, c, t, g, unknown or other
  misc_feature (216)..(216): n is a, c, g, or t
  modified_base (547)..(547): a, c, t, g, unknown or other
  misc_feature (547)..(547): n is a, c, g, or t
tcagactgtacagtcacgaccggtgctcgatttagagtatacatattgggtttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacacccggacaaaggctccaaactcataattttgagaccagtaagcggccctctggggtttctagtcgattcactggctccaagtctggcaacacggcctcctaacatctctggctccgagctgaagcgaggctgtttattctgctgttgctagtgtgctagaaaactagtttggtcgtcgtcggacgggtacgggaccctaagttcgaaccgttcttaagtcagacccgtaaggcctccggacccccgtcggtcctacgtccgttccgttccccncccttccctctacccg

SEQ ID NO: 294245 - DNA, 671 bp, Homo sapiens
  misc_feature: GYAE6OF02IRP0Y.25.67.G01.1.454.CMB.1.raw
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
tcagactgtacagtcacgaccggtgctcgatttagagtatacatattgggtttggggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacgtatttccngcagtggactcagcactgatgttgctagttattacttgtctctcggtacaacacaccagacaacgacccctaaattatcctatttangtacgacctaacgtaacgccggtaccctacgtacggtacgtttactaacttccgtctttctcgtcgggtacctaccgtaagttccgtaggacgtacgaccgtaacccggcccttacccgtacgactaacgttccgtccgtcgggtcctacccgtaggacgttcgggaacgggacggtaacggttcgttacgttaagtttaactacgtagtacctaccgttctaagtacgtacggacctaactactaccgtaactaaacgttcccgtacgttaccggaccgttacggaccgtacgggtaccaccggttccggtacggtccgtaaccggacccgtaaaccggaccccgtaacctcccgtacgttacccg

SEQ ID NO: 294246 - DNA, 734 bp, Homo sapiens
  misc_feature: GYAE6OF02ICKCY.25.67.G01.1.454.CMB.1.raw
  modified_base (217)..(217): a, c, t, g, unknown or other
  misc_feature (217)..(217): n is a, c, g, or t
tcagactgtacagtcacgaccggtgctcgatttagagtatacatattgggtttgggggggggtcacaagaggcagcgctctcgggacgtctccaccatggcctgggctctgctgctcctcactctcctcactcaggacacgagggtcctgggcccagtctggcctgactcaacctgcctcgtgtcgtggtctccgtggacgtcaatcaccatttccngacactggaaccagcaacttgacgttggttcggcttacctttgtacccttgtccttcgttagtaaccaacgaacaccggaacaaaggactaccaaactactaatttaacgtttttagagtaccgtagtaacggccggtccctacgttcggggtttactaggtaccgtagttccaacgtcggtcctaccaagttctacggacaaaccgtacccggtacctaaccctaaactaattccgttcgtacgggtcctaccgtaggtacgtacggaaacggtacgtaggtcctttagttttaatttcgttacgtcgttagttaggtactttagtcggttaggtaccgttaaagaaaaacgttagttttcgggtaggtccgtaccgggtaacgggaccggtaaacccgttagtacggtaaccgtttaacgttaacgcgaacggtacccggaaggttcctccggtaccccccgttaggtcctaaccttccggttcccgttaccccgccccttacccgtacctaccg

SEQ ID NO: 294247 - DNA, 633 bp, Homo sapiens
  misc_feature: GYAE6OF02GMTXZ.25.67.G01.1.454.CMB.1.raw
  modified_base (217)..(217): a, c, t, g, unknown or other
  misc_feature (217)..(217): n is a, c, g, or t
  modified_base (229)..(229): a, c, t, g, unknown or other
  misc_feature (229)..(229): n is a, c, g, or t
tcagactgtacagtcacgaccggtgctcgatttagagtatacatattgggtttgggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcactatttccngcactggaaccngcactgatgttcggactactttcgaccttgtctcttggtaccaacaacgaccgacaagcacaacactatatttgagacagtaacgcgcctcgttcggttactagtcgtattcgactggtcctactaagtctcggacaacgaccgtacctaccctaacaactcgtcgtacggacctaccgagtcgtacgaacgtacggacggtacttagtttacttcgtgtcttcgttagtcttagtggtacggtactaagtaaacttagttggtacgtcggtccgggacgggtaacggtacctaagtccggtaacttacgtaacggttacgaccggtaccggtacggtccgtaccggtccccgttacggtcctaccgttccgttacccgttccccgtcccttccctacctaccg

SEQ ID NO: 294248 - DNA, 636 bp, Homo sapiens
  misc_feature: GYAE6OF02F2070.25.67.G01.1.454.CMB.1.raw
tcagactgtacagtcacgaccggtgctcgatttagagtatacatattggggtttgggggggggtcacaagaggcagcgctctcgggacgtctccaccatggcctgggctctgctgctcctcactctcctcactcaggacacagggtcctgggcccagtctggcctgactcaacctgcctcgtgtctggtctccgtggacgtcaatcactatttcctgcactggaaccagcactgattgtggtcttactttgaccttgtctcttacggtaccaacaaccacccggacaaacggcctaccaaactcattaattttagacgacagtaacgcggcctcgttcggggtttctagtcgtattcacgtcggtctactaagtctcggacaactaccggccttaccaaactactcctcgttcggcctcgagtctaggaacgacggtaggtcctttagttttacgtttcgtgtccgtttgttcgttactagttcgtggtactaacgaaacttagtttggtgtcgtacgggcgggtacggtacctaagttcgtacgttcgttacgcaccgaccgaacgtccgtcccggtaccccgttggtacctaccgttccgtttccgtaccccttaccccgtcctaccgttaccg

SEQ ID NO: 294249 - DNA, 854 bp, Homo sapiens
  misc_feature: GYAE6OF02HREGG.25.67.G01.1.454.CMB.1.raw
  modified_base (234)..(234): a, c, t, g, unknown or other
  misc_feature (234)..(234): n is a, c, g, or t
tcagactgtacagtcacgaccggtgctcgatttagagtatacatattgggtttggggggggtcacaagaggcagcgctctcgggacgtctccaccatggcctgggctctgctgctcctcactctcctcactcaggacacgagggtcctgggcccagtctggcctgactcaacctgcctccgtgtcgtggtctccgtggacgtcaactcacctatttccgtgcacgtcggaaccngacaacttgagttggttcggtactttacgttttagtccgtttcggttccttccgtttaccggtaacctaaaccgaaacccgaaccccgggaaaccgtaaaaccggtacctaacccgtaaaaccttacgttaaacttttaaacgttttttacggaaccgttaacccggtaaaggtaaccgggtcccggtaccccgtttacgggtttccgggggttttaccttaacggttacgtacctttaccgacgttccggtaccttaccgtaacgttcgtaacggaccgtaaaccgtacggtcccctaaccgtaacaacttcccgtacgtcggcctaaccgaggtacgtaacgaacggtaccggtacggtttacgtttcgtttaagtttacgtcggttacgttgttacggtaccgttgttacgttacggtaaccgttaaggtaaaacgtttacggtttagggtccgttcgggaaccgggttacggggtaacccgtaaccgttaaacggtttcgtacccgttaacggttacgtaccgtcggtaacccggtcgcccgttacccggacccgttacggtaccttaccgtttccgtaccccgttaccccttacccgtacccgtacttaacccgg

SEQ ID NO: 294250 - DNA, 531 bp, Homo sapiens
  misc_feature: GYAE6OF01B0093.19.3.A03.1.454.CMB.1.raw
  modified_base (492)..(492): a, c, t, g, unknown or other
  misc_feature (492)..(492): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccgagggaaggggctgggagtgggtctcttccattaataaacatgccagtgacatgtactacgcagacgcacgtggagggccgattcaccatctccagagacaacgccaggagctcacttgtttctcacatgaacaactcgacccccgaggactacagctatatattattgtggagagaagagtgggggngtcgtcgttcgggcacgggacccggtcgccgtcgtcccg

SEQ ID NO: 294251 - DNA, 526 bp, Homo sapiens
  misc_feature: GYAE6OF01BKPAH.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccagggaaggggctggagtgggtctcttccattaataaacatgccagtgacatgtactacgcagacgcactggaggccgattcaccatctccagagacaacgccaggagctcactgttcttcacatgaacaacctgacccccgagactacagctatatattattgtggagagaagagtgggggagtccgtgttcgggcgagggacccgggtcgccgtcgtcccg

SEQ ID NO: 294252 - DNA, 701 bp, Homo sapiens
  misc_feature: GYAE6OF01DOBWA.19.3.A03.1.454.CMB.1.raw
  modified_base (295)..(295): a, c, t, g, unknown or other
  misc_feature (295)..(295): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtcgtgggggaggcctggtcaagccgtggggggtccctgagactctcctgtgcagcctctggattcgatttcgataattatggcatgattgggccncaggctcgagggagggctggagtgggtctcgttcaattaataaacatgacagtgacatgtactacgcagacgcacgtgggacggccgattccaacctactcctaccaaggaacgaaccgaaaccggacccgaagggacgtcctacctaacctttcggttttacctttaccaactactaacgaaaccctaaaccgtacccgaacccccggaggaaccttaaaccgacggtaccttaagttaacttaacgtttacgtttagggtacggggtaaaggtaaagggtaaaagggtaagggttaacgggggggggtacggttaccccgggtttacgggttaccggggtacccgggtaaacggggggtaaacccccggggttcccgggtaccccgggttcccgttaaccccgg

SEQ ID NO: 294253 - DNA, 750 bp, Homo sapiens
  misc_feature: GYAE6OF01EQ3E3.19.3.A03.1.454.CMB.1.raw
tcagtactctcgtgcacgaccggtgctcgattttagagagcgtcacaggggctgagagaggagccttagccctggattccaaggcctatccacttggtgaccagtactgagcaccgaggattcaccatggaactggggctccgtctgggttttccttgttgcttattttagaaggcgtctagtgtgaggtgcacctggtggagtctgggggaggcctggtcaaggccgtggggggtccctgagactcgtcctgtgcagcctctggattcgatttcgataattatggcatgaattggtccgccaggctccgaggggaggggctgggaggtgggtctcgttccgattaataaacatagccagtgacagtgtactacgcagaccgcacgtgggacgggccgagttaccgaaccgtattccctaccaagtacgaaccgtaaaccggcccgaagggaacgtacctccgtaaacctttcggttttaccctttacgaacctagttaaccggaaacctaaccccgttacgaacccccccgggaagtaacctaaccggaacgttaccgttaattaacgtttaaacgtttaacggtttaggggttacgggtaaagggttaaacgggtaaaaagggttaaggggttcgggggggggtaaaccggttacccgggttacggtttaccggggggaacccgtacgggggggttaaaacccccgggggttcccgggttaaccccggttcccggtttaacccccggg

SEQ ID NO: 294254 - DNA, 611 bp, Homo sapiens
  misc_feature: GYAE6OF01DMLX6.19.3.A03.1.454.CMB.1.raw
  modified_base (297)..(297): a, c, t, g, unknown or other
  misc_feature (297)..(297): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtcgtgggggaggcctggtcaagccgtggggggtccctgagactctcctgtgcagcctctggattcgatttcgattaattatggcatgaattgggccnccgaggctccgaggggaggggctggagtgggtctcttcattaataaacatgccagtgactatcgtactacgcacggaccgacacgtgggaacggggcccgtattccaccactcctaccaagacgaaccaaccggaccgaaggacgcctctacttcgtttccttcactactacgaacctaacccgtaccgaacccccgaggtaactacacgtacttaattattatttacgttggtagggagaaggaaaggaggtggggggtacgtccgtggttcgggccggaacggggtacccgggtccggcccggttcgtcccg

SEQ ID NO: 294255 - DNA, 758 bp, Homo sapiens
  misc_feature: GYAE6OF01C81M5.19.3.A03.1.454.CMB.1.raw
  modified_base (379)..(379): a, c, t, g, unknown or other
  misc_feature (379)..(379): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgcttattttagaaggcgtcagtgtgaggtgcacctggtggagtcgtgggggagccgtggtcaagccgtggggggtccctgagactctcctgtgcagcctctggattcgtatttcgaattaattagtggcagtgaattcggggtccgccgaaggccgtaccgaggggaaaggggtccgtgggaggttggggtccttacgttacctaatttaaaataaaaccngttcgacctagtacgaactaagttacgtaaccgttaccgacgaaggaccgaccgtaacgtacggggacgggtaccccgtaaagtttaccccgaacctactttacccgtacccaaggaaccgaaaccgtaaaccggacccgaagggaacgtaccttaccctaacgtttcggtttacctttacacctaagttacgaaaccgtaaaccctccggaaaccccccgtaagggaacctaccgaacgtacttaagttaacttaatttaagttaggtacgggtaagaaaggtaaagggtagggtagggggtacggttaccgttcggttaaccggggacccggtaaccgggggtaaccccgggttaccgtcccgggtcccttacccgg

SEQ ID NO: 294256 - DNA, 818 bp, Homo sapiens
  misc_feature: GYAE6OF01BLDIM.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactgggctccgctggtttccttgttgctattttagaggcgtcagtgtgagtgcacctggtggagtcgtggggagcctggtcaagcctgggggtccctgagactctcctgtgcagcctctggattcgatttcgattaattagtggactatggtaatttggggtcccgccgagggccgtaccggaagggggaaacggggccgtgggtagggttcggggttccttacgtttaccctaaagtttaaaataaacctatcggaccctaaggtcggaactattacggtaccgttaacggctaacggaccgcaacggtcgggaacggggccctaaacgtttccaacccgtacgttccgttacccgaaggtaacgaaaccgaaacccggaccgaagggaacgtaccgttacctaaccgtttcgttttaacccttccaaccgtaacgttaacggtaaaccctaaccccggttaacccggaacccccccggtaaagggtaaaccttaccgaacggttacccttaaagttaacgttaaagttttacggttagggtacggggtaaaggtaaacggtaaaagggtaggggttacggggggggtaaccggtttacccggtttaccgggttaccgggggtaccccgggttaaccgggggtaaacccccggggtttcccggtccccggttcccggttaaccccgg

SEQ ID NO: 294257 - DNA, 810 bp, Homo sapiens
  misc_feature: GYAE6OF01BWLA8.19.3.A03.1.454.CMB.1.raw
  modified_base (325)..(325): a, c, t, g, unknown or other
  misc_feature (325)..(325): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaacgtggggctccgcttgggttttccttgttgcttattttagaaggcgtccagtgtgaggtgcaccgtggtggagtcgtgggggagccgtggtcaaggccggtcggggggtccctggagacttctcctgtgcgagcctgtggtattcgtatttcgaattaaatttagtggactagtaggtaagttcggggtccccncgacggtcctaccggaagggggaacggggtctgggacggttgggttaccttccgtttaccctaaagtttaaaactaaaacgtagttcgacctaggtacgaacgtaagttacggttaacctaccggacgaacgtacgacgtacggtagggacggggtaccctagtttacccaacctacgttacccgtaccaacggaaccgaacccgaaacccgaccggaagggaccgtaccgtaccttaaccgttttcgtttaccttacgaactacgtaacgaaaccctaacccgtaccccggaaccccgtaacggtaactaacccgtacgtacttaagttaactttaagtttaggttacgggttaagggaaagtaaagggtaaaagggtaggggttacgggggggtacgttacccgggttacgggttaccggggtaacccgggtaaccgggggtaacccccggggttacccggtcccggttccccgttaccccgg

SEQ ID NO: 294258 - DNA, 764 bp, Homo sapiens
  misc_feature: GYAE6OF01C65U1.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgcttggttttccttgttgctattttagaggcgtcagtgtgaggtgcacctggtggagtcgtgggggagccgtggtcaggccgtgggggtccctgagactctcctgtgcacgcctgtggtattccgtatttacgtattaatttagtcggtacaagttggtaaagtttcggggtaccccgccgagggtcccttaccggaaggggggaacggggtcgtaggggtaggttcggggttcttccgttactaagtttaaactaaaccagtcgaccgtaaggtcgaactagttaacggtacctacggacgtaacggaccgtaccgacgggttaggggaccggggtaccgttacgttaccaccctacgttaccctacccgaacggtaacggaaaccgaacccggtacccgaacggtaacgcccttacgttaccttttcggttttccttaccaaccttacgtaaccgtaaaccctaaccccgtaccgtaaccccccggaaaggtaactacccgaagttccgttaagttactttaattagtttagggacgggtaagaaggaagggtagggtagggggtaccgttcggttacggtcgggacccggtacggggtacccggtcccgcgtccgtcccg

SEQ ID NO: 294259 - DNA, 630 bp, Homo sapiens
  misc_feature: GYAE6OF01A2IMK.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgtaagttgggtccgccgaggctccgagggagggctggagtggtctcgttcattaataaacatcgccagtagacatgtactacgcagacgcacgtgggaggccgacttccacctatcctaccgagacgtaacaacgaccgaaggacgcctacctaacgtttcgtttaccttacactaagtacgaaaccctaaccgtccgaacccccgtaaggacctaaccgacgtacttatacttacttagttggtacgggagaagggtaaaggtagggtaggggggtacggttcccgtacggtttaccgggaccggaaccgggggtaaccccgggtcggtccccgttccgtaccccg

SEQ ID NO: 294260 - DNA, 536 bp, Homo sapiens
  misc_feature: GYAE6OF01A7MMR.19.3.A03.1.454.CMB.1.raw
  modified_base (296)..(296): a, c, t, g, unknown or other
  misc_feature (296)..(296): n is a, c, g, or t
  modified_base (417)..(417): a, c, t, g, unknown or other
  misc_feature (417)..(417): n is a, c, g, or t
  modified_base (464)..(464): a, c, t, g, unknown or other
  misc_feature (464)..(464): n is a, c, g, or t
  modified_base (486)..(486): a, c, t, g, unknown or other
  misc_feature (486)..(486): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtcgtgggggaggcctggtcaagcctggggggtccctgagactctcctgtgcagcctctggattcgatttcgataattatggcatgaattgggtccnccaggctccgagggaagggctggagtgggtctcttccattaataaacatgccagtgacatgtactacgcagacgcacgtggaggccgattccacctactctccagagacaacgccagagcncactgtttctacactatgaaccactcgaccccgaggactacagctanattattagtgtaggagagaagngtagggggagtccgtcgtgggtccgacggggtaacccggcgcgtcctccg

SEQ ID NO: 294261 - DNA, 895 bp, Homo sapiens
  misc_feature: GYAE6OF01BMIP8.19.3.A03.1.454.CMB.1.raw
  modified_base (187)..(187): a, c, t, g, unknown or other
  misc_feature (187)..(187): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgcttgggttttccttgttgcttatttagaggcgtcagtgtgaggtncacctggtggagtcgtgggggaggcctggtcaacggccggtcggggggtccctggagacctctccgtgtgcacgcctctggtactttcgtattttacgaattaattagtggtactagttagaacgtttcggggtcccgccgaggtcctaccggaagggggaaggggtccgttagggggaggttccggggttcctttaccgtttaccctaaattttaaaacctaaacgtacgttaccggaccctaaggttacggaactaacggtttacggttaaccttaaccggaccgtaaacgggaacccggtaccgtaaccgggttacgggggaacgggggaaccccgttaacttttaccccgaaccctaacgttcccgttaaaccccggaaggaacggtaaacccgaaacccggacccggaaggggtaacccgtaccgttacccgttaacgtttttaccgttttacccgtttacctaaacctacgtaaaccggtaaaccccgtaacccgtaacccgggtaacccccccggtaagggtaacctaaccggtaaccgttactttaacttaaagttaactttaggttacggggtaacggggaaaggtaaacgggtaaaagggtacgggggttaggggggtaacggtttcccgtacggggttaccgggacccggggtaaccggggtaacccccgggttccggtcccggttcgttaccccgg

SEQ ID NO: 294262 - DNA, 711 bp, Homo sapiens
  misc_feature: GYAE6OF01EO1RA.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcacatggaactggggctccgctgggttttccttgttgcttattttagaaggcgtcagtgtgaggtgcaccgtggtggagtcgtgggggaggccgtggtcaagccgtgggggtccctgagctctcctgtgcacgcctcgtggtattcgtatttcgaattaattagtggactagtagtaagttcggggtcccgccgaggcctccggaagggggtaagggggcgtggggaggttcgggttccttaccgtttacctaatttaaacgtaaactatacggacctaaggtacgactagttacgtacctacgcaacggaccgcacggtggggacggctacttccacctatcctacgagacgaaccacgacccgaaggctaccgtctacgtttcgtttacctacaacgtacgtaaccgaaacctaaccccgtacccggaaccccggtaaggaacctacgaacgttacttaattaacttaagtttagttacgggtagggaaacgtaaggaaacgggtaggggttacgggggtaacgttccgttacgggtaccggggaccgggaacccggggtacccgggtccggtcccgttcgtacccgg

SEQ ID NO: 294263 - DNA, 891 bp, Homo sapiens
  misc_feature: GYAE6OF01D8ZUO.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgcttattttagaaggcgtccagtgtgaggtgcacctggtggagtcgtgggggaggcctggtcaagccgtggggggtccctgagactctcctgtgcagcctcgtggtacttcgtatttacgaattaattagtggactagtagtaagtttcggggtcccgaccgagggtcctaccggaagggggaacgggggtccgtaggggaggttcggggttccttacgtttacctaaatttaaaacgtaaaacgtagttacggacctaaggttacgaacgttaatacgggttaaaccttaaccggaccgtaaacggacccggtacgtaacgggttacgggggaaaccggggtacccgtaaacgtttacccaaacccgtaacgttaccctaaccccggtaaaggaaccggaaaccgaaaacccggacccggaacgggtaacgtacccgttacctaccgttttacgttttaccgttaccgtaaccgtaacttaacggaaaacccgtaaaccccggtacccggtaaacccccccgggtaagggtaaaccgttaaaccgtaaccggtaacctttaacgttaactttaacgtttaaggttagggttaacggggaaaggtaaagggtaaaacgggttaggggttaacggggggggtacgttaccgggttaccgggttacgggggtaccccgggtaaaccggggggtaacccccgggttcccgggttaccccggtcccgttaaccccgg

SEQ ID NO: 294264 - DNA, 884 bp, Homo sapiens
  misc_feature: GYAE6OF01D0HT0.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgcttgggttttccttgttgcttattttagaaggcgtcagtgtgaggtgcaccgtggtggagtcgtgggggagcctggtcaaggccgtggggggtccctgagactctcctgtgcagcctcgtggtatttcgattttcgaattaattagtggactagttagtaaagtttcggggtccccgaccgaacggggtccttacccgggaaaggggggtaaacggggggtccgttaggggggtaacggtttcgggggtttcctttcccgttttaaccctaaaagttttaaaaactaaaaacctagttcgtacccgtaaggttcgaaacctagttacggttaaccttaccggacaaacggaccgacgtacggtacgggggaacgggtacccgtaatttacccgaaccctacgttccctacccgaaaggaaccgaaacccgaaacccggcccgaaaggggtaacgtccccttacgtaaccgttttacggttttacccttacgaaccttaagttaaccgaaaaccgtaaccccgtaacccggaaccccccggtaaaggaaccttaaccgaagtaactttaaacgttaattttaaagttttaacgtttagggtaacggggtaaaggaaacgggtaaaagggttaaggggttacggggggggtaaccgttacccggtttacgggttacccggggaacccgggtaaacccggggggtaccccggggttacccggtccccggttcccgttaaccccgg

SEQ ID NO: 294265 - DNA, 829 bp, Homo sapiens
  misc_feature: GYAE6OF01BMI2S.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttcctgttgctattttagaaggcgtccagtgtgaggtgcactggtggagtcgtgggggagcctggtcaagccgtgggggtccctggagactctccgtgtgcacgcctcgtggactttcgtagttttacgaattaaattagtggactatggtaaagtttcggggtcccgtccgaagggcctaccgggaagggggaacgggggtccgttggggacggttcggggttccttccgtttacctaaatttaaaacgtaaaactagttacgaccctaaggtacgtaactagttacggtaacgtaacgacgaacgaccgacgtacggtacggggacggggtacccgtacgttaccgaaccctacttccctacccgaaggaaccggaaacctaaacccggacccgtaacgggacgtacccttaccgtacgtttccggttttaccttaaccgaacgttaacgttaacccggaaaaaccccttaaccccggtaccccggtaaccccggaaacgggtaactaaaccgtacgttaacttaagttaattaacgtttagttacgggttagggaaaggtaaacggtaaagggtaaggggtacggggggtaacggttaccccgttaggggttacccggggacccggggttaaaccggggtacccccggggtccggttccccggttccggtacccccg

SEQ ID NO: 294266 - DNA, 733 bp, Homo sapiens
  misc_feature: GYAE6OF01BBSPS.19.3.A03.1.454.CMB.1.raw
  modified_base (271)..(271): a, c, t, g, unknown or other
  misc_feature (271)..(271): n is a, c, g, or t
  modified_base (442)..(442): a, c, t, g, unknown or other
  misc_feature (442)..(442): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgcttgggttttccttgttgcttattttagaaggcgtccagtgtgaggtgcaccgtgggtggagtcgtgggggacggccgtggtacaacggccgtcggggggtccctggagactctcctgtgcacgtcctntggtattcgatttcgattaattatggctagtgtaagttcgggcccgcgaggcctcggaggggagggctgggaggtcgggtcttcgttacctaatttaaaactaaacagttacgaccgtaaggtacggtaactaagttcgtaacctacgaccgtaaggaaccgactaacggngggacgggacctacttaccaccgtactccgactaaggacgaaccgaacgccgaaggtactaccgtcctaacgtttcgtttacctacgaactacgtaacgaaaccctaccgtaaccgacccccgaaggactaccgtagtaccttaatacttaattacggttggtaacgggaaaggtaaggtaaacgggttaggggacggggggttaaccggttccgttacggggttaccggggaacccggaacccgggggttaaaccccgggtccgggttaccccgtaccggttacccccgg

SEQ ID NO: 294267 - DNA, 781 bp, Homo sapiens
  misc_feature: GYAE6OF01EHYL0.19.3.A03.1.454.CMB.1.raw
tcagtactctcgtgcacgaccggtgctcgatttagagagcgtcacaggggctgagagaggagccttagccctggattccaaggcctatccacttggtgaccagtactgagccaccgaggattcaccatggaactggggctccgcttgggttttccttgttgcttattttagaaggcgtccagtgtgaggtgcacctggtggagtcgtgggggagccgtggtcaagccgtgggggtccctgagactctctgtgcacgcctctggtacttcgtattttcgaagttaacttagtggcaattagtaaagtttcggggtccccgccgtaagggtcctccggaaaggggggaacgggggtcctagggggtaacgggttcggggttccttcccgttttacctaaatttaaaaactaaaacgtagtcgtaccccgaaggttacgaacctagttacgttaaccgtacggacgacggaaccgcaacggttagggacggggacccgtatttacccgaacctacttaccctaccaaggtacgaaaccgaacgaccgaaggagcctactaccgtttgtttaccttacgaactacgttacgaaacctaacccgttacccggaacccccggaacggtaacgttaacctaacggtacttaacttaacgtttaaagttacgttaggtaacggggaagtaaacgggtaaaagggtagggtaacgggggggtacgttacccgttcggttaccgggaccggaaccgggggtaccccgggtcgtccccggttcgtaccccgg

SEQ ID NO: 294268 - DNA, 693 bp, Homo sapiens
  misc_feature: GYAE6OF01BCVJI.19.3.A03.1.454.CMB.1.raw
  modified_base (288)..(288): a, c, t, g, unknown or other
  misc_feature (288)..(288): n is a, c, g, or t
  modified_base (450)..(450): a, c, t, g, unknown or other
  misc_feature (450)..(450): n is a, c, g, or t
  modified_base (516)..(516): a, c, t, g, unknown or other
  misc_feature (516)..(516): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgcttgggttttccttgttgcttattttagaaggcgtcagtgtgaggtgcacgtggtggagtcgtgggggaggccgtggtcaagccgtcggggggtcctgagactctccgtgtgcagcctcgtggtattcgtatttacgattaattangtactagtgtaagttcgggtcccgcgacggctccggaggggtaacggggtcgtgggtaggttcgggtcctccgtttaccgtaattaaacgtaaacgtagttcgacctaggttacgaactacgttacggttaacctaccggacctaacggaaccgcgtaacgngggaacgggtcccgtattacccgacctactcctaaccgagaaccgaccaaaccgccgacgggaacncctactaccgtttgtttccttacacgtactaacgtaaccctaccgtacccggaaccccgtaaggactaacgtccgacttaactgttaacttggttacggtaggagaaggtacggtgggtacggggtacgtcgttcggtacggaccggacggggtaaccggcccgtccggtcctcccg

SEQ ID NO: 294269 - DNA, 924 bp, Homo sapiens
  misc_feature: GYAE6OF01D37XK.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcgaccgtagggatacgaccgataggtaacgtggggctccgtcttgggtttttccttgttcgtcttagttttagaaggctctaggtgtagaggtgctaccgtgggtggagtcggtagggggacggtccgttgggtacaacggccgggttcggggggtcccctaggacgtccgtcctccgtggtcgacgacggtccttgaggttctccggtattttcgaatttaattagtcggtctaagttaccggtaaggtttccgggccctaccggtacgggtccgtttaccggggaagggggtaaccgggggtcgttggggtaacggggtttccggggtacctttacggtttacctaaaaggtttaaaactaaacgtaacgtccgtaccgaggggtttacaaaaccgttcggtaagtttaacccggaacgacggaaacggttccggtacgtaacgggcggggtaaaccggccgttaacgtacgtacccctaacgtttccgaacccgttaaccgaacggtaaaccggaacccgttaccggaaccgggtaacgttccccaacgtttaccgggttttacccgtttacttaccggtaaaccttacggtaacccgttaaacccgtaaaccccgacccgggtaaccccgggtaactaaccgttaacccggtaaacgttaccgttaatttaaccgttaggttacgtttagggaaacggtagggttaaagaccgggtagggtaacggggggttacccacggggttccgggttaccgggaacccggggtttaccgggggtaacccggtccggtttcccgcccggttacccgg

SEQ ID NO: 294270 - DNA, 851 bp, Homo sapiens
  misc_feature: GYAE6OF01B865R.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggcctccgcgttgggttttccttgttgcttattttagaaggcgtccagtgtgaggtgcaccgtggtggtagtcggtggggacggccgtggtacgaacggcccggttcggggggttccctggacgaccttcctcccgtggtcgcacgtcccttcgtggtatttcgtagttttcgtaatttaatttagtcggactaagtaggttaaggttccggggtcccgaccgacgggtccgtaccgggaaggggtacggggtccgtaggggtacggttcggggttccttaccgtttaccgtaaatttaaacgtaaacgtattcggacctaggttacgaactagttacgtaacgtaaccgacgaacgaccgacgtacggtaggggacggtcccgtacttaccgacctacgttcctaaccgaaggtaaccgaaaccgaaccccggtaccgaacgggaccgttaccccgtacgttaaccgttttccggttttacccttaaccgtaacgtaacggttaacccgtaaaccccgtaaccccggttaccccggaaaccccccggtagggtaaaccctaccgaaccgttaacttaactttagttaacgtttaggtaggttagggaaaaccggtagggtaaacgggtaggggtacggggttaccggttcgttacggggtaccgggtacccgggtaaccggggtaccccgggtccgtcccggttcccgtacccgg

SEQ ID NO: 294271 - DNA, 896 bp, Homo sapiens
  misc_feature: GYAE6OF01BHPAL.19.3.A03.1.454.CMB.1.raw
tcagtactctcgtgcacgaccggtgctcgattttagagagcgtcacaggggctgagagaggagccttagccctggattccaaggcctatccacttggtgaccagtactgagccaccgaggattcaccatggaacgtgggggtcctccgtcgtttcgggtttttcctttggtttcgtactttaagtttttaaggaacgggtccgttccaggttggtggagggttcgccaccgttggggtggacggttcggtggggggacggtcccgtgggtccgaacggtccggtcgggggggttccctaggacgtccttccgtccgtggtcgccgtacgtccgttacgtggtactttcgtaacttttacgtaagttaatttagtcggactagtagtaaggttccgggccgaccgaggccgtaccgggagggaacggggtcgtagggtaggtcgggttccttaccgttacgtaaattaaaacgtaacgtacgtcgacctaggtacgtacgtacgtagttaacccgtagacgacggacgtccgaaccgggttgggaacccggggtcccgtaacgtcccgtaaccctacgtaccgtaccggaacgaacgaaccgtaacccgaccgggacggtaacctcccgttacgttacgtttacgttttacctaccgtaactaacgttaaccgtaacccaacccgttacccggtaaccccggtaacggtacctaaacgtacgtaacctttaagttaagtttaaccgttaggtttaacgggtaggtaaacgggttaaacggggtaaacggtagggggttccggggggttaccggttaccggttacggggttacccggggtaacccgggaaccggggggttaaccccgggtcccgggtaccggtttccccgtaccccgg

SEQ ID NO: 294272 - DNA, 798 bp, Homo sapiens
  misc_feature: GYAE6OF01EROYK.19.3.A03.1.454.CMB.1.raw
  modified_base (147)..(147): a, c, t, g, unknown or other
  misc_feature (147)..(147): n is a, c, g, or t
  modified_base (186)..(186): a, c, t, g, unknown or other
  misc_feature (186)..(186): n is a, c, g, or t
  modified_base (332)..(332): a, c, t, g, unknown or other
  misc_feature (332)..(332): n is a, c, g, or t
tcagtactctcgtgcacgaccggtgctcgatttagagagcgtcacgaggggcgtgagagaggagccttagccctggattccgaaggcctatccacttggtgaccagtactgagccaccgaggattcgaccatggaactgggctccgntggttttcttgtgctatttagaggcgtcagtgtgaggtncacgtggtggagtcgtggggagccgtggtcaagccgtggggggtccctgagtactcgtccgtgtgcacgtccttcgtggtaacttcgagttttcgaattaaacgtttagtgggtaccaagtaggtaaacgtttcgggggtaccccnccgaacggggtccttaccccgggaaggggggtaaaaccgggggtcggtacggggtaacgggtttcggggtttaccgttttacccgttttaacccgtaaattttaaaaacgtaaaaaccgtaagtttaccgggacccgttaggtaacggaaactacgttacggttaaaccgttaacggacgtaacggaaccgtccgtaaacgtcggggacggtaccgactttaccaaccgtactcctaccgaagacgtaaaccgaaacgccgtaaggactccgtactacgttacgtttctacgtacgtaagtacgtaaacccaacgtcccgaaccccggagtactaacgtacgtaccttagttaatacgttagttacgacgggtaaagaagggtaaacggtagggagggggtaccgtccgttaggtaccggggtaccgaaccgggggtacccggttacggtcccggttcctacccgg

SEQ ID NO: 294273 - DNA, 536 bp, Homo sapiens
  misc_feature: GYAE6OF02HLABY.19.3.A03.1.454.CMB.1.raw
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccgagggaaggggctggagtgggtctcttccattaataaacatgccagtgacatgtactacgcagacgcacgtggagggccgattcaccatctccagagacaacgccaggagctcactgtttctcanatnaacaacctcgaccccgaggaactacagactataatattattgtggagaggaaagagtagggggaggtccgtgttcgggccgagggacccgggtcgccgtctccg

SEQ ID NO: 294274 - DNA, 529 bp, Homo sapiens
  misc_feature: GYAE6OF02F1JOE.19.3.A03.1.454.CMB.1.raw
  modified_base (438)..(438): a, c, t, g, unknown or other
  misc_feature (438)..(438): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgcaggctccgagggagggctggagtgggtctcttccattaataaacatgccagtgacatgtactacgcagacgcacgtgggacgggccgatttccaccatctaccagagacaacgccgaggagctcacttgtttcttcacatanaaccaacctcgaccccgagactacagctatatattatgtggagagaagagtgggggagtcgtgtcggcgacgggaccggtcgccgtctccg

SEQ ID NO: 294275 - DNA, 557 bp, Homo sapiens
  misc_feature: GYAE6OF02G6C0J.19.3.A03.1.454.CMB.1.raw
  modified_base (257)..(257): a, c, t, g, unknown or other
  misc_feature (257)..(257): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagccgtggggggtccctgagactctcctgtgcagcctntggattcgatttcgattaattatggcatgaattggggtccgccaggctccgaggggaagggctgggaggtgggtctcttccattaataaacatgaccagtgacatgtactacgcagacgcacgtgggacggccgtattcgaccatcctcagagacaacgcaggacgctcacttgtttctacactatcgaaccaccgtacgaccccgaggactacacgtactaatattaatattggtaggagaagaaggagtagggggtacgtccgttgtcggcgacgggtacccgggtcgtccgtctccg

SEQ ID NO: 294276 - DNA, 654 bp, Homo sapiens
  misc_feature: GYAE6OF02JGC81.19.3.A03.1.454.CMB.1.raw
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (357)..(357): a, c, t, g, unknown or other
  misc_feature (357)..(357): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctgggtcaagccgtggggggtccctgagactctcctgtgcagcctctggattcgatttcgataattatggcatgaattcggggtccgccaggctccgaggggaacggggctggagtgggtctcttccattaanaacntgccagtnacattgtactacgcagacgacacgtgggacgggcccgtatttccacctactcctaccacgacgacaacgaccgaggacgctcacttgtttaccttcctactactacgaacctaaccgtaccgtaacccccggaagtacttaaccgacgtacctaagttaacttaatttaagtttcggtagggaacggtaaggtaaacggtaaggttaaggggggtacgggttaccggtttacggttaccggggaccggtaccggggtaaaccccggggttccgggtacccggttacccgttacccgg

SEQ ID NO: 294277 - DNA, 562 bp, Homo sapiens
  misc_feature: GYAE6OF02IO2AW.19.3.A03.1.454.CMB.1.raw
  modified_base (433)..(433): a, c, t, g, unknown or other
  misc_feature (433)..(433): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcgaagccgtggggggtccctgagactctcctgtgcagcctctggattcgatttcgataattatggcatgaattgggtccgccaggcctccgaggggaaggggctgggaggtgggtctcttcctaattaataaacatgccagtgacatgtactacgacagacgcacgtgggagggccgagtttccaccactctccagacgaacaacgaccgaggacncctcacttgtttccttacacatacgaacaacctcgaccccgagactacagactatatattagttgtggagaaggaagaggtagggggacgtcgtacgtgggccgacgggacccgggtcgccgtcgtccg

SEQ ID NO: 294278 - DNA, 546 bp, Homo sapiens
  misc_feature: GYAE6OF02GVHR5.19.3.A03.1.454.CMB.1.raw
  modified_base (340)..(340): a, c, t, g, unknown or other
  misc_feature (340)..(340): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgattaatatggcatgaattggggtccgcaggctccgagggaagggctggagtgggtctctcattaataacntgccagtcgacatgtactacgcagacgcacgtgggacgggccgatttccaccatcctccgagacgacaacgccgaggacgcctcacttgtttcttcactatacgaaccaacctcgaccccgaggactacgagactaatatattatgtaggagagaagaggtagggggagtccgtgtcggacgacgggtacccggtcgccgtctccg

SEQ ID NO: 294279 - DNA, 526 bp, Homo sapiens
  misc_feature: GYAE6OF02G68W7.19.3.A03.1.454.CMB.1.raw
tcagtactctcgtgcacgaccggtgctcgatttagagagcgtcacaggggcgtgagagaggagccttagccctggattccaaggcctatccacttggtgaccagtactgagcaccgaggattcaccatggaactggggctccgctgggttttccttgttgctatttttagaaggcgtccagtgtgaggtgcacctggtggagtctgggggaggcctggtcaagcctggggggtccctgagactctcctgtgcagcctctggattcgatttcgataattatggcatgaattgggtccgccaggctccgagggaaggggctggagtgggtctcttccattaataaacatgccagtgacatgtactacgcagacgcactggagggccattcaccatctcagagacaacgccaggagctcacttgtttcttcactatacgaacaacctcgaccccgagactacagctatactattatgtggagagaagagtggggagtcgtgtcggcgacgggaccggtcgccgtctccg

SEQ ID NO: 294280 - DNA, 537 bp, Homo sapiens
  misc_feature: GYAE6OF02GQ5OW.19.3.A03.1.454.CMB.1.raw
  modified_base (297)..(297): a, c, t, g, unknown or other
  misc_feature (297)..(297): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagccgtggggggtccctgagactctcctgtgcagcctctggattcgatttcgataattatggcatgaattggggtccnccaggctccgaggggaaggggctggagtgggtctcttccattaataaacatgccagtgacatgtactacgcagacgcactggacgggccgattcacctatctccagacgacaacgccgaaggacgctcacttgtttcttcacatcgaaccaacctacgaccccgagactacagactatatattatgtggagagaagagtgggggagtcgtgtcggcgacgggacccggtcgccgtctccg

SEQ ID NO: 294281 - DNA, 529 bp, Homo sapiens
  misc_feature: GYAE6OF02FZHAS.19.3.A03.1.454.CMB.1.raw
  modified_base (480)..(480): a, c, t, g, unknown or other
  misc_feature (480)..(480): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccgaggggaaggggctggagtgggtctcttccattaataaacatgccagtgacatgtactacgcaggacgcactggagggccgattcacatctccagagacaacgccaggagctcacttgtttctcacatcgaacaaccgtcgaccccgaggaactacagtctatatattatgtgganaggaagagtgggggagtcgtgtcggcgagggacccggtcgccgtctccg

SEQ ID NO: 294282 - DNA, 556 bp, Homo sapiens
  misc_feature: GYAE6OF02HW6DS.19.3.A03.1.454.CMB.1.raw
  modified_base (402)..(402): a, c, t, g, unknown or other
  misc_feature (402)..(402): n is a, c, g, or t
  modified_base (415)..(415): a, c, t, g, unknown or other
  misc_feature (415)..(415): n is a, c, g, or t
  modified_base (429)..(429): a, c, t, g, unknown or other
  misc_feature (429)..(429): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccaggggaaggggctgggagtgggtctcgttccaattaataaacatgcctagtgactatgtactacgcagacgcactggagggccattcacatctcaganacaacgccagganctcacttgttcttnacatagaacaacctcgaacccccgaggactacagtctaatatagttacttaggtgggaagtaggaaaggtgtaggggggtagtaccgtgttcgggaccgaagggacccgggtcgcccggtctacccg

SEQ ID NO: 294283 - DNA, 562 bp, Homo sapiens
  misc_feature: GYAE6OF02F2V8Q.19.3.A03.1.454.CMB.1.raw
  modified_base (433)..(433): a, c, t, g, unknown or other
  misc_feature (433)..(433): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggagcctggtcaagcctggggggtccctgagactctcctgtgcagcctctggattcgattcgataattatggcatgaattgggtccgccaggctccaggggaaggggctggagtgggtctcttccattaaataaacatgccagtgacatgtactacgcagacgcactgggagggccgacttcaccatctccagacacaacgccaggagactcacttgtttcttccanatagaacaacctcgacccccgaggaactacacgactactattaattattacgtgggaagagtaaaggaggtaggggggacggttccgtcgttagggccgtacgggacccgggtcggacccgtcgtcccg

SEQ ID NO: 294284 - DNA, 720 bp, Homo sapiens
  misc_feature: GYAE6OF02F9T06.19.3.A03.1.454.CMB.1.raw
  modified_base (260)..(260): a, c, t, g, unknown or other
  misc_feature (260)..(260): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
  modified_base (345)..(345): a, c, t, g, unknown or other
  misc_feature (345)..(345): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggtttcctgttgctattttagaaggcgtcagtgtgaggtgtcacctggtggagtctggggaggcctggtcgaagccgtgggggtccctgagactctccgtgtgcagcctcgtggnttcgatttcgattaattatcggcagtgaagtttgggccncgaggcctcggagggagggctggagtggtctctactattaanaacngttcgcctagtcgactatggtacctacgcgacgaccgtcaacgttgggacgggtacccgtattaccgaaccgtacgttacctaccgaagacggtaacccgtaaccggaccgtaacgggtactacccgtccgtaacggtttcgttttacccgtttcgaaaccgttaccgttaacggtaaaccctaaacccgtacccggtaacccccgtaggtaaaccgtaacccggtaagtaccgtttaatacgtttaagtttaacggtgttacgggtaaagtaagggtaaacggtaggggttaacgggggtccgttaccggttcgggttaccgggtacccgggtaacggggtaccccggtcgggtacccgttaccgtacccccgg

SEQ ID NO: 294285 - DNA, 839 bp, Homo sapiens
  misc_feature: GYAE6OF02HENU1.19.3.A03.1.454.CMB.1.raw
  modified_base (310)..(310): a, c, t, g, unknown or other
  misc_feature (310)..(310): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactgggctccgctggttttccttgttgcttatttagaaggcgtccagtgtgaggtgcacctggtggagtcgtgggggacgcctggtacaagccgtcgggggtccctggagactctccgtgtcgcagcctgtggtacttcgtagtttcgattaattagtggctatgtaagttcgggtcccnccgaggcctaccggaggggaacgggcgtgggacggtcgggtaccttcgtttaccaaagtttaaataaaccgtagttccgacctaggtacgtaacctagtttacgtaaccgttaccggacgtaacggacccggaccgtaacggttacggggaaccggggtacccgttaaccgtttacccgaacccgtacgttacccgttacccgaaacgggtaaccgaaacccgtaaacccggacccgaacgggtaccgtacccgttaccgtaaccgtttaccgttttacccgttaccgtaacctaacgtaacccgaaaacccgtaacccgtacccgggtaaccccccggtaaggtaaccgtaaccgtaacgtaccttaaagttaaccgtttaagtttagttaaccgggttaggtaacggtaaacgggtaaacgggtaggggttaacgggggtaaccggttacccgtttaccggggtaccggtaaccgggtaacccgggggtaaccccggttacccgggtacccgttcccgttaccccgg

SEQ ID NO: 294286 - DNA, 782 bp, Homo sapiens
  misc_feature: GYAE6OF02JY8IH.19.3.A03.1.454.CMB.1.raw
  modified_base (326)..(326): a, c, t, g, unknown or other
  misc_feature (326)..(326): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctgggtcaagccgtggggggtccctgagactctcctgtgcagcctcgtggattcgatttcgattaattatggcattgaacgttgggtcccgccaggctccggtagggacggggntaggaggttcgggtcttccttccgaatttaaaacaaaacgtgtacggtaccctaagttacggacctaagttgtaaccgttaaccggcgaacggaaccggccaacgggttacggggaccggggtacccgtagtttaccgtacccgtaacttcccgtaccgtaacggtaaccggaacctaaacccgggaccgtaacgggaagccgtaccgtaaccgtttgttttaccttacaacgttaacgtacgtaaacctaaccccgtaccggaaccccccggtaaaggacgttaaacccgacgttaccgttaaacgttaagttaaccgtttaagttacggtagggtagtaacgggtaaaggaacggggtttacgggggtaacgggtttccgtttacccggttacggggttacccggaaccggggttaccccggggtacccggtcccggttaacccggttccccgg

SEQ ID NO: 294287 - DNA, 852 bp, Homo sapiens
  misc_feature: GYAE6OF02JYVZO.19.3.A03.1.454.CMB.1.raw
  modified_base (234)..(234): a, c, t, g, unknown or other
  misc_feature (234)..(234): n is a, c, g, or t
tcagtactctcgtgcacgaccggtgctcgatttagagagcgtcacaggggcgtgagagaggagccttagccctggattccaaggcctatccacttggtgaccagtactgagcaccgaggattcaccatggaactgggctccgctgggttttccttgttgctattttagaaggcgtccagtgtgaggtgcacctggtggagtcgtggggaggctggtcaagcctggggggtcccngagactcgtcctgtgcagcctgtggattcgtatttcgataattatgggcatgtaagttcgggtccgaccgacggccgtccggacggggaacggggcgtacgggtagggttcggggttccttccgtttacccctaaagttttaaaacgtaaaactcgttacgtacccgtaggttacgaaccgttaatacggttaaccctaacggtacaaccggtaaacgaccgtaaccgttgggggaaaccggggtcccggtaacgttccctaacccgtacttacccgttaccgaacggacgtaaacccgaaaccgacccgtaacgggaacgccgttactaccgtttacgttttcccgttacctacgtacttaacgaaacccgtaaccctacccgggtaaacccccggaacggtaaacctaaccgtaacgtaaccgtttaaacgtttaaacttaacgtttaacgtttacgggtagggggtaagtaaacgggtaaaacggtaacgggggttaacgggggggttaaccgggttaacccgtttccggggttacccggggtaccccggggtaaacccgggggttaacccccgggggtacccggtttacccccggggtaccgtttacccccggg

SEQ ID NO: 294288 - DNA, 613 bp, Homo sapiens
  misc_feature: GYAE6OF02HFDNW.19.3.A03.1.454.CMB.1.raw
  modified_base (375)..(375): a, c, t, g, unknown or other
  misc_feature (375)..(375): n is a, c, g, or t
  modified_base (428)..(428): a, c, t, g, unknown or other
  misc_feature (428)..(428): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtcgtggggggaggcctggtcaagccgtggggggtccctgagactctcctgtgcagcctctggattcgatttcgataattatggcatgaattgggtccgccaggcctccgagggaagggctgggagtgggtctcgttaccagttaactaaacatcgccagtgactatgtactacgnagacgcacgtgggacgggccattccaccatcctacagacacaacgccaaggcnctcacttcgtttccttacactatacgaacctaaccgtccggaacccccgagaactaccgaacgtcttaatacttatttagttaggtagggagtaacggtaaaggagggtaggggggacgttccgttaggttaccggggaccggtaaccggggaaccccggggttccgcccggttaccgtccccgg

SEQ ID NO: 294289 - DNA, 596 bp, Homo sapiens
  misc_feature: GYAE6OF02GH4GC.19.3.A03.1.454.CMB.1.raw
  modified_base (342)..(342): a, c, t, g, unknown or other
  misc_feature (342)..(342): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccgagggagggctggagtgggtctcttccattaataaacntcgccagtcgacatgtactacgcagacgcacgtgggagggccattcactatctcagagacaacgccaggacgctcacttcgtttcttacacatacgaacctaacctccgaaccccgaggactacgacgtactaataattatttagttacggtagggaagaaggaaaggtagggtagggggggtacggttaccgttcggttacggggacccggtaacgggggtaccccggggtccggtacccggttcctacccgg

SEQ ID NO: 294290 - DNA, 752 bp, Homo sapiens
  misc_feature: GYAE6OF02H3JKF.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgagtgcacctggtggagtcgtggggaggcctggtcaagccgtggggggtccctgagactctcctgtcgcacgcctcgtggattcgatttcgaattaattatggctatgtaattgggtccgccgaggcctccgaggggaggggctgggagtggtctcttcaattaataaacatcgaccgagtacgacagtacgtaactacgacgtagaaccgctaacgtcggggacgggacccgtagtttacccaaaccgtacttaccgtacccgaacgtaacgaacccgaaacggcccgaagggacgcccttaccgtactttcggttttacctaccactaacgtacaaacccgtaacccttccggaaccccccgaaagggtactaaaccgacgtaccttaaattaattaacgttttaagttccggtttagggaaccggtaagggtaaaaaggtacgggggtttaaggggggtaccgggtttaacccggtttaccgggttttacgggggaaccccgggttaaacccgggggggttaacccccggggttaccgggtaccccggtttaccgttaacccccggg

SEQ ID NO: 294291 - DNA, 702 bp, Homo sapiens
  misc_feature: GYAE6OF02GFYTC.19.3.A03.1.454.CMB.1.raw
  modified_base (284)..(284): a, c, t, g, unknown or other
  misc_feature (284)..(284): n is a, c, g, or t
  modified_base (532)..(532): a, c, t, g, unknown or other
  misc_feature (532)..(532): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgactatttagaagcgtcagtgtgaggtgcacctggtggagtcgtgggggagcctggtcaggccgtggggggtccctgagactctccgtgtgcgagcctctggatttcgattttcgaattaattagnggtactagtagtaagtttcggggcctaccggaggtccgttaccggaagggggtaacggggtccgtagggtaagggtttcggggtacctttaccgtttaccgtaattttaaaacgtaaaacctagttacgaccgtaggtacgtaacgtattacgttaacgtaccgaccgtaacggtacgaccgtacgtaggggaccgggtacgtaccgttacaacgtactccgtacgagacgacaaccgcgaggactcncgtattcgttctacactacgtaagaacctaaccgaccgaccccgagtacaacgtagacttaactattaagttgttagacgggtaagaaggtaacggtagggtacggggtaccttaccggtagttcgggaaccggtaacggggaccccggtccgtaccgtccgtaccccgg

SEQ ID NO: 294292 - DNA, 854 bp, Homo sapiens
  misc_feature: GYAE6OF02FKLY7.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcacccgaggattcaccagtgaacctgggcctccgcttggttttccttgttgcttatttagaacgcgtccagtgtgagtgcaccgtggtggtagtcgtgggagcctggtacagtccgtcgggggtccctgcgacctctccgtgtacgcacgtccttcgtaggtcttacgtacttaccgtattaacttcgtcggacctagtacggtaacggttccggtaccccggaccacgggtccgtaccgaggttaacggtgtggacgttcggttccttacctaccgtaaacttaaaccgaactacgtcgacccggtacgtacgtaccgttacgtaaccgttacccggtaaccgacggttaaaaccggcccggtaccggtaaccgggtaaccggggtacccggtaccccgttaccgtttacccaacccgtacccgtttacccgaaccgggtacctaaaccgggtaaccccgtaaacccggaccgtaacggttacccgttacccttacgttaccgtttaacctttccgtaaaccgaaccttacgtaaaccccgacccgtaacccgaccgttaaaccggaacgtttaacaaccggtaacttaccttaacgtaacgtttaggttaccgttaacgggacgggttaaaccgagggtaaaccgggttccgggttaaccgggttacccgtccggttaacgggttcccggaaccgggtacccggtttaccccggaccggttacccgttcccgtaaccccggg

SEQ ID NO: 294293 - DNA, 712 bp, Homo sapiens
  misc_feature: GYAE6OF02ICNJH.19.3.A03.1.454.CMB.1.raw
  modified_base (246)..(246): a, c, t, g, unknown or other
  misc_feature (246)..(246): n is a, c, g, or t
  modified_base (344)..(344): a, c, t, g, unknown or other
  misc_feature (344)..(344): n is a, c, g, or t
tcagtactctcgtgcacgaccggtgctcgatttagagagcgtcacaggggctgagagaggagccttagccctggattccaaggcctatccacttggtgaccagtactgagcaccgaggatcaccatggaactggggctccgctgggttttcctgttgcttattttagaggcgtccagtgtgaggtgcacgtggtggagtcgtgggggagctggtcaagccgtgggggtcctgagactctctgcgcncgtcctcgtggtattcggtatttcgtaattaattagtggctagtggtaagtttcggggtccgaccgtaggtcctaccggagggggtaacggggtcggngggtaggttcggggtccttccgtttacgtaattaaactaaaactgtacggtacctaggtacgactagttacggtaacgtacgacgtacgacgctaacgaggggacggcctattccgaacctacgtccctacgaagaacgtaacccaaacggtcaagggacctcgtactctttcgtttctacacgttacacgaaaccctacgtacccggaacccggtataccgtactacgttacttaatacgttaagtttacgttgggaaggtaacgtaaacggtaaagggtacgggggtacgggggtacccgtttccgtacgggtaccggtacgggaaacccgggggttccccggtacggtaccccgtcgtaccccgg

SEQ ID NO: 294294 - DNA, 838 bp, Homo sapiens
  misc_feature: GYAE6OF02H9677.19.3.A03.1.454.CMB.1.raw
tcagtactctcgtgcacgaccggtgctcgattttagagagcgtcacaggggctgagagaggagccttagccctggattccaaggcctatccacttggtgaccagtactgagcaccgaggattcaccatggaacgtggggctccgcgttgggtttttccttgttgtcttagttttagaggcgtccagtgtgaggtgcacgtggtggagtcgtgggggacgtccgtggtacgaaggtccggttcggggggtccctggacgtactcctaccgtggtcgactacgccttcggtaggttattccgtagttttacgaatttaaacgttagtggactagttacgtaaggttcgggtccggaccggtaggtcccgtaacgggaagggggtaacggggtggtacgggtacgggttcgggttaccttccgtttaaccgtaaattaaaacgtaaacgtacgtacggtaccgtaaggtacacgttagtacgttaactacgacacggacgtcaacggtacgggaccgggtaccgtacttacccaactactccgtacccgaagtaaccgaacccgaccgacgtaccgggaactccgttaacctaccgtttacgttttaccttacaagttaccgtaacgtaaaccctacccggtacccggaaaccccgttaagtaacccgtagtaacgtacgttaaactttaagttaacgttttacgggttggtaacgggtaaaggtaaaggaacgggttaagggggtcggggggttaaacccgttttccgtacgggttaccggggaacccgggttacccgggggtaacccggtcccgggttacccggttaccgttaccccgg

SEQ ID NO: 294295 - DNA, 680 bp, Homo sapiens
  misc_feature: GYAE6OF02JELFD.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcacctggtggagtcgtggggaggcctggtcaagccgtgggggtccctggagactcgtcctgtcgcacgcctcgtggattcggtatttacgaattaattagtggctataggtaagtttcgggtccgccgacggtcctccggagggagggtcgtggaggtggtctcttccgaattaactaacgtagtcgaccagtgactagtacgtacctaacgcaacgacggacacgtgggacggctaacgttcaacctagtcctaccgagaacgtaacccaacggccgaagggaactcctacctctttcgttttcctactaacccattacccgaaacctaccccgttaccgggaacccccgtaggtaactacctagaactttaactaattacgtttaagttacggttagggaactaaggtaaggtaggggtacggggtacgttaccggttacgtcgggtaaccggaccggggtaccccggtcggtaccccgttcgtacccgg

SEQ ID NO: 294296 - DNA, 651 bp, Homo sapiens
  misc_feature: GYAE6OF02GLGQH.19.3.A03.1.454.CMB.1.raw
  modified_base (458)..(458): a, c, t, g, unknown or other
  misc_feature (458)..(458): n is a, c, g, or t
  modified_base (464)..(464): a, c, t, g, unknown or other
  misc_feature (464)..(464): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggactggggctccgctgggttttcctgttgctattttagaaggcgtccagtgtgaggtgcacctggtggagtcgtgggggaggcctggtcaagccgtgggggtcctgagactctcctgtgcagcctctggattcgatttcgattaagttatggcatagtagttcgggtccgcaggtctccggaggggaagggtcgtggaggtgggtccttcttaccgtaattaaactaaacctagtacgccaggttacgactatcgtactacgctacgcgcaacgtggacgggcctatcctaccgacttcctaccgaggtacaacgaacgccgaagggacncctacncgtttcgtttacttcgactactacgaaccaccgtccgaaccccggtagtaataccgacgtacttaagtacttagtttaagttggtacgggaagaagggtaaaggagggttggggggtaaccgttcccggttgggttaccggggaccggtaccgggggaacccgggtccgtacccgggtcctacccgg

SEQ ID NO: 294297 - DNA, 812 bp, Homo sapiens
  misc_feature: GYAE6OF02GZAT1.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccataggaacgtgggctccgctgggttttccttgtgctattttagaaggcgtacagtgtgaggtgcacctggtggagtcgtggggagcctggtacaacgcgtcgggggtccctgagtacctacgttcctgtcgcgtacgtcctcgttggtatttacgtagtttacgtaattaaaattagtaggtactaagtaggtaagtttcgggacccgtaccgtaaggtaccgtccggaaggggtaacgggtcgtagggtagggtcggttaccttcgttaccgtaatttaaacgtaaactaaggttccgaccgtagtacgtactacgttacgtacgttaccgacgacggtaacgacgtaaccggtagggaccgggtacctaacgtttacccaaccgttaactacccgttaaccgaacggtaacgaaccgaaacgtaccgaagggtacaacccttacgtaccgtttagttttacctactaagactaacgtaaaccgaaccctaccggtaaccccggtaggtacaaccgtaacgtacctttaaagttagttaaaccgtttaggttacggttacgggaacggtaaggtaaacgggttaacgggttaggggggaaccggtttcccgttaagggtttaccggggaacccggtaaaccggggttaaccccgggtacccggttacccggttccgttaaccccgg

SEQ ID NO: 294298 - DNA, 834 bp, Homo sapiens
  misc_feature: GYAE6OF02HPEKV.19.3.A03.1.454.CMB.1.raw
  modified_base (233)..(233): a, c, t, g, unknown or other
  misc_feature (233)..(233): n is a, c, g, or t
tcagtactctcgtgcacgaccggtgctcgatttagagagcgtcacaggggctgagagaggagccttagccctggattccaaggcctatccacttggtgaccagtactgagcaccgaggattcaccatggaactggggctccgctggttttcctgttgctattttagaaggcgtccagtgtgaggtgcacctggtggagtcgtggggaggcctggtcaagccgtgggggtcccngagactctcctgtgacagcctcgtaggtcttcgatttcggaattaaattagtggacagttgtaaagttcgggtacccgtcctaacgggtccgttacccggaaggggaacgggggtccgtagggtaacggttcggggttcctacgtttacccgtaaatttaaagtaaaacgtgttacggacccgtaggtacgtacgtaagttagtaacctacggcgtaaacggaccgacgtaacggttaggggacggggtaccccgtaacgtttaccgaacccgtaacgtcccgttaacccgaaaggtaacggtaaacccgaacccggtaaccgaacgggtacctaccttaacgtaccgtttacggtttttacctaccggtaactacgttaaacgtaaacccttaaaccgtacccggaacccccggtaaggtaaccgttaacgacggtaaccgttaacttaaacgtttagttaacgttacggttagggaacggtaaagggtaaaggtacggggttacgggggtaacggttcccggttcgggttaaccggggacccggttaaacccgggggtaacccccggttccgggttaccccggttcccgttacccccgg

SEQ ID NO: 294299 - DNA, 876 bp, Homo sapiens
  misc_feature: GYAE6OF02G2C8W.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactggggctccgctgggttttccttgttgctattttagaaggcgtccagtgtgaggtgcaccgtggtgacgtggtaggggggacgtccgtggtacgaacggtccgggttcgggggtccctaggaacgtacctccttccgtggtacgacgtacgtcccgtgtacggttacttacgttaacgttttacggtaaatttaaagttaggtccggacttaagtaggttaaacggtttccggggccctaccgggtacggtaccccgttaacggggaacgggggtaacgggtcggttagggtacgggttcgggttaccctttaccgttaccgtaaaatttaaaaacgtaaaccgtagttcgaaccgttaggtactaacgtaacgtttacgtaaccgttaaccggacgaaacggacggtactaacgggtacggggacggggtacccttaactaaccgtaactaccgttacccgactaaacgggaccgaaaccgaacccgggaacgtacgggaccgttacccgtaacgtttacgttccgttttaccgtaccaacttaacggtaactaaaaccccgtaccgttaacccccggaacccggtaagtaaacccgtaacggtacgtaacgttaacttaaaggttaactttagggttacgggaggaaacgttaagggaaagttacggggggtacgggtaacggtcccgttaggaccgggtaccggaaccggggtacccggacccgttacgtcccgttacccg

SEQ ID NO: 294300 - DNA, 942 bp, Homo sapiens
  misc_feature: GYAE6OF02G3IZZ.19.3.A03.1.454.CMB.1.raw
tcagtactctcgtgcacgaccggtgctcgatttagagagcgtcacaggggctgagagaggagccttagccctggattccaaggcctatccacttggtgaccagtactgagcaccgaggattcaccatggaactgggctccgctgggttttccttgttgctattttagaggcgtccagtgtgaggtgcacctggtggagtcgtgggggaggccgtggtcaagccgtgggggtccctggagactctcctgtcgcagccctcgtggtattcggtatttcggaattaatttagtggctaagttagtaagtttcggggtcccgccgacggtccgttacccggaagggggtaacgggggtccgttggggagggttcggggttccttccgttttaccgtaaagtttaaaacgtaaaaccgtagttaccggacccgtaaggttacgtaaccgtaagttacggttaaccgtaaccggtacgaaacgggtaaccgtacccgtaaccggttacgggggaaccgggggtaccccggtaacgttttacccgaaacccgttaaccttaccccgttacccggaaacggtaaacggaaacccgtaaacccggacccgggaaacgggaccggtacccgttcctaaccgttttacggtttttacccgttaacctaaccgttagttaaccggtaaaccctaaccccgtaaccccgggtaaccccccgaaggggtaaacctaaccggtaacgtaccttttaaagttaaacgttttaaacgtttaacggttttacgggttacggggaaaggttaaagggtaaaacggggttaacggggttaaggggggggttaacccggtttacccgggtttaccgggtttaccgggggaaccccgggttaaacccgggggggtaaccccccggggtttaaccgggttccccggtttaccccgttaccccggg

SEQ ID NO: 294301 - DNA, 430 bp, Homo sapiens
  misc_feature: GYAE6OF01CEEGZ.37.77.G11.1.454.CMB.1.raw
tcagtagtgtagatcacgaccggtgctcgatttagctagtcactcaagggaaagggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcgtcttcccctggcgccctgctccaggagcacctccgagagcacagcggccctgggctgcctggtcaaggctacttccatctacactactgagcgggctggcaaggcgcatag

SEQ ID NO: 294302 - DNA, 439 bp, Homo sapiens
  misc_feature: GYAE6OF01B3CJW.37.77.G11.1.454.CMB.1.raw
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggctacgttccatctacactactgagcgggctggcaaggcgcatagnnnnnn

SEQ ID NO: 294303 - DNA, 444 bp, Homo sapiens
  misc_feature: GYAE6OF01D5RA8.37.77.G11.1.454.CMB.1.raw
  modified_base (432)..(444): a, c, t, g, unknown or other
  misc_feature (432)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcgccctgctccaggagcacctccgagagcacagcggccctgggctgcctggtcaaggctacttccatctaactactgagcgggctggcaaggcgcatagnnnnnnnnnnnnn

SEQ ID NO: 294304 - DNA, 420 bp, Homo sapiens
  misc_feature: GYAE6OF01CX5RG.37.77.G11.1.454.CMB.1.raw
  modified_base (420)..(420): a, c, t, g, unknown or other
  misc_feature (420)..(420): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaatacggtctatctggaaatgaacagcctgagagccgaggacacggccctctattactgtgcgagagatcagacggagtatagcagcagctctgactactggggacacggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagn

SEQ ID NO: 294305 - DNA, 439 bp, Homo sapiens
  misc_feature: GYAE6OF01BNUS5.37.77.G11.1.454.CMB.1.raw
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 294306 - DNA, 441 bp, Homo sapiens
  misc_feature: GYAE6OF01DQTPU.37.77.G11.1.454.CMB.1.raw
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnn

SEQ ID NO: 294307 - DNA, 516 bp, Homo sapiens
  misc_feature: GYAE6OF01DR1GW.37.77.G11.1.454.CMB.1.raw
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (476)..(476): a, c, t, g, unknown or other
  misc_feature (476)..(476): n is a, c, g, or t
  modified_base (478)..(482): a, c, t, g, unknown or other
  misc_feature (478)..(482): n is a, c, g, or t
  modified_base (487)..(488): a, c, t, g, unknown or other
  misc_feature (487)..(488): n is a, c, g, or t
  modified_base (490)..(490): a, c, t, g, unknown or other
  misc_feature (490)..(490): n is a, c, g, or t
  modified_base (492)..(494): a, c, t, g, unknown or other
  misc_feature (492)..(494): n is a, c, g, or t
  modified_base (497)..(497): a, c, t, g, unknown or other
  misc_feature (497)..(497): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (503)..(505): a, c, t, g, unknown or other
  misc_feature (503)..(505): n is a, c, g, or t
  modified_base (507)..(511): a, c, t, g, unknown or other
  misc_feature (507)..(511): n is a, c, g, or t
  modified_base (513)..(516): a, c, t, g, unknown or other
  misc_feature (513)..(516): n is a, c, g, or t
tcagtagtgtagatcacgaccggtgctcgatttagctagtcactctaagggtaagggggctggagtgggtctcagctacttaatgggaatggtgataccgacatactacggcccagactccgtgaacgggccgggttcacccatctccagggaccaagttcccaacgaacacaacctgtctctgcaaatcgaacagcctcgagagtccgaggaccaccggccttatattactgtgtgaaggggacctctagccccttatagcagtcggcgtggtcctggtacgtttgacgtaactggggtcctagggaacccctgggtcaccgtctcctcagcctccaccgaaagggtcccaatcggtcttcccctggcncctgctcagancacctcgagagcacgacgcggccctggggctggccgtggtcaaaggactacgtccagtctacactactgacgcgggctggcaaggccgcatagcnannnnnatatnnanannntcncncncnnncnnnnnannnn

SEQ ID NO: 294308 - DNA, 440 bp, Homo sapiens
  misc_feature: GYAE6OF01BZ34F.37.77.G11.1.454.CMB.1.raw
  modified_base (434)..(440): a, c, t, g, unknown or other
  misc_feature (434)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcgactggtcctggtactttgacgactggggccagggaaccctggtcaccgtctcctcagcctccaccaagggcccatcggtctcccctggcgccctgctccaggagcacctccgagagcacagcggccctgggctgcctggtcaaggactacttccatctacactactgagcgggctggcaaggcgcatagnnnnnnn

SEQ ID NO: 294309 - DNA, 439 bp, Homo sapiens
  misc_feature: GYAE6OF01ADFK6.37.77.G11.1.454.CMB.1.raw
  modified_base (431)..(431): a, c, t, g, unknown or other
  misc_feature (431)..(431): n is a, c, g, or t
  modified_base (437)..(439): a, c, t, g, unknown or other
  misc_feature (437)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacctggtcaccgtctcctcagcctccaccaagggcccactcggtcttccccctggcgccctgctccaggagcacctccgagagcacagcggccctgggctgcctggtcaaggactacttccatctacactactgagcgggctgggcaaggcncatagnnn

SEQ ID NO: 294310 - DNA, 440 bp, Homo sapiens
  misc_feature: GYAE6OF01AJJ2S.37.77.G11.1.454.CMB.1.raw
  modified_base (436)..(440): a, c, t, g, unknown or other
  misc_feature (436)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 294311 - DNA, 508 bp, Homo sapiens
  misc_feature: GYAE6OF01ESNO5.37.77.G11.1.454.CMB.1.raw
  modified_base (465)..(467): a, c, t, g, unknown or other
  misc_feature (465)..(467): n is a, c, g, or t
  modified_base (469)..(469): a, c, t, g, unknown or other
  misc_feature (469)..(469): n is a, c, g, or t
  modified_base (476)..(477): a, c, t, g, unknown or other
  misc_feature (476)..(477): n is a, c, g, or t
  modified_base (479)..(479): a, c, t, g, unknown or other
  misc_feature (479)..(479): n is a, c, g, or t
  modified_base (481)..(482): a, c, t, g, unknown or other
  misc_feature (481)..(482): n is a, c, g, or t
  modified_base (484)..(488): a, c, t, g, unknown or other
  misc_feature (484)..(488): n is a, c, g, or t
  modified_base (490)..(494): a, c, t, g, unknown or other
  misc_feature (490)..(494): n is a, c, g, or t
  modified_base (496)..(496): a, c, t, g, unknown or other
  misc_feature (496)..(496): n is a, c, g, or t
  modified_base (498)..(500): a, c, t, g, unknown or other
  misc_feature (498)..(500): n is a, c, g, or t
  modified_base (502)..(508): a, c, t, g, unknown or other
  misc_feature (502)..(508): n is a, c, g, or t
tcagtagtgtagatcacgaccggtgctcgattttagctagtcactcgaagggaaaggggctggagtgggtactcagctatttaactgggaatggtggataccacatactacgcagactcccgtgaagggccggttcaccatctccaggggaccaagttccaaggaacacactgtctctcgcaaatgaacagcctgagagtcgaggacaggccttatattactgtgtgaagggacctctagccccttatagccagcggcgtggtcctggtactttgacggactggggccagggaccctggtcaccgtctcctcacgcctccaccaagggcccatcggtcttcccctggcgtccctgctccacggacgccaacctccgagtacgcacagcggcctgggctcgctggtccaaggactacttccgatctacactacgtgagcgggcgtcggacaaggcgcacttacggnnngngcacgcnncncnncnnnnncnnnnncncnnncnnnnnnn

SEQ ID NO: 294312 - DNA, 436 bp, Homo sapiens
  misc_feature: GYAE6OF01DPFLW.37.77.G11.1.454.CMB.1.raw
  modified_base (431)..(436): a, c, t, g, unknown or other
  misc_feature (431)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcatagnnnnnn

SEQ ID NO: 294313 - DNA, 461 bp, Homo sapiens
  misc_feature: GYAE6OF01B9YM6.37.77.G11.1.454.CMB.1.raw
  modified_base (454)..(461): a, c, t, g, unknown or other
  misc_feature (454)..(461): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctagccccttatagcagcggctggtcctggtactttgacgacgtgggccagggaaccctggtcaccgtctcctcagcctccaccaagggcccagtcggtccttccccgtggccgccctgcctccgaggagccacctccgagacgccacacggccggcccgtgggctcgccgtggtcaagggactaccttccatccacactactgacgcgggctggcgaaggcgcatagnnnnnnnn

SEQ ID NO: 294314 - DNA, 441 bp, Homo sapiens
  misc_feature: GYAE6OF01CK79U.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggagccctggtcactgtctcctcagcctccaccaagggcccatcggtcttccccctggcgccctgctccaggagcacctccgagagcacagcggccctgggctgcctggcaaggactacttccatctacactactgagcgggctggcaaggcgcatagnnnnnnn

SEQ ID NO: 294315 - DNA, 439 bp, Homo sapiens
  misc_feature: GYAE6OF01DJM8T.37.77.G11.1.454.CMB.1.raw
  modified_base (333)..(333): a, c, t, g, unknown or other
  misc_feature (333)..(333): n is a, c, g, or t
  modified_base (346)..(346): a, c, t, g, unknown or other
  misc_feature (346)..(346): n is a, c, g, or t
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcnccctgctccaggngcacctccgagagcacagcggccctgggctgccctggtcaaggactacttccatctacactactgagcgggctggcaaggcgcatagnnnnnn

SEQ ID NO: 294316 - DNA, 423 bp, Homo sapiens
  misc_feature: GYAE6OF01CDB8L.37.77.G11.1.454.CMB.1.raw
  modified_base (419)..(423): a, c, t, g, unknown or other
  misc_feature (419)..(423): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctggctgcctggtcaggactacttccatctacactactgagcgggctggcaaggcgcatagnnnnn

SEQ ID NO: 294317 - DNA, 435 bp, Homo sapiens
  misc_feature: GYAE6OF01AUGFS.37.77.G11.1.454.CMB.1.raw
  modified_base (429)..(435): a, c, t, g, unknown or other
  misc_feature (429)..(435): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtatctgcaaatgaacagcctgagtgccgaggacacggccctatattattgtgcgaaatgtggggggagtgggggctactcctggcgttttgactactggggccagggagccctggtcaccgtctcctcagcctccaccaagggcccatccggtcttccccctggccgccctgcctccaggagcacctccgagagcacagcggccctgggctgcctggtcaaggctacttccatctacactactgagcgggctggcaaggcgcatagnnnnnnn

SEQ ID NO: 294318 - DNA, 443 bp, Homo sapiens
  misc_feature: GYAE6OF01C9ZXD.37.77.G11.1.454.CMB.1.raw
  modified_base (435)..(443): a, c, t, g, unknown or other
  misc_feature (435)..(443): n is a, c, g, or t
tcagtagtgtagatcacgaccggtgctcgatttagctagtcactcaagggaaagggctggagtgggtctcagctattaatgggaatggtgataccacatactacgcagactccgtgaaggggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggctacttccatctacactactgagcgggctgggcaaggcgcatagnnnnnnnnn

SEQ ID NO: 294319 - DNA, 446 bp, Homo sapiens
  misc_feature: GYAE6OF01BD7VB.37.77.G11.1.454.CMB.1.raw
  modified_base (434)..(446): a, c, t, g, unknown or other
  misc_feature (434)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttgacgactggggccagggaaccctggtcaccgtctcctcagcctccaccaagggcccatcggtctcccctggcgccctgctccaggacgcacctccgagagcacagcggccctgggctgcctggtcaaggctacttccatctaccactactgagcgggctggcaaggcgcatagnnnnnnnnnnnnn

SEQ ID NO: 294320 - DNA, 451 bp, Homo sapiens
  misc_feature: GYAE6OF01DCSWM.37.77.G11.1.454.CMB.1.raw
  modified_base (250)..(250): a, c, t, g, unknown or other
  misc_feature (250)..(250): n is a, c, g, or t
  modified_base (296)..(296): a, c, t, g, unknown or other
  misc_feature (296)..(296): n is a, c, g, or t
  modified_base (433)..(433): a, c, t, g, unknown or other
  misc_feature (433)..(433): n is a, c, g, or t
  modified_base (439)..(451): a, c, t, g, unknown or other
  misc_feature (439)..(451): n is a, c, g, or t
tcagtagtgtagatcacgaccggtgctcgatttagctagtcactcaagggaaaggtgctggagtgggtctcagctattaatgggaatggtgataccacatactacgcagactccgtgaagggccggttcaccatctccagggacaattccaagaacacgctgtatctgcaaatgaacagcctgagagccgaggacacgaccgtatattactgttcgaaagataggtactctggttcgcgtactttttaangtccatcttgaccatggggccagggaaccctggtcaccgtctcctnagccctccaccaagggcccatccggtccttcccccgtggcgcccctgcctccaggacgccacctccgagagcacagcggccctgggctgcctggcaaggctacttcatctacactactgagcggctggctaagggcncatagnnnnnnnnnnnnn

SEQ ID NO: 294321 - DNA, 437 bp, Homo sapiens
  misc_feature: GYAE6OF01CNVCP.37.77.G11.1.454.CMB.1.raw
  modified_base (432)..(437): a, c, t, g, unknown or other
  misc_feature (432)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcaccctcctccaagagcacctctggggcacagcggccctggctgcctggtcaaggctacttccatctacactactgagcgggctggcaaggcgcatagnnnnnn

SEQ ID NO: 294322 - DNA, 458 bp, Homo sapiens
  misc_feature: GYAE6OF01AVQW2.37.77.G11.1.454.CMB.1.raw
  modified_base (300)..(300): a, c, t, g, unknown or other
  misc_feature (300)..(300): n is a, c, g, or t
  modified_base (352)..(352): a, c, t, g, unknown or other
  misc_feature (352)..(352): n is a, c, g, or t
  modified_base (423)..(423): a, c, t, g, unknown or other
  misc_feature (423)..(423): n is a, c, g, or t
  modified_base (433)..(433): a, c, t, g, unknown or other
  misc_feature (433)..(433): n is a, c, g, or t
  modified_base (440)..(458): a, c, t, g, unknown or other
  misc_feature (440)..(458): n is a, c, g, or t
tcagtagtgtagatcacgaccggtgctcgatttagctagtcactcaagggaaaggggctggaggtgggtctcagctattaatgggaatgggtgataccacatactacgcagactccgtgaagggccggttcaccatctccagggacaattccaagaacaacactgtctctgcaaatgaacagcctgagagtcgaggacacgggccttatattactgtacgaaaatggcctacggatatgactactattgggactggtacttcgatctctggggccgtggcaccctggtcactgtctcctnagcctccaccagggcccatcggtcttcccctggcgccctgcctccagggacncacctccggagagcacaggccggccctggggctcgcctggcaaggctactcatctacactactgagcggtntggcaaggcncatagcnnnnnnnnnnnnnnnnnnn

SEQ ID NO: 294323 - DNA, 442 bp, Homo sapiens
  misc_feature: GYAE6OF01EQMPQ.37.77.G11.1.454.CMB.1.raw
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnn

SEQ ID NO: 294324 - DNA, 410 bp, Homo sapiens
  misc_feature: GYAE6OF01E2YBI.37.77.G11.1.454.CMB.1.raw
  modified_base (408)..(410): a, c, t, g, unknown or other
  misc_feature (408)..(410): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnn

SEQ ID NO: 294325 - DNA, 439 bp, Homo sapiens
  misc_feature: GYAE6OF01CEXE7.37.77.G11.1.454.CMB.1.raw
  modified_base (430)..(430): a, c, t, g, unknown or other
  misc_feature (430)..(430): n is a, c, g, or t
  modified_base (436)..(439): a, c, t, g, unknown or other
  misc_feature (436)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcncatagnnnn

SEQ ID NO: 294326 - DNA, 454 bp, Homo sapiens
  misc_feature: GYAE6OF01AEZJR.37.77.G11.1.454.CMB.1.raw
  modified_base (445)..(454): a, c, t, g, unknown or other
  misc_feature (445)..(454): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaccctggtcaccgtctcctcagcctccaccaagggcccatccggtcttccccctggccgcccctgcctccagggacgccacctccgagacgcacagccggccctgggctgccctggtcaaggctacttccatctacactactgagcgggctggcaaggcgcatagnnnnnnnnnn

SEQ ID NO: 294327 - DNA, 439 bp, Homo sapiens
  misc_feature: GYAE6OF01D6QKF.37.77.G11.1.454.CMB.1.raw
  modified_base (433)..(439): a, c, t, g, unknown or other
  misc_feature (433)..(439): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggactacttccatctacactactgagcgggctgggcaaggcgcatagnnnnnnn

SEQ ID NO: 294328 - DNA, 439 bp, Homo sapiens
  misc_feature: GYAE6OF01ANVZ1.37.77.G11.1.454.CMB.1.raw
  modified_base (436)..(439): a, c, t, g, unknown or other
  misc_feature (436)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnn

SEQ ID NO: 294329 - DNA, 442 bp, Homo sapiens
  misc_feature: GYAE6OF01AWAA2.37.77.G11.1.454.CMB.1.raw
  modified_base (435)..(442): a, c, t, g, unknown or other
  misc_feature (435)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcaccctcctccaagagcacctctggggcacagcggccctgggctgcctggtcaaggactacttccatctacactactgagcgggctggcaaggcgcatagnnnnnnnn

SEQ ID NO: 294330 - DNA, 440 bp, Homo sapiens
  misc_feature: GYAE6OF01DNX57.37.77.G11.1.454.CMB.1.raw
  modified_base (435)..(440): a, c, t, g, unknown or other
  misc_feature (435)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactggggccagggaaccctggtcaccgtctcctcagcctccaccaagggcccatcggtctcccctggcgccctgctccaggagcacctccgagagcacagcggccctgggctgcctggtcaaggactacttccatctacactactgagcgggctggcaaggcgcatagnnnnnn

SEQ ID NO: 294331 - DNA, 438 bp, Homo sapiens
  misc_feature: GYAE6OF01BDB3A.37.77.G11.1.454.CMB.1.raw
  modified_base (434)..(438): a, c, t, g, unknown or other
  misc_feature (434)..(438): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaggactacttccatctacactactgagcgggctggcaaggcgcatagnnnnn

SEQ ID NO: 294332 - DNA, 441 bp, Homo sapiens
  misc_feature: GYAE6OF01AVDXV.37.77.G11.1.454.CMB.1.raw
  modified_base (432)..(441): a, c, t, g, unknown or other
  misc_feature (432)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagtgccgaggacacggccctatattattgtgcgaaatgtgggggagtgggggctactcctggcgttttgactactggggccaggggagccctggtcaccgtctcctcagcctccaccaagggcccatccggtccttccccctggccgccctgcctccaggacgcacctccgagagccacagcggccctgggctgcctggtcaaggctacttccatctacactactgagcgggctggcaaggcgcatagnnnnnnnnnn

SEQ ID NO: 294333 - DNA, 438 bp, Homo sapiens
  misc_feature: GYAE6OF01BRMX6.37.77.G11.1.454.CMB.1.raw
  modified_base (435)..(438): a, c, t, g, unknown or other
  misc_feature (435)..(438): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnn

SEQ ID NO: 294334 - DNA, 449 bp, Homo sapiens
  misc_feature: GYAE6OF01BELAJ.37.77.G11.1.454.CMB.1.raw
  modified_base (355)..(355): a, c, t, g, unknown or other
  misc_feature (355)..(355): n is a, c, g, or t
  modified_base (440)..(449): a, c, t, g, unknown or other
  misc_feature (440)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatccggtccttccccctggccgccctgcctccaggancacctccgagagcacagcggccctgggctgcctggtcaaggctacttcatcctacactactgagcgggctggcaaggcgcatagnnnnnnnnnn

SEQ ID NO: 294335 - DNA, 441 bp, Homo sapiens
  misc_feature: GYAE6OF01C62ZL.37.77.G11.1.454.CMB.1.raw
  modified_base (433)..(441): a, c, t, g, unknown or other
  misc_feature (433)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcgccctgctccaggacgcacctcgagagcacagcggccctgggctgcctggtcaaggctactccatctacactactgagcgggctgggcaaggcgcatagnnnnnnnnn

SEQ ID NO: 294336 - DNA, 443 bp, Homo sapiens
  misc_feature: GYAE6OF01B5EVK.37.77.G11.1.454.CMB.1.raw
  modified_base (438)..(443): a, c, t, g, unknown or other
  misc_feature (438)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgacggacacggccttatattactgtgtgaagggacctctagccccttatagcagcggctggtcctggtactttgacgactggggccagggaaccctggtcaccgtctcctcagcctccaccaagggcccatccggtcttccccctggccgccctgctccaggagcacctccgagagcacagcggccctgggctgcctggtcaggactacttccatctacactactgagcgggctggcaaggcgcatagnnnnnn

SEQ ID NO: 294337 - DNA, 434 bp, Homo sapiens
  misc_feature: GYAE6OF01AQDSS.37.77.G11.1.454.CMB.1.raw
  modified_base (221)..(221): a, c, t, g, unknown or other
  misc_feature (221)..(221): n is a, c, g, or t
  modified_base (424)..(434): a, c, t, g, unknown or other
  misc_feature (424)..(434): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaacgccaagaactccctgtatctgcaaatgaacagtctgagagctgaggacacggccttgtattactgtgcaaaggntcagtatcaactggctgtcaatacttttgatatttggggccaaggcacaatggtcagcgtctcttcagcctccaccaagggcccatcggtcttccccctggcaccctcctccaagacgcacctctgggggcacagcggccctgggctgcctggtcaaggctacttccatctacactactgagcgggctggcaaggcgcatagnnnnnnnnnnn

SEQ ID NO: 294338 - DNA, 442 bp, Homo sapiens
  misc_feature: GYAE6OF01AJKMM.37.77.G11.1.454.CMB.1.raw
  modified_base (435)..(442): a, c, t, g, unknown or other
  misc_feature (435)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctcctccaagagcacctctggggcacagcggccctgggctgcctggtcaaggactacttccatctacactactgagcgggctggcaaggcgcatagnnnnnnnn

SEQ ID NO: 294339 - DNA, 440 bp, Homo sapiens
  misc_feature: GYAE6OF01B2DQI.37.77.G11.1.454.CMB.1.raw
  modified_base (418)..(418): a, c, t, g, unknown or other
  misc_feature (418)..(418): n is a, c, g, or t
  modified_base (434)..(440): a, c, t, g, unknown or other
  misc_feature (434)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccttatagcagcggctggtcctggtactttgacgactggggccagggaaccctggtcaccgtctcctcagcctccaccaacgggcccatcggtcttcccctggccgccctgctccaggagcacctcgagagcacagcggccctgggctgcctggtcaaggactacttccatctacactatgagcgggntggcaaggcgcatagnnnnnnn

SEQ ID NO: 294340 - DNA, 436 bp, Homo sapiens
  misc_feature: GYAE6OF01A47I7.37.77.G11.1.454.CMB.1.raw
  modified_base (425)..(436): a, c, t, g, unknown or other
  misc_feature (425)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccaccaagggcccatcggtctccccctggccgccctgctccaggagcacctccgagagcacagcggccctgggctgcctggtcaaggctactcatctacactactgagcgggctggcaaggcgcatagnnnnnnnnnnnn

SEQ ID NO: 294341 - DNA, 502 bp, Homo sapiens
  misc_feature: GYAE6OF01EWXOT.37.77.G11.1.454.CMB.1.raw
  modified_base (474)..(502): a, c, t, g, unknown or other
  misc_feature (474)..(502): n is a, c, g, or t
tcagtagtgtagatcacgaccggtgctcgatttagctagtcactcgaagggaaaggggctggagtgggtctcagctattaaagggaatggtgataccacatactacgcagactccgtgaagggccggttcaccatctccagggacaattccaagtaacacactgtctctgcaaatgaacagcctgagagtcgaggacacggccgttatattactgtgtggaagggacctctagccccttatagcagcggctggtcctggtactttgacgactggggccagggaaccctggtcaccgtctcctcagcctccaccgaacgggcccagtccggtccttcccccgtggtcgcccctgcctccaggagccacctccgagacgcacagccggccctgggcctgcccgtggtaccaaggtaccttacgttacccagtcccttaacactacgtgaacgccgggactggacaaggcgcatagnnnnnnnnnnnnnnnnnnnnnnnnnnnnn

SEQ ID NO: 294342 - DNA, 449 bp, Homo sapiens
  misc_feature: GYAE6OF01BDZN1.37.77.G11.1.454.CMB.1.raw
  modified_base (442)..(449): a, c, t, g, unknown or other
  misc_feature (442)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgcccctgcctccaggacgcacctccgagacgcacagcggccctgggctgcctggtcaaggactacttccatcctacactactgagcgggctggcaaggcgcatagnnnnnnnn

SEQ ID NO: 294343 - DNA, 445 bp, Homo sapiens
  misc_feature: GYAE6OF01A7D5F.37.77.G11.1.454.CMB.1.raw
  modified_base (437)..(445): a, c, t, g, unknown or other
  misc_feature (437)..(445): n is a, c, g, or t
tcagtagtgtagatcacgaccggtgctcgatttagctagtcactcaagggaaggggcgtggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggcgcccctgcctccaggagcacctcgagagcacagcggccctgggctgcctggtcaaggctacttccatctacactactgagcgggctggcaaggcgcatagnnnnnnnnn

SEQ ID NO: 294344 - DNA, 456 bp, Homo sapiens
  misc_feature: GYAE6OF01B6OXH.37.77.G11.1.454.CMB.1.raw
  modified_base (442)..(456): a, c, t, g, unknown or other
  misc_feature (442)..(456): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagccctccaccaagggcccatcggtccttcccctggccgccctgctccgaggacgcacctccgagacgcacagccggccctgggctgcctggtcaaggactacttcccatcacactactgagcgggctggcaaggcgcatagnnnnnnnnnnnnnnn

SEQ ID NO: 294345 - DNA, 444 bp, Homo sapiens
  misc_feature: GYAE6OF01A0XGO.37.77.G11.1.454.CMB.1.raw
  modified_base (437)..(444): a, c, t, g, unknown or other
  misc_feature (437)..(444): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccgtctcctcagcctccaccaagggcccatcggtcttcccctggcgccctgctccaggacgccacctccgagacgcacagcggccctgggctcgcctggtcaaggactactccatctacactactgagcggctggcaaggcgcatgnnnnnnnn

SEQ ID NO: 294346 - DNA, 454 bp, Homo sapiens
  misc_feature: GYAE6OF01C5JQ3.37.77.G11.1.454.CMB.1.raw
  modified_base (446)..(454): a, c, t, g, unknown or other
  misc_feature (446)..(454): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccctatattattgtgcgaaatggtggggggagtgggggctactccgtggtcgttttgactacgtgggggccaggggacgccctgggtcaccggtctccctcagcctccaccaagggccccatccggtccttccccctggcccgcccctgcctccaggacgccacctccgagagcacaggccggccctgggctgcctggtcaaggctacgttccatcacactactgagcggctggcaaggcgcatagnnnnnnnnn

SEQ ID NO: 294347 - DNA, 452 bp, Homo sapiens
  misc_feature: GYAE6OF01C4PMU.37.77.G11.1.454.CMB.1.raw
  modified_base (349)..(349): a, c, t, g, unknown or other
  misc_feature (349)..(349): n is a, c, g, or t
  modified_base (442)..(452): a, c, t, g, unknown or other
  misc_feature (442)..(452): n is a, c, g, or t
tcagtagtgtagatcacgaccggtgctcgatttagctagtcactcaaggtaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggancacctccgagagcacagcggccctggggcctgcctggtcaaggacttacttccatcctacactactgacgcgggctgggcaaggcgacatagnnnnnnnnnnn

SEQ ID NO: 294348 - DNA, 444 bp, Homo sapiens
  misc_feature: GYAE6OF01BM0UJ.37.77.G11.1.454.CMB.1.raw
  modified_base (348)..(348): a, c, t, g, unknown or other
  misc_feature (348)..(348): n is a, c, g, or t
  modified_base (435)..(444): a, c, t, g, unknown or other
  misc_feature (435)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcgccctgctccaggacncacctccgagacgcacagcggccctgggctgcctggtcaaggactactccatctacactactgacgcgggctggcaaggcgcatagnnnnnnnnnn

SEQ ID NO: 294349 - DNA, 445 bp, Homo sapiens
  misc_feature: GYAE6OF01DDN2S.37.77.G11.1.454.CMB.1.raw
  modified_base (334)..(334): a, c, t, g, unknown or other
  misc_feature (334)..(334): n is a, c, g, or t
  modified_base (435)..(445): a, c, t, g, unknown or other
  misc_feature (435)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcnccctgctccaggagcacctcgagagcacagcggccctgggctgcctggtcaaggactacgttccatctacactactgagcgggctggcaaggcgacatagnnnnnnnnnnn

SEQ ID NO: 294350 - DNA, 441 bp, Homo sapiens
  misc_feature: GYAE6OF01B1KBR.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcatagnnnnnnn

SEQ ID NO: 294351 - DNA, 441 bp, Homo sapiens
  misc_feature: GYAE6OF01C9GPG.37.77.G11.1.454.CMB.1.raw
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttcccctggcgccctgctcccaggagcacctccgagagcacagcggccctgggctgcctggtcaaggctacttccatctacactactgagcgggctggcaaggcgcatagnnnnnn

SEQ ID NO: 294352 - DNA, 450 bp, Homo sapiens
  misc_feature: GYAE6OF01EJX67.37.77.G11.1.454.CMB.1.raw
  modified_base (443)..(450): a, c, t, g, unknown or other
  misc_feature (443)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatccggtcttccccctggccgccctgctccaggcgccacctccgagagcacagcggccctgggctgcctggtcaaggactacttccatcctacactactgaggcgggctggcaaggcgacatagnnnnnnnn

SEQ ID NO: 294353 - DNA, 526 bp, Homo sapiens
  misc_feature: GYAE6OF01CZT5H.37.77.G11.1.454.CMB.1.raw
  modified_base (496)..(526): a, c, t, g, unknown or other
  misc_feature (496)..(526): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttcccctggccgcccctgcctccaggacgcacctccggagacgccacgacgccggccctggggcctggcccttggtaccaaacgggtaccttaccttccagttcctaaccaccttaacgttcggaacggtccggggcttacgggacgaaacgggccgaccaatacggcannnnnnnnnnnnnnnnnnnnnnnnnnnnnnn

SEQ ID NO: 294354 - DNA, 436 bp, Homo sapiens
  misc_feature: GYAE6OF01C03PA.37.77.G11.1.454.CMB.1.raw
  modified_base (336)..(336): a, c, t, g, unknown or other
  misc_feature (336)..(336): n is a, c, g, or t
  modified_base (436)..(436): a, c, t, g, unknown or other
  misc_feature (436)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggccnccctgctccaggacgcacctcgagagcacagcggccctgggctgcctggtcaaggactacttccatctacactactgagcgggctggcaaggcgcatagn

SEQ ID NO: 294355 - DNA, 437 bp, Homo sapiens
  misc_feature: GYAE6OF01EOWW6.37.77.G11.1.454.CMB.1.raw
  modified_base (434)..(437): a, c, t, g, unknown or other
  misc_feature (434)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctcctccaagagcacctctggggcacagcggccctgggctgcctggtcaaggactacttccatctacactactgagcggctggcaaggcgcatagnnnn

SEQ ID NO: 294356 - DNA, 429 bp, Homo sapiens
  misc_feature: GYAE6OF01AK1YP.37.77.G11.1.454.CMB.1.raw
  modified_base (424)..(429): a, c, t, g, unknown or other
  misc_feature (424)..(429): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagccgacgacgacggccatatattattgtgcgaaagacccccaacggtgaccacattggagcttttgacttctggggccaagggacaacggtcaccgtctcttcagcctccaccaagggcccatcggtcttcccctggcgccctgctccaggagcacctccgagagcacagcggccctgggctgcctggtcaggactacttccatctacactactgagcgggctggcaaggcgcatagnnnnnn

SEQ ID NO: 294357 - DNA, 444 bp, Homo sapiens
  misc_feature: GYAE6OF01CH3JR.37.77.G11.1.454.CMB.1.raw
  modified_base (439)..(444): a, c, t, g, unknown or other
  misc_feature (439)..(444): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggccgccctgctccaggacgcacctccgagacgcacagcggccctgggctgcctggtcaaggactacttccatctacactactgagcgggactggacaaggcgcatagnnnnnn

SEQ ID NO: 294358 - DNA, 454 bp, Homo sapiens
  misc_feature: GYAE6OF01C57ZH.37.77.G11.1.454.CMB.1.raw
  modified_base (396)..(396): a, c, t, g, unknown or other
  misc_feature (396)..(396): n is a, c, g, or t
  modified_base (450)..(454): a, c, t, g, unknown or other
  misc_feature (450)..(454): n is a, c, g, or t
tcagtagtgtagatcacgaccggtgctcgatttagctagtcactcaaggggtaaagggggctggagtgggtctcagctattaatcgggaatggtcgataccacatactacgccacgactccgtgaagggccggttcaccatctccgagggacaattaccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccgaagggcccatccggtccttccccctggccgcccctgcctccaggacgcacctccgagagcacagcggccctgggcngctggtcaaggctacttcatctacactactgagcgggctggcaaggcgcatagnnnnn

SEQ ID NO: 294359 - DNA, 427 bp, Homo sapiens
  misc_feature: GYAE6OF01DZVE1.37.77.G11.1.454.CMB.1.raw
  modified_base (421)..(427): a, c, t, g, unknown or other
  misc_feature (421)..(427): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgcgagagatcagacggagtatagcagcagctctgactactggggccacggaaccctggtcaccgtctcctcagcctccaccaagggcccatcggtcttccccctggccaccctcctccaagacgcacctctggggcacagcggccctggctgcctggtcaaggactacttccatctacactactgagcgggctggcaaggcgcatagnnnnnnn

SEQ ID NO: 294360 - DNA, 471 bp, Homo sapiens
  misc_feature: GYAE6OF01ETX5K.37.77.G11.1.454.CMB.1.raw
  modified_base (342)..(342): a, c, t, g, unknown or other
  misc_feature (342)..(342): n is a, c, g, or t
  modified_base (451)..(471): a, c, t, g, unknown or other
  misc_feature (451)..(471): n is a, c, g, or t
tcagtagtgtagatcacgaccggtgctcgatttagctagtcactcaaggggaaagggggctggagtgggtctcagctattaatgggaatggtgataccacatactacgcagactccgtgaagggccggttcaccatctccagggacaattccaagaacacactgtctctggcaaatgaacagcctgagagtcgaggacacggccttatattactgtgtgaagggacctctagcccccttatagcagcggctggtcctggtactttgacgactggggccagggaaccctggtcaccgtctccgtcagcctccaccaagggcccatcggtcttccccctggccncccctgcctcctaggacgccacctcctagagccacacgcggcccctgggctgcctggtcaaggacctacttccatctacactactgagcgggctggcaaggcgcatagnnnnnnnnnnnnnnnnnnnnn

SEQ ID NO: 294361 - DNA, 441 bp, Homo sapiens
  misc_feature: GYAE6OF01DX6VP.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctccccctggcgccctgctccaggagcacctccgagagcacagcggccctgggctgcctggtcaaggactacttccatctacactactgagcgggctggcaaggcgcatagnnnnnnn

SEQ ID NO: 294362 - DNA, 479 bp, Homo sapiens
  misc_feature: GYAE6OF01AVAM7.37.77.G11.1.454.CMB.1.raw
  modified_base (390)..(390): a, c, t, g, unknown or other
  misc_feature (390)..(390): n is a, c, g, or t
  modified_base (430)..(430): a, c, t, g, unknown or other
  misc_feature (430)..(430): n is a, c, g, or t
  modified_base (462)..(462): a, c, t, g, unknown or other
  misc_feature (462)..(462): n is a, c, g, or t
  modified_base (465)..(479): a, c, t, g, unknown or other
  misc_feature (465)..(479): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtccttccccctggccgcccctgcctccaggacgccacctccggaggcacacgacggcccgcggcggcncgtcgtcgacgacgtacttccactctaccactacctacgnggacggcggtcgtcggacgtacggcgactagngcnnnnnnnnnnnnnnn

SEQ ID NO: 294363 - DNA, 444 bp, Homo sapiens
  misc_feature: GYAE6OF01B84B5.37.77.G11.1.454.CMB.1.raw
  modified_base (433)..(433): a, c, t, g, unknown or other
  misc_feature (433)..(433): n is a, c, g, or t
  modified_base (439)..(444): a, c, t, g, unknown or other
  misc_feature (439)..(444): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgcccctgctcccaggacgcacctccgagagcacagcggccctgggctgcctggtcaaggactacttccatctacactactgagcgggctggcaaggcncatagnnnnnn

SEQ ID NO: 294364 - DNA, 441 bp, Homo sapiens
  misc_feature: GYAE6OF01EDWUB.37.77.G11.1.454.CMB.1.raw
  modified_base (334)..(334): a, c, t, g, unknown or other
  misc_feature (334)..(334): n is a, c, g, or t
  modified_base (434)..(441): a, c, t, g, unknown or other
  misc_feature (434)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcnccctgctccaggagcacctccgagacgcacagcggccctgggctgcctggtcaaggactactccatctacactactgagcgggctggcaaggcgcatagnnnnnnnn

SEQ ID NO: 294365 - DNA, 442 bp, Homo sapiens
  misc_feature: GYAE6OF01CSOSZ.37.77.G11.1.454.CMB.1.raw
  modified_base (332)..(332): a, c, t, g, unknown or other
  misc_feature (332)..(332): n is a, c, g, or t
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcnccctgctccaggagcacctccgagacgcacagcggccctgggctgcctggtcaaggacctacttccatctacactactgagcgggctgggcaagggcgcatagnnnnnnn

SEQ ID NO: 294366 - DNA, 431 bp, Homo sapiens
  misc_feature: GYAE6OF01BDH3K.37.77.G11.1.454.CMB.1.raw
  modified_base (422)..(431): a, c, t, g, unknown or other
  misc_feature (422)..(431): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccctctattactgtgcgagagatcagacggagtatagcagcagctctgactactggggccacggaaccctggtcaccgtctcctcagcctccaccaagggcccatcggtcttccccctggcaccctcctccaacgagcacctctcggggcacagcggccctgggctgcctggtcaaggactacttccatctacactactgagcgggctggcaaggcgcatagnnnnnnnnnn

SEQ ID NO: 294367 - DNA, 413 bp, Homo sapiens
  misc_feature: GYAE6OF01AY3WZ.37.77.G11.1.454.CMB.1.raw
  modified_base (409)..(413): a, c, t, g, unknown or other
  misc_feature (409)..(413): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcatagnnnnn

SEQ ID NO: 294368 - DNA, 443 bp, Homo sapiens
  misc_feature: GYAE6OF01BOAJ8.37.77.G11.1.454.CMB.1.raw
  modified_base (437)..(443): a, c, t, g, unknown or other
  misc_feature (437)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggagcacctccgagacgcacagcggccctgggctgcctggtcaaggctacttccatctacactactgagcgggctggcaaggcgcatagnnnnnnn

SEQ ID NO: 294369 - DNA, 443 bp, Homo sapiens
  misc_feature: GYAE6OF01B9OHK.37.77.G11.1.454.CMB.1.raw
  modified_base (353)..(353): a, c, t, g, unknown or other
  misc_feature (353)..(353): n is a, c, g, or t
  modified_base (437)..(443): a, c, t, g, unknown or other
  misc_feature (437)..(443): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccgtctcctcagcctccaccaagggcccatcggtccttcccctggccgccctgctccaggacncacctacgagagcacagcggccctgggctgcctggtcaaggctacttccatctacactactgagcgggctggcaaggcgcatgnnnnnnn

SEQ ID NO: 294370 - DNA, 444 bp, Homo sapiens
  misc_feature: GYAE6OF01A81P6.37.77.G11.1.454.CMB.1.raw
  modified_base (435)..(444): a, c, t, g, unknown or other
  misc_feature (435)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcgccctgctccaggacgcacctccgagacgcacagcggccctgggctgcctggtcaaggactacttccatctacactactgagcgggctggcaaggcgcatagnnnnnnnnnn

SEQ ID NO: 294371 - DNA, 660 bp, Homo sapiens
  misc_feature: GYAE6OF01CG4PW.37.77.G11.1.454.CMB.1.raw
tcagtagtgtagatcacgaccggtgctcgatttagctagtcactcaagggaaagggggctggagtcgggtctcagctattaatgggtaatggtgataccacatactacgcagactccgtgaagggccggttcaccatctccgagggacaattccaagaactacactgtctacttagcaaatgaacagctgagagtcgaggacacggtcttagtattactggtgtgaaggggacctctagcccttatacgcagcggctggtctgtacttgacgacgtgggccaggacctggtcaccgtctccctcgagccctaccaccgaacgggcccagtccggtccgttccccgtggccgtaccctagctccgaggcgacaccgtaccgagacgcgacgtacggccggcccgtagggcccgtacgtcccgttacggtaccgtaaacgggacccttaacgttcccgaattacccttaaccgtaacgttaacgtaacggtaccggttaccgggaccttacgggaacccgtaaacgggcccgtaaaccgtaaggtaaccgagtaaccgagacgacgacgtacgtacgtacgtacgtactactacactactacgtacgtacgtacgtacgtacggtacgtcggacgacgacgtacgacgagtcgtcgtcgtcg

SEQ ID NO: 294372 - DNA, 446 bp, Homo sapiens
  misc_feature: GYAE6OF01BGQ5A.37.77.G11.1.454.CMB.1.raw
  modified_base (357)..(357): a, c, t, g, unknown or other
  misc_feature (357)..(357): n is a, c, g, or t
  modified_base (434)..(446): a, c, t, g, unknown or other
  misc_feature (434)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctgggccgtggcaccctggtcactgtctcctcagcctccaccaagggcccatcggtcttcccctggcgccctgctccaggacgcacctccgagngcacagccggccctgggctgcctggtcaaggactacttccatctacactactgagcgggctggcaaggcgcatacgnnnnnnnnnnnnn

SEQ ID NO: 294373 - DNA, 479 bp, Homo sapiens
  misc_feature: GYAE6OF01BXCKS.37.77.G11.1.454.CMB.1.raw
  modified_base (450)..(450): a, c, t, g, unknown or other
  misc_feature (450)..(450): n is a, c, g, or t
  modified_base (452)..(479): a, c, t, g, unknown or other
  misc_feature (452)..(479): n is a, c, g, or t
tcagtagtgtagatcacgaccggtgctcgatttagctagtcactcaaggggaaaggggctggagtgggtctcagcctaattaattgggaatggtgataccacatactacgcagactccgtgaagggccggttcaccatctccaggggacaattcctaagaacacactgtctctgcaaatgaacagcctgagagtcgaggacacggccttatattactgtgtggaagggacctctagccccttatagcagcggctggtcctggttactttgacgactggggccagggaaccctggtcaccgtctcctcagcctccaccaaggggcccagtccgggtctttccccctaggacgccctgctccaggagccacctcgagacgcacagcggcctggctgcctggcaaggactacttccaatctacactactgaagcggctggcaaggcgcatagncnnnnnnnnnnnnnnnnnnnnnnnnnnnn

SEQ ID NO: 294374 - DNA, 511 bp, Homo sapiens
  misc_feature: GYAE6OF01CKZUC.37.77.G11.1.454.CMB.1.raw
  modified_base (491)..(511): a, c, t, g, unknown or other
  misc_feature (491)..(511): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgaggacacggccttatattactgtacgaaaatggcctacggatatgactactattgggactggtacttcgatctcgtggggcgtggcacccgtggtcactgtcctcctcacgcctccaccgaacgggcccactccggtccttcccccgtggccgcccctcgcctccgacggacgccaccgtccgagagccacgacgccggcccgtggggctgccgtgggtccaaggtaccttaccgttccattcctaacgaccttacgtcggacggccggggtctcggggaccaaggggtccgacaagtagnnnnnnnnnnnnnnnnnnnnn

SEQ ID NO: 294375 - DNA, 441 bp, Homo sapiens
  misc_feature: GYAE6OF01DY9SK.37.77.G11.1.454.CMB.1.raw
  modified_base (430)..(430): a, c, t, g, unknown or other
  misc_feature (430)..(430): n is a, c, g, or t
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggacgcacctccgagagcacagcggccctgggctgcctggtcaaggactactccatctacactactgagcgggctggcaaggcncatagnnnnnn

SEQ ID NO: 294376 - DNA, 542 bp, Homo sapiens
  misc_feature: GYAE6OF01CS4D2.37.77.G11.1.454.CMB.1.raw
  modified_base (511)..(542): a, c, t, g, unknown or other
  misc_feature (511)..(542): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtccaccgtctcctcagcctccaccaagggcccagtccgtccttccccgtggccgccctgccctccgacggacgcctacccgtccggacgacgccaaccgacggcccggtcccgtcgggccgtcggtcccgtggtaccgaaacggtaccttaccttacccgattaccctaaccgtactaccgtggacggcgggtacgtgggaccgaaagggccgaccgaagtcgcnnnnnnnnnnnnnnnnnnnnnnnnnnnnnnnn

SEQ ID NO: 294377 - DNA, 457 bp, Homo sapiens
  misc_feature: GYAE6OF01EFY8C.37.77.G11.1.454.CMB.1.raw
  modified_base (443)..(443): a, c, t, g, unknown or other
  misc_feature (443)..(443): n is a, c, g, or t
  modified_base (449)..(457): a, c, t, g, unknown or other
  misc_feature (449)..(457): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttccccctggccgcccctgcctccaggacgccacctccgagacgcacgagccggccctgggctgcctggtcaaggacctacttccattcctacctactgagcgggctggcaagggcncatagnnnnnnnnn

SEQ ID NO: 294378 - DNA, 443 bp, Homo sapiens
  misc_feature: GYAE6OF01CS3MN.37.77.G11.1.454.CMB.1.raw
  modified_base (439)..(443): a, c, t, g, unknown or other
  misc_feature (439)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccgccctgctccaggacgcacctccgagagcacagcggccctgggctgcctggtcaaggactacttccatctacactactgagcgggctggcaaggcgcatagnnnnn

SEQ ID NO: 294379 - DNA, 462 bp, Homo sapiens
  misc_feature: GYAE6OF01AHWB8.37.77.G11.1.454.CMB.1.raw
  modified_base (348)..(348): a, c, t, g, unknown or other
  misc_feature (348)..(348): n is a, c, g, or t
  modified_base (447)..(462): a, c, t, g, unknown or other
  misc_feature (447)..(462): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacaccggccttatattactgtgtgaagggacctctagccccttatagcagcggctggtcctggtactttgacgactggggccagggaaccctggtccaccgtctcctcagcctccaccaaggcccatcggtctcccctggcgccctgcctcaggngcacctccgagagcacagcggccctgggcctgccgtggtcgaagggacctacttccatcctacactactggacgccgggctggccaacgggcgcatgcnnnnnnnnnnnnnnnn

SEQ ID NO: 294380 - DNA, 510 bp, Homo sapiens
  misc_feature: GYAE6OF01AMPE9.37.77.G11.1.454.CMB.1.raw
  modified_base (381)..(381): a, c, t, g, unknown or other
  misc_feature (381)..(381): n is a, c, g, or t
  modified_base (451)..(451): a, c, t, g, unknown or other
  misc_feature (451)..(451): n is a, c, g, or t
  modified_base (476)..(481): a, c, t, g, unknown or other
  misc_feature (476)..(481): n is a, c, g, or t
  modified_base (483)..(483): a, c, t, g, unknown or other
  misc_feature (483)..(483): n is a, c, g, or t
  modified_base (485)..(510): a, c, t, g, unknown or other
  misc_feature (485)..(510): n is a, c, g, or t
tcagtagtgtagatcacgaccggtgctcgatttagctagtcactcgaaaggggaaaggggctggagtgggtctcagcctattaagtgggaatgggtacgataccacatactacgcagactccgtgaagggcccggttcaccactctccacggggaccaattaccaagaacacactgtctctgcaaatcgaacagtcctgagaggtcgaggaccaccggccttatattactggtgtgaagggacctctagcccttatagcagcgctggtcctggtactttgacgactggggcccagggaaccctcggtcacccgtctcctcacgccctccaccaacgggcccctatcggtccttccccgtcggccgcccctgcctccacggngccacctccgagacgcacgcggcggcccgtgggctcgcctggtcacggactacttcactctacacttacngcgcgggctggccaaggcgcatagnnnnnngngnnnnnnnnnnnnnnnnnnnnnnnnnn

SEQ ID NO: 294381 - DNA, 452 bp, Homo sapiens
  misc_feature: GYAE6OF01ANB5Z.37.77.G11.1.454.CMB.1.raw
  modified_base (442)..(452): a, c, t, g, unknown or other
  misc_feature (442)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccgccctgctccaggagccacctccgagacgcacagccggccctgggctgcctggtccaaggctacttccatctacactactgacgcgggctggcaaggcgcatagnnnnnnnnnnn

SEQ ID NO: 294382 - DNA, 574 bp, Homo sapiens
  misc_feature: GYAE6OF01DH4JX.37.77.G11.1.454.CMB.1.raw
  modified_base (299)..(299): a, c, t, g, unknown or other
  misc_feature (299)..(299): n is a, c, g, or t
  modified_base (545)..(574): a, c, t, g, unknown or other
  misc_feature (545)..(574): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccttatagcagcggctggtcctggtactttgacgactggggccagggaaccctggtcaccgtctccctnacgtcctccaacgaaccggcctacgtcgttccctcccgtcggccgtcccgtcgtcctccgaaggccgaccgtaccgtccgaagacgaccaacgcggccccggtccggtcggtccgtccgtaccggtcggtaacgaaacggttaccttaccccttaccctaacttaccctaaccgtaaccttacggtacgggacgggtcccggggtcgttaccgggaacggaacggggcccaaccgtaaggtagcgnnnnnnnnnnnnnnnnnnnnnnnnnnnnnn

SEQ ID NO: 294383 - DNA, 461 bp, Homo sapiens
  misc_feature: GYAE6OF01B3AOI.37.77.G11.1.454.CMB.1.raw
  modified_base (352)..(352): a, c, t, g, unknown or other
  misc_feature (352)..(352): n is a, c, g, or t
  modified_base (423)..(423): a, c, t, g, unknown or other
  misc_feature (423)..(423): n is a, c, g, or t
  modified_base (440)..(461): a, c, t, g, unknown or other
  misc_feature (440)..(461): n is a, c, g, or t
tcagtagtgtagatcacgaccggtgctcgatttagctagtcactcaagggaaaggggcgtgggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccgttatagcagcggctggtcctggtactttgacgactggggccagggaaccctggtcaccgtctcctcacgcctccaccaagggcccatcggtctcccctggcgccctgctcaggacnccacctcgagagcacagccggcctgggctgcctggtcaaggactacttccatcctacactactgagcgggntggcaaggtcgcatagnnnnnnnnnnnnnnnnnnnnnn

SEQ ID NO: 294384 - DNA, 453 bp, Homo sapiens
  misc_feature: GYAE6OF01DTP3K.37.77.G11.1.454.CMB.1.raw
  modified_base (435)..(453): a, c, t, g, unknown or other
  misc_feature (435)..(453): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaaggctacgttccatctacactactgagcggctggcaaggcgcatacgnnnnnnnnnnnnnnnnnnn

SEQ ID NO: 294385 - DNA, 441 bp, Homo sapiens
  misc_feature: GYAE6OF01DO3ZH.37.77.G11.1.454.CMB.1.raw
  modified_base (434)..(441): a, c, t, g, unknown or other
  misc_feature (434)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccttatagcagcggctggtcctggtactttgacgactggggccagggaaccctggtcaccgtctcctcagcctccaccaagggcccatcggtcttcccctggccgccctgctccaggacgcacctccgagagcacagcggccctggctgcctggtcaaggactacttccatctacactactgagcggctggcaaggcgcatagnnnnnnnn

SEQ ID NO: 294386 - DNA, 443 bp, Homo sapiens
  misc_feature: GYAE6OF01EJMB4.37.77.G11.1.454.CMB.1.raw
  modified_base (435)..(443): a, c, t, g, unknown or other
  misc_feature (435)..(443): n is a, c, g, or t
tcagtagtgtagatcacgaccggtgctcgatttagctagtcactcaagggaaaggggcgtggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccagggcccatcggtcttccccctggcgccctgctccaggagcacctccgagagcacagcggccctgggctgcctggcaaggctacttccatctacactactgagcgggctggcaaggcgcagtagnnnnnnnnn

SEQ ID NO: 294387 - DNA, 471 bp, Homo sapiens
  misc_feature: GYAE6OF01BOYK0.37.77.G11.1.454.CMB.1.raw
  modified_base (449)..(471): a, c, t, g, unknown or other
  misc_feature (449)..(471): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgcgagagatcagacggagtatagcagcagctctgactactgggccacggaaccctggtcaccgtctcctcacgccctccaccgaacgggcccagtccggtccttccccctggcccaccctccctccaagacgccacctcgtcggggcacgacgccggccctgggctcggcctggtcaacggacctacttccatctaccactactgacgcgggcgtcggcgaaggcgacacgtagcnnnnnnnnnnnnnnnnnnnnnnn

SEQ ID NO: 294388 - DNA, 456 bp, Homo sapiens
  misc_feature: GYAE6OF01COYMQ.37.77.G11.1.454.CMB.1.raw
  modified_base (446)..(456): a, c, t, g, unknown or other
  misc_feature (446)..(456): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtccttcccctggccacccctcctccaacgacgcacctcgtcggggcacgacgccggccctgggctcgccgtggtcaacggactacttccatctacactactgagcggctggcaaggcgcatagnnnnnnnnnnn

SEQ ID NO: 294389 - DNA, 441 bp, Homo sapiens
  misc_feature: GYAE6OF01BCPS8.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggacgcacctccgagagcacagcggccctgggctgcctggtcaggactacttccatctacactactgagcgggctggcaaggcgcatagnnnnnnn

SEQ ID NO: 294390 - DNA, 441 bp, Homo sapiens
  misc_feature: GYAE6OF01BR0MH.37.77.G11.1.454.CMB.1.raw
  modified_base (348)..(348): a, c, t, g, unknown or other
  misc_feature (348)..(348): n is a, c, g, or t
  modified_base (427)..(427): a, c, t, g, unknown or other
  misc_feature (427)..(427): n is a, c, g, or t
  modified_base (432)..(441): a, c, t, g, unknown or other
  misc_feature (432)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggngcacctccgagagcacagcggcctgggctgcctggtcaaggctactccatctacactactgacgcgggctggcaaggcnatagnnnnnnnnnn

SEQ ID NO: 294391 - DNA, 439 bp, Homo sapiens
  misc_feature: GYAE6OF01DQESN.37.77.G11.1.454.CMB.1.raw
  modified_base (331)..(331): a, c, t, g, unknown or other
  misc_feature (331)..(331): n is a, c, g, or t
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttacgactggggccagggaaccctggtcaccgtctcctcagcctcaccaagggcccatcggtcttcccccnggcgccctgctccaggagcacctccgagagcacagcggccctgggctgcctggtcaaggactactccatctacactactgagcgggctggcaaggcgcatagnnnnnn

SEQ ID NO: 294392 - DNA, 470 bp, Homo sapiens
  misc_feature: GYAE6OF01AV589.37.77.G11.1.454.CMB.1.raw
  modified_base (443)..(443): a, c, t, g, unknown or other
  misc_feature (443)..(443): n is a, c, g, or t
  modified_base (449)..(450): a, c, t, g, unknown or other
  misc_feature (449)..(450): n is a, c, g, or t
  modified_base (453)..(470): a, c, t, g, unknown or other
  misc_feature (453)..(470): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcgactggtcctggtactttgacgactggggccagggaaccctggtcaccgtctcctcagcctccaccaagggcccatccggtcttcccccgtggccgcccctgcctccgaggacgccacctccgagacgcacacgccggccctgggctcgcctggtcaacggctacttccatcctacactactgagcgggctggcaaggcncatagnngcnnnnnnnnnnnnnnnnnn

SEQ ID NO: 294393 - DNA, 488 bp, Homo sapiens
  misc_feature: GYAE6OF01A10WC.37.77.G11.1.454.CMB.1.raw
  modified_base (345)..(345): a, c, t, g, unknown or other
  misc_feature (345)..(345): n is a, c, g, or t
  modified_base (456)..(458): a, c, t, g, unknown or other
  misc_feature (456)..(458): n is a, c, g, or t
  modified_base (460)..(488): a, c, t, g, unknown or other
  misc_feature (460)..(488): n is a, c, g, or t
tcagtagtgtagatcacgaccggtgctcgatttagctagtcactcaaggggaaaggggcgtggagtgggtctcagctattaatgggaatggtgataccacatactacgcagactccgtgaagggccggttcaccatctccagggacaattccaagaacacactgtctctgcaaatgaacagcctgagagtcgagggacacggccttatattactgtgtgaacggggacctctagccccctttatagcagcggctggtcctggtactttgacgactggggccagggaaccctggtcaccggtctcctcagccctccaccaagggcccatcggtcttccccctggcncccctgctccaggagcctacctccggagacgcgacacgcggtcctggggcctggccctggtcaaggcctactccgatctacactactgagcgggctggcaaggcgcatagnnncnnnnnnnnnnnnnnnnnnnnnnnnnnnnn

SEQ ID NO: 294394 - DNA, 439 bp, Homo sapiens
  misc_feature: GYAE6OF01D3DB9.37.77.G11.1.454.CMB.1.raw
  modified_base (432)..(439): a, c, t, g, unknown or other
  misc_feature (432)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccaggggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccagggcccatcggtctcccctgcgccctgctccaggcgcacctccgagagcacagcggccctggctgcctggtcaaggactacttccatctacactactgagcgggctggcaaggcgcatagnnnnnnnn

SEQ ID NO: 294395 - DNA, 451 bp, Homo sapiens
  misc_feature: GYAE6OF01CPS3E.37.77.G11.1.454.CMB.1.raw
  modified_base (421)..(421): a, c, t, g, unknown or other
  misc_feature (421)..(421): n is a, c, g, or t
  modified_base (444)..(451): a, c, t, g, unknown or other
  misc_feature (444)..(451): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatccggtccttccccctggccgcccctgcctccaggacgccacctccgagacgcacagccggccctgggctgcctggtcaaggctacttccattcacactacngagcgggctggcaggcgcatagnnnnnnnn

SEQ ID NO: 294396 - DNA, 458 bp, Homo sapiens
  misc_feature: GYAE6OF01C9NSA.37.77.G11.1.454.CMB.1.raw
  modified_base (428)..(428): a, c, t, g, unknown or other
  misc_feature (428)..(428): n is a, c, g, or t
  modified_base (434)..(458): a, c, t, g, unknown or other
  misc_feature (434)..(458): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggccagggacctggtcaccgtctcctcagcctccaccaagggcccatcgtctccctgcgccctgctcaggacgcacctcgagacgcacgacgccggcctgggctcgcccgtggtccaaggctacttccatcctacactactgagcgggctggcaaggcnagtagnnnnnnnnnnnnnnnnnnnnnnnnn

SEQ ID NO: 294397 - DNA, 508 bp, Homo sapiens
  misc_feature: GYAE6OF01EBA69.37.77.G11.1.454.CMB.1.raw
  modified_base (497)..(508): a, c, t, g, unknown or other
  misc_feature (497)..(508): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccagaacacactgtctctgcaaatgacagcctgagagtcgaggacacggccttatattactgtgtgaagggacctctagccccttatagcagcggctggtcctggtactttgacgactggggccagggaaccctggtcaccgtctcctcagccctccaccgaacgggccccagtccggtcccttccccccgtcgggccgcccctggtcctacccgcaacggggtcgcaaccccgtcccggaagacgccaaccagggccggccccgtggggcctgcccgttgggtcaacgggacttaccgttcccattcctacgacttaccgtgaggcgggactggcaagggcgcatagnnnnnnnnnnnn

SEQ ID NO: 294398 - DNA, 449 bp, Homo sapiens
  misc_feature: GYAE6OF01A3M3R.37.77.G11.1.454.CMB.1.raw
  modified_base (439)..(449): a, c, t, g, unknown or other
  misc_feature (439)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgcctccaggcgcacctccgagcgcacagccggccctgggcctgcctggtcaaggactactccatctacactactgacgcgggctggcaaggcgcagtagnnnnnnnnnnn

SEQ ID NO: 294399 - DNA, 443 bp, Homo sapiens
  misc_feature: GYAE6OF01ALKY5.37.77.G11.1.454.CMB.1.raw
  modified_base (332)..(332): a, c, t, g, unknown or other
  misc_feature (332)..(332): n is a, c, g, or t
  modified_base (432)..(432): a, c, t, g, unknown or other
  misc_feature (432)..(432): n is a, c, g, or t
  modified_base (435)..(435): a, c, t, g, unknown or other
  misc_feature (435)..(435): n is a, c, g, or t
  modified_base (438)..(443): a, c, t, g, unknown or other
  misc_feature (438)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagccctccaccaaggcccatccggtcttccccnggccgccctcgctccaggacgccacctccgagagcacagcggcctgggctgcctggtcaggactacttccatctacactactgagcgggctggcaaggcncanagnnnnnn

SEQ ID NO: 294400 - DNA, 445 bp, Homo sapiens
  misc_feature: GYAE6OF01B7SOT.37.77.G11.1.454.CMB.1.raw
  modified_base (439)..(445): a, c, t, g, unknown or other
  misc_feature (439)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggcgcccctgcctccaggagcacctccgagagcacagcggccctgggctgcctggtcaaggactacttccatcctacactactgagcgggctggcaaggcgcatgnnnnnnn

SEQ ID NO: 294401 - DNA, 583 bp, Homo sapiens
  misc_feature: GYAE6OF01DF7NT.37.77.G11.1.454.CMB.1.raw
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (546)..(546): a, c, t, g, unknown or other
  misc_feature (546)..(546): n is a, c, g, or t
  modified_base (556)..(556): a, c, t, g, unknown or other
  misc_feature (556)..(556): n is a, c, g, or t
tcagtagtgtagatcacgaccggtgctcgatttagctagtcactcaagggaaaggggctggagtgggtctcagcttattaatgggaatggtgataccacatactacgcagacgtccgtgaagggccggttcaccatcgtccagggacaattccaagaacgacactgtctctgacaaatgaacagcctgagagtcgagacacggcttatatactgtgtagacgggacctctagcccttatagcagcggctggtacctggtactttgacgacttcggggcctagggaacccttggtacaccgtctacctcgacgcctccaccgaacgggccccaagtccggtccttccccgtggccgtcccgttgccgtccaaggacgcctaaccgtccgagacgcacgacggcggacccgtggctcggccgtggtacgaaagggtaccttaacttaccgaacttaccttaacgacgtacgtggacggcgggacgtcgggtacaagggtcgtacgtagtagancgngnacgnacgatanatacgngtgtcgacgcganaggagacggnagacgagtacgactcgacactgctgcg

SEQ ID NO: 294402 - DNA, 442 bp, Homo sapiens
  misc_feature: GYAE6OF01A4KDB.37.77.G11.1.454.CMB.1.raw
  modified_base (348)..(348): a, c, t, g, unknown or other
  misc_feature (348)..(348): n is a, c, g, or t
  modified_base (434)..(442): a, c, t, g, unknown or other
  misc_feature (434)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcgccctgctccaggacncacctccgagacgcacagcggccctgggctgcctggtcaaggctacttccatctacactactgagcgggctggcaaggcgcatcgnnnnnnnnn

SEQ ID NO: 294403 - DNA, 446 bp, Homo sapiens
  misc_feature: GYAE6OF01BV0WL.37.77.G11.1.454.CMB.1.raw
  modified_base (439)..(446): a, c, t, g, unknown or other
  misc_feature (439)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggacgccacctccgagacgcacagcggccctgggctgcctggtcaaggactacttccatctacactactgagcgggctggcaaggcgcatgnnnnnnnn

SEQ ID NO: 294404 - DNA, 433 bp, Homo sapiens
  misc_feature: GYAE6OF01ELZUI.37.77.G11.1.454.CMB.1.raw
  modified_base (430)..(433): a, c, t, g, unknown or other
  misc_feature (430)..(433): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccgtatattactgtgcgaaggaagggtctagcagtgcctggtactcccactactatatggacgtctggggcaaaggaatcgcggtcaccgtctcctcagcctccaccaagggcccatcggtctcccctggcaccctcctccaagagcacctctggggcacagcggccctgggctgcctggtcaaggactacttccatctacactactgagcgggctggcaaggcgcatagnnnn

SEQ ID NO: 294405 - DNA, 473 bp, Homo sapiens
  misc_feature: GYAE6OF01EI3J7.37.77.G11.1.454.CMB.1.raw
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (353)..(353): a, c, t, g, unknown or other
  misc_feature (353)..(353): n is a, c, g, or t
  modified_base (419)..(419): a, c, t, g, unknown or other
  misc_feature (419)..(419): n is a, c, g, or t
  modified_base (448)..(473): a, c, t, g, unknown or other
  misc_feature (448)..(473): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagccagcggctggtcctggtactttgacgactggggccagggaaccctggtcaccgtctcctcagccctccaccagggcccagtcggtccttccccnggccnccctgctccaggcncacctcgagcgcacagccggccctgggctgcctggtcaaggacttacttccattctacacttacgngagcgggctggactaaggccgacagtagnnnnnnnnnnnnnnnnnnnnnnnnnn

SEQ ID NO: 294406 - DNA, 749 bp, Homo sapiens
  misc_feature: GYAE6OF01ERQNA.37.77.G11.1.454.CMB.1.raw
  modified_base (718)..(749): a, c, t, g, unknown or other
  misc_feature (718)..(749): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacacttcgtctctcgaactaagtacgaaacgacgtccgtagaaggtacggacggaacggaaccggaccggttacctttaattaactttacgtggttggtaagggaaccgggtacccttacgtacccgttacccctttaagacgacgacggccggtcggttcggttccgtacggttttacgttacggaccgtacggggtccgggggaccggaaaccgggtaaccggttcggtaccgtaccggttcctcccgtacgaccgtcccctacccgaaaccggaacccgggccctacggttccggttcccccttccccggcggccccgtcccgtcgtccctaccggacgggccgaccctaaccggtaacggaggaccgaccgaaacgccggggcccccggtcccggggtcgggtccgtcccggtcccggttacgggtaaaccggtaaaccgggttaaccctttaccccggttaacctaacctttaaccccgtaaaccgtaacctttacggggtacggaccgggggtccggtacggtaacgggaacgtaaccgggccgaacttaggacgnnnnnnnnnnnnnnnnnnnnnnnnnnnnnnnn

SEQ ID NO: 294407 - DNA, 449 bp, Homo sapiens
  misc_feature: GYAE6OF01B20C3.37.77.G11.1.454.CMB.1.raw
  modified_base (338)..(338): a, c, t, g, unknown or other
  misc_feature (338)..(338): n is a, c, g, or t
  modified_base (433)..(433): a, c, t, g, unknown or other
  misc_feature (433)..(433): n is a, c, g, or t
  modified_base (440)..(449): a, c, t, g, unknown or other
  misc_feature (440)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccnccctgcctccaggagcacctccgagacgcacagcggccctgggctgcctggtcaaggctacttccatctacactactgagcgggctggcaaggcncgatagnnnnnnnnnn

SEQ ID NO: 294408 - DNA, 458 bp, Homo sapiens
  misc_feature: GYAE6OF01BSJVL.37.77.G11.1.454.CMB.1.raw
  modified_base (443)..(443): a, c, t, g, unknown or other
  misc_feature (443)..(443): n is a, c, g, or t
  modified_base (449)..(458): a, c, t, g, unknown or other
  misc_feature (449)..(458): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatccggtccttcccccgtggccgccctcgcctccgaggacgcacctccgagacgcacacgccggccctgggctgcctggtcaaggactacttccattctacactactgagcgggctggcaaggcncatagnnnnnnnnnn

SEQ ID NO: 294409 - DNA, 461 bp, Homo sapiens
  misc_feature: GYAE6OF01CXMXV.37.77.G11.1.454.CMB.1.raw
  modified_base (442)..(461): a, c, t, g, unknown or other
  misc_feature (442)..(461): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgcctccaggacgcacctccgagacgcacagccggcctgggctgccgtggtcaaggactactcatctacactactgacgtcgggctgggcaaggcgacatacgnnnnnnnnnnnnnnnnnnnn

SEQ ID NO: 294410 - DNA, 440 bp, Homo sapiens
  misc_feature: GYAE6OF01CG0RY.37.77.G11.1.454.CMB.1.raw
  modified_base (349)..(349): a, c, t, g, unknown or other
  misc_feature (349)..(349): n is a, c, g, or t
  modified_base (434)..(440): a, c, t, g, unknown or other
  misc_feature (434)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggnccacctccgagagcacagcggccctgggctgcctggtcaaggctacttcatctacactactgagcgggctggcaaggcgcatagnnnnnnn

SEQ ID NO: 294411 - DNA, 443 bp, Homo sapiens
  misc_feature: GYAE6OF01BE2TX.37.77.G11.1.454.CMB.1.raw
  modified_base (433)..(443): a, c, t, g, unknown or other
  misc_feature (433)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcgccctgctccaggagcacctccgagagcacagcggccctgggctgcctggtcaaggctacttccatctacactactgagcgggctggcaaggcgcatagnnnnnnnnnnn

SEQ ID NO: 294412 - DNA, 459 bp, Homo sapiens
  misc_feature: GYAE6OF01AJQT0.37.77.G11.1.454.CMB.1.raw
  modified_base (443)..(443): a, c, t, g, unknown or other
  misc_feature (443)..(443): n is a, c, g, or t
  modified_base (446)..(459): a, c, t, g, unknown or other
  misc_feature (446)..(459): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttccccctggccgcccctgctccaggagccacctccgagagcacagcggccctggggctcgcctggtcaaggactacttccatcctacactaccctgacgcgggctggcaggcgcanagnnnnnnnnnnnnnn

SEQ ID NO: 294413 - DNA, 521 bp, Homo sapiens
  misc_feature: GYAE6OF01A6U6B.37.77.G11.1.454.CMB.1.raw
  modified_base (488)..(488): a, c, t, g, unknown or other
  misc_feature (488)..(488): n is a, c, g, or t
  modified_base (492)..(521): a, c, t, g, unknown or other
  misc_feature (492)..(521): n is a, c, g, or t
tcagtagtgtagatcacgaccggtgctcgatttagctagtcactcaagggaaagggggctggagtggggtctcagctattaatgggaatggtgataccacatactacgcagactccgtgaagggccggttcacccactctcccagggacaattccaaggaacacgacctgtctctgcaaatgaacagcctgagagtcgaggacacggccttagtattactgtgtgaagggacctctagccccttatagcagcggctggtcctggtacttttgacgaactggggccagggaaccctggtcaccgtactcctcagcctccaccaacgggcccactaccggtcctttccccctggccgcccctgtacctcccgacggacgctaccgtccgacgagtccaccgacgccggccctcgggactcgcccgtggtccaacgggactaccgtctactctacgactactggacgcgggctggcaaggcgacctatagngcgnnnnnnnnnnnnnnnnnnnnnnnnnnnnnn

SEQ ID NO: 294414 - DNA, 484 bp, Homo sapiens
  misc_feature: GYAE6OF01CUVNM.37.77.G11.1.454.CMB.1.raw
  modified_base (452)..(452): a, c, t, g, unknown or other
  misc_feature (452)..(452): n is a, c, g, or t
  modified_base (457)..(484): a, c, t, g, unknown or other
  misc_feature (457)..(484): n is a, c, g, or t
tcagtagtgtagatcacgaccggtgctcgatttagctagtcactcaaggggtaaagggggcgtggagtgggtctcagctattaatgggaatggtgataccacatactacgcagacctccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctggcctccgagggacgccacctcgagagtcacgagcggccctgggcctggcctggtcaagggactacgttccatcctacactactgacgcgggctgggacaaggcgnatagnnnnnnnnnnnnnnnnnnnnnnnnnnnn

SEQ ID NO: 294415 - DNA, 441 bp, Homo sapiens
  misc_feature: GYAE6OF01CHEXT.37.77.G11.1.454.CMB.1.raw
  modified_base (426)..(426): a, c, t, g, unknown or other
  misc_feature (426)..(426): n is a, c, g, or t
  modified_base (432)..(441): a, c, t, g, unknown or other
  misc_feature (432)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctggcgccctgctccaggagcacctcgagagcacagcggccctgggctgcctggtcaaggactacttccatctacactactgagcggctggcaaggcncatagnnnnnnnnnn

SEQ ID NO: 294416 - DNA, 587 bp, Homo sapiens
  misc_feature: GYAE6OF01CCGXC.37.77.G11.1.454.CMB.1.raw
  modified_base (558)..(587): a, c, t, g, unknown or other
  misc_feature (558)..(587): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacaacctgagagccgaggacacggccctatattactgtacgaaaatggcctacggatatgactactattgggactggtacttcgatctcgtggggccgtggcaccctggtcactgtctcctcacgccctaccaccgaacgggccccagtccggtccctttccccccgtgggcccgcccccttggccttccgagggacgccaaccctccggaagacggccaacgacggccgggccccttgggggccctttcggcccctttggggttacccaaaacggggtacccttaaccgtttccccaactttccctaaccaaccttaaccgttgggaaacggcccggggggtacttcggggaccgtaaaacggggccgacgaacgttaaggnnnnnnnnnnnnnnnnnnnnnnnnnnnnnn

SEQ ID NO: 294417 - DNA, 442 bp, Homo sapiens
  misc_feature: GYAE6OF01CBE1V.37.77.G11.1.454.CMB.1.raw
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtccttcccctggccgccctgctccaggacgcacctccgagagcacagcggcctgggctgcctggtcaaggactacttccatctacactactgagcgggctggcaaggcgcatagnnnnnnn

SEQ ID NO: 294418 - DNA, 583 bp, Homo sapiens
  misc_feature: GYAE6OF01DKTP6.37.77.G11.1.454.CMB.1.raw
  modified_base (557)..(583): a, c, t, g, unknown or other
  misc_feature (557)..(583): n is a, c, g, or t
tcagtagtgtagatcacgaccggtgctcgatttagctagtcactcaagggaaaggggctggagtgggtctcagctattaatgggaatggtgataccacatactacgcagactccgtgaagggtccggttcaccatctcagggacaattccaagaacacactgtctctgacaaatgaacagcctgagagtcgagacacggtcttatattactgtgtagaaggcctctacgcccttatagcagcggcgtcggtccttggttactttgacgacggtcggggaccgaacgggaacccgtggtcaccgttcctcctcacgccctaccgaaccgaacgggcccacgttccggtcccttccccgtcggccgtcccgtgacctccgaaggccgaccgacccgtaccggaaggacgaccgaacgacggtcccgggcccggtcgggtccgtcgccgttacggtaacgtaaaccggtaacctttacctccctaatttaccctaaccctacgttaaccgtagggtaccggtccggggtcgtagggaccaacggggccacgaagtaggcnnnnnnnnnnnnnnnnnnnnnnnnnnn

SEQ ID NO: 294419 - DNA, 445 bp, Homo sapiens
  misc_feature: GYAE6OF01AUWM4.37.77.G11.1.454.CMB.1.raw
  modified_base (436)..(445): a, c, t, g, unknown or other
  misc_feature (436)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgcccctgctccaggagcacctccgagagcacagcggccctgggctgcctggtcaaggctactccatctacactactgagcgggctggcaaggcgacatagnnnnnnnnnn

SEQ ID NO: 294420 - DNA, 439 bp, Homo sapiens
  misc_feature: GYAE6OF01B5409.37.77.G11.1.454.CMB.1.raw
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctggctgcctggtcaaggactacttccatctacactactgagcgggctggcaggcgcatagnnnnnn

SEQ ID NO: 294421 - DNA, 451 bp, Homo sapiens
  misc_feature: GYAE6OF01AYNUP.37.77.G11.1.454.CMB.1.raw
  modified_base (441)..(441): a, c, t, g, unknown or other
  misc_feature (441)..(441): n is a, c, g, or t
  modified_base (443)..(443): a, c, t, g, unknown or other
  misc_feature (443)..(443): n is a, c, g, or t
  modified_base (446)..(451): a, c, t, g, unknown or other
  misc_feature (446)..(451): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatcggtccttccccctggccgccctgcctccaggagccacctccgagacgcacacgccggccctgggctcgcctggtccaaggactacgttccatctacactactgagcgggctggcaaggcnanagnnnnnn

SEQ ID NO: 294422 - DNA, 482 bp, Homo sapiens
  misc_feature: GYAE6OF01CKT93.37.77.G11.1.454.CMB.1.raw
  modified_base (226)..(226): a, c, t, g, unknown or other
  misc_feature (226)..(226): n is a, c, g, or t
  modified_base (470)..(482): a, c, t, g, unknown or other
  misc_feature (470)..(482): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctntagccccttatagcagcggctggtcctggtactttgacgacgtggggccagggaaccctggtcaccgtctcctcagcctccaccgaacgggcccatccggtccttccccgtggcccgcccctcgccccgaggacgcccaccgtccggagacgccacgacgccggcccgtgggcctcgccgtggtacaaggtactaccttccactctaacacttactggacgcgggctggcaacggcgacatagnnnnnnnnnnnnn

SEQ ID NO: 294423 - DNA, 460 bp, Homo sapiens
  misc_feature: GYAE6OF01C7QGM.37.77.G11.1.454.CMB.1.raw
  modified_base (333)..(333): a, c, t, g, unknown or other
  misc_feature (333)..(333): n is a, c, g, or t
  modified_base (337)..(337): a, c, t, g, unknown or other
  misc_feature (337)..(337): n is a, c, g, or t
  modified_base (342)..(342): a, c, t, g, unknown or other
  misc_feature (342)..(342): n is a, c, g, or t
  modified_base (378)..(378): a, c, t, g, unknown or other
  misc_feature (378)..(378): n is a, c, g, or t
  modified_base (431)..(431): a, c, t, g, unknown or other
  misc_feature (431)..(431): n is a, c, g, or t
  modified_base (443)..(443): a, c, t, g, unknown or other
  misc_feature (443)..(443): n is a, c, g, or t
  modified_base (446)..(460): a, c, t, g, unknown or other
  misc_feature (446)..(460): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctaagccccttatagcagcggctggtcctggtactttgacgactggggccagggaaccctggtcaccgtctcctcagcctccaccaaggcccatcggtccttccccgngccncctcncacgaggcactaccacgagacacacgcgccgccggngtcgcgcgtcgtacgaagtaccttacctcatacaacactacgtgaggccgcgngacgaggccaanagnnnnnnnnnnnnnnn

SEQ ID NO: 294424 - DNA, 452 bp, Homo sapiens
  misc_feature: GYAE6OF01AUTMO.37.77.G11.1.454.CMB.1.raw
  modified_base (438)..(452): a, c, t, g, unknown or other
  misc_feature (438)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaaggggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctggggctgcctggtcaagggactacttccatctacactactgagcgggctggcaaggcgcatagnnnnnnnnnnnnnnn

SEQ ID NO: 294425 - DNA, 449 bp, Homo sapiens
  misc_feature: GYAE6OF01B4H2M.37.77.G11.1.454.CMB.1.raw
  modified_base (437)..(437): a, c, t, g, unknown or other
  misc_feature (437)..(437): n is a, c, g, or t
  modified_base (443)..(449): a, c, t, g, unknown or other
  misc_feature (443)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttccccctggccgccctgcctccaggcgcacctccgagagcacagccggccctggctgcctggtcaaggactacttccatctacactactggacgcgggctggcaagggcncatagnnnnnnn

SEQ ID NO: 294426 - DNA, 454 bp, Homo sapiens
  misc_feature: GYAE6OF01C055P.37.77.G11.1.454.CMB.1.raw
  modified_base (361)..(361): a, c, t, g, unknown or other
  misc_feature (361)..(361): n is a, c, g, or t
  modified_base (384)..(384): a, c, t, g, unknown or other
  misc_feature (384)..(384): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
  modified_base (447)..(454): a, c, t, g, unknown or other
  misc_feature (447)..(454): n is a, c, g, or t
tcagtagtgtagatcacgaccggtgctcgatttagctagtcactcaaggggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtctggtactttgacgactggggccagggaaccctggtcaccgtctcctcacgcctccaccaacgggccccatccggtccttccccgtggccgcccctgcctccagggcncacctcgagacgcacagccgccngggctgcctggtcaaggtactactccatcctacncttacngagcggntcggcaggcgnatagnnnnnnnn

SEQ ID NO: 294427 - DNA, 557 bp, Homo sapiens
  misc_feature: GYAE6OF01BTIR0.37.77.G11.1.454.CMB.1.raw
  modified_base (210)..(210): a, c, t, g, unknown or other
  misc_feature (210)..(210): n is a, c, g, or t
  modified_base (345)..(345): a, c, t, g, unknown or other
  misc_feature (345)..(345): n is a, c, g, or t
  modified_base (525)..(525): a, c, t, g, unknown or other
  misc_feature (525)..(525): n is a, c, g, or t
  modified_base (527)..(557): a, c, t, g, unknown or other
  misc_feature (527)..(557): n is a, c, g, or t
tcagtagtgtagatcacgaccggtgctcgatttagctagtcactcaagggaaaggggctggagtgggtctcaggtattggtggcagtggtgagaccacatactacgcagactccgtgaagggccggttcaccatctccagagacaattccaagaacaccctgtctctgcaaatgaacaacctgagagccgaggacacggcctatattacngtaacgaaaatggcctacggatatgactactattgggactggtacttcgatctcgtggggccgtggccacccgtggtcactgtctcctcagcctaccaccgaacgggcccagtccggtccttcccccgtggcccnccctgcctccgaggacgccaccgtcccgagacgccacgacggccggacccctgggggacctcggtcccgttaggtaccgaaaacgggtaccttaaccctttacccgaacttcctaaccgaccttaacgtcggaacggtccggggtcctagggacctaaaggggccgaccgaagttacggncnnnnnnnnnnnnnnnnnnnnnnnnnnnnnnn

SEQ ID NO: 294428 - DNA, 454 bp, Homo sapiens
  misc_feature: GYAE6OF01EISEF.37.77.G11.1.454.CMB.1.raw
  modified_base (445)..(454): a, c, t, g, unknown or other
  misc_feature (445)..(454): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactggggccagggaaccctggtcaccgtctcctcagcctccaccaagggcccatcggtcttccccctggccgcccctgctcccaggacgcacctccgagacgcacagcggccctgggctgcctggtcaaggactacttccatctacactactgacgcgggctggcaaggcgcagtagcnnnnnnnnnn

SEQ ID NO: 294429 - DNA, 447 bp, Homo sapiens
  misc_feature: GYAE6OF01ASI1C.37.77.G11.1.454.CMB.1.raw
  modified_base (438)..(447): a, c, t, g, unknown or other
  misc_feature (438)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggcgcccctgctccaggagcacctccgagagcacagcggccctgggctgcctggtcaaggactacttccatctacactactgagcgggctggcaaggcgcatagnnnnnnnnnn

SEQ ID NO: 294430 - DNA, 451 bp, Homo sapiens
  misc_feature: GYAE6OF01A70XN.37.77.G11.1.454.CMB.1.raw
  modified_base (432)..(432): a, c, t, g, unknown or other
  misc_feature (432)..(432): n is a, c, g, or t
  modified_base (439)..(451): a, c, t, g, unknown or other
  misc_feature (439)..(451): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatccggtcttccccctggccacccctcctccaagacgcacctcgtgggacacgacgcggccctgggctgcctggcaaggactctcatctacactactgagcggctggcaaggcncgatagnnnnnnnnnnnnn

SEQ ID NO: 294431 - DNA, 552 bp, Homo sapiens
  misc_feature: GYAE6OF01D3LYM.37.77.G11.1.454.CMB.1.raw
  modified_base (520)..(520): a, c, t, g, unknown or other
  misc_feature (520)..(520): n is a, c, g, or t
  modified_base (523)..(552): a, c, t, g, unknown or other
  misc_feature (523)..(552): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacaacctgagagccgaggacacggccctatattactagtaagaaaatggcctaggatatgactactagttggactggtacttcgatcgtcgtggggccgtggccacccgtggtcactgtcctcctcacgccctccaccaacgggcccacgtccggtcccttcccccgtggccgtcccgtgcctccgaggacgccaccgtccgagacgccaacgacgcccggcccgtcgggcctcggcccgttaggaccgtaaacgggaccttacgttaccctacgttcctaacctactaacgtggtaacggccggggtacgtacgggacgaaacgggtccgaacgtagttacggncgnnnnnnnnnnnnnnnnnnnnnnnnnnnnnn

SEQ ID NO: 294432 - DNA, 456 bp, Homo sapiens
  misc_feature: GYAE6OF01CL0BE.37.77.G11.1.454.CMB.1.raw
  modified_base (430)..(456): a, c, t, g, unknown or other
  misc_feature (430)..(456): n is a, c, g, or t
tcagtagtgtagatcacgaccggtgctcgatttagctagtcactcaaggggaaaggggctggagtgggtctcagctattaatgggaatggtgataccaccatactacgcagactccgtgaagggccggttcaccatctcccaggggacaattccaagaacacactgtctctgcaaatgaacagcctgagagtcgaggacacggccttatattactgtgtgaaaggctggggatggggggactacgtggggccaggggaaccctggtcaccggtctcctcagcctccaccaagggcccagtccggtccttcccccgtggccaccccttcctaccaagacgccacctcgtcgggggcacaggccggcctgggctcggcctggtcaaggtctacgttccatcctacactactgagcggctggcaggcgcatgnnnnnnnnnnnnnnnnnnnnnnnnnnn

SEQ ID NO: 294433 - DNA, 439 bp, Homo sapiens
  misc_feature: GYAE6OF01EZBXU.37.77.G11.1.454.CMB.1.raw
  modified_base (431)..(439): a, c, t, g, unknown or other
  misc_feature (431)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccagggcccatcggtcttcccctggccgccctgctccaggacgcacctccgagagcacagcggccctggctgcctggtcaaggctacttccatcacactactgagcggctggcaggcgcatagnnnnnnnnn

SEQ ID NO: 294434 - DNA, 470 bp, Homo sapiens
  misc_feature: GYAE6OF01CY9Z1.37.77.G11.1.454.CMB.1.raw
  modified_base (435)..(435): a, c, t, g, unknown or other
  misc_feature (435)..(435): n is a, c, g, or t
  modified_base (441)..(470): a, c, t, g, unknown or other
  misc_feature (441)..(470): n is a, c, g, or t
tcagtagtgtagatcacgaccggtgctcgatttagctagtcactcaaggggaaaggggctggagtgggtctcgtctattagtggaagtggtgcttatacaaaactaacgcagcctccgtgaagggccgcttcaccatctccagagactattccaagagcactctgtatctgcaaatgaacagcctgagtgccgaggacacggccctatacttattgtgcgaaatgtggggggatggggggctacgtcctggcgttttgactactggggccagggagccctggtccaccgtctcctcagcctccaccaaggggccccagtcggtcttccccctggccgccctgctccaggacgccacctccgagacgcacagcggccctgggctgcctggtcaaggctacgttccattctacactactgagcgggctggcaaggcncatagnnnnnnnnnnnnnnnnnnnnnnnnnnnnnn

SEQ ID NO: 294435 - DNA, 547 bp, Homo sapiens
  misc_feature: GYAE6OF01EDSLF.37.77.G11.1.454.CMB.1.raw
  modified_base (525)..(547): a, c, t, g, unknown or other
  misc_feature (525)..(547): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtagaagggacctctacgccccttatagcagcggctggtcctggtactttgacgactggggccagggaaccctggtcaccgtctcctcacgcctccaccgaacgggcccacgtccggtccttcccccgtgggcccgccctcggcctccgaggacgccaccctaccggagacgacacgacggcccggcccgtcggggctcgcccgttggtaccgaaacgggtaccttacctaccctattccccttaacgacctttaaccgtgggaacggccgggggtcttacgggaccaaacggggtccaccgtaagtacggnnnnnnnnnnnnnnnnnnnnnnn

SEQ ID NO: 294436 - DNA, 450 bp, Homo sapiens
  misc_feature: GYAE6OF01DZVG6.37.77.G11.1.454.CMB.1.raw
  modified_base (445)..(450): a, c, t, g, unknown or other
  misc_feature (445)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgaccccgagtcgaggacacggccttatattactgtgtgaagggacctctagccccttatagcagcggctggtcctggtactttgacgactggggccagggaaccctggtcaccgtctcctcagcctccaccaacgggcccatcggtccttcccccgtcggccgccctcgctccaggagcacctccgagacgcacacgcggccctgggctgcctggtcaaggactactccatctacactactgagcggctggcaaggcgcatgnnnnnn

SEQ ID NO: 294437 - DNA, 494 bp, Homo sapiens
  misc_feature: GYAE6OF01BY2YX.37.77.G11.1.454.CMB.1.raw
  modified_base (453)..(453): a, c, t, g, unknown or other
  misc_feature (453)..(453): n is a, c, g, or t
  modified_base (473)..(494): a, c, t, g, unknown or other
  misc_feature (473)..(494): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctgggtcaccgtctcctcagccctccaccgaagggcccatccggtccttccccctgggccgcccctgcctccgaggacgccacctccgagacgccacgagccggcccgtggggctcggcccgttggtaccgaaacgggacttacttccattcctacactactgagccgggntgggacaagggcgcagtagnnnnnnnnnnnnnnnnnnnnnn

SEQ ID NO: 294438 - DNA, 440 bp, Homo sapiens
  misc_feature: GYAE6OF01ATNY9.37.77.G11.1.454.CMB.1.raw
  modified_base (428)..(428): a, c, t, g, unknown or other
  misc_feature (428)..(428): n is a, c, g, or t
  modified_base (434)..(440): a, c, t, g, unknown or other
  misc_feature (434)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggacgcacctccgagagcacagcggccctgggctgcctggtcaaggctacttccatctacactactgagcggctggcaaggcncatagnnnnnnn

SEQ ID NO: 294439 - DNA, 468 bp, Homo sapiens
  misc_feature: GYAE6OF01CT2GH.37.77.G11.1.454.CMB.1.raw
  modified_base (459)..(468): a, c, t, g, unknown or other
  misc_feature (459)..(468): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgactggggccagggaaccctggtcaccgtctcctcacgcctccaccaagggcccatccggtccttccccctggccgcccctgcctccgaggacgcacctccgagacgcacagccggccctgggcctcgcctggtacaacggacctacttaccactcctacactacgtgaggcgggctggcgaaggcgacatagnnnnnnnnnn

SEQ ID NO: 294440 - DNA, 476 bp, Homo sapiens
  misc_feature: GYAE6OF01EPDG6.37.77.G11.1.454.CMB.1.raw
  modified_base (293)..(293): a, c, t, g, unknown or other
  misc_feature (293)..(293): n is a, c, g, or t
  modified_base (348)..(348): a, c, t, g, unknown or other
  misc_feature (348)..(348): n is a, c, g, or t
  modified_base (461)..(476): a, c, t, g, unknown or other
  misc_feature (461)..(476): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctagccccttatagcagcggctggtcctggtactttgacgactggggcagggaccctggtcaccgtcncctcagcctccaccagggcccatccggtcttccccctggccgcctgctccaggcnccacctccgagagcacgacgccggcccgtgggctcgtccgtggtacaagggaccttacttcccacttcctacactacgtcgacggcgggctcgggacgaacgggcgcagtagnnnnnnnnnnnnnnnn

SEQ ID NO: 294441 - DNA, 443 bp, Homo sapiens
  misc_feature: GYAE6OF01D6P6C.37.77.G11.1.454.CMB.1.raw
  modified_base (431)..(431): a, c, t, g, unknown or other
  misc_feature (431)..(431): n is a, c, g, or t
  modified_base (437)..(443): a, c, t, g, unknown or other
  misc_feature (437)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggccgccctgctccaggagcacctccgagagcacagcggccctgggctgcctggtcaaggactacttccatcctacactactgagcgggctggcaaggcncatagnnnnnnn

SEQ ID NO: 294442 - DNA, 458 bp, Homo sapiens
  misc_feature: GYAE6OF01AE83Z.37.77.G11.1.454.CMB.1.raw
  modified_base (448)..(458): a, c, t, g, unknown or other
  misc_feature (448)..(458): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaccctgggtcaccgtctcctcagcctccaccaagggcccatccggtccttcccccgtggccacccctcctccaagacgccacctcctgggggcacagccggcccgtgggctcgcctggtcaaggacctacttccatcctacactactgagcgggctggcaggcgcatagnnnnnnnnnnn

SEQ ID NO: 294443 - DNA, 605 bp, Homo sapiens
  misc_feature: GYAE6OF01BGT7Z.37.77.G11.1.454.CMB.1.raw
  modified_base (245)..(245): a, c, t, g, unknown or other
  misc_feature (245)..(245): n is a, c, g, or t
  modified_base (373)..(373): a, c, t, g, unknown or other
  misc_feature (373)..(373): n is a, c, g, or t
  modified_base (540)..(540): a, c, t, g, unknown or other
  misc_feature (540)..(540): n is a, c, g, or t
  modified_base (543)..(543): a, c, t, g, unknown or other
  misc_feature (543)..(543): n is a, c, g, or t
  modified_base (547)..(547): a, c, t, g, unknown or other
  misc_feature (547)..(547): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (560)..(560): a, c, t, g, unknown or other
  misc_feature (560)..(560): n is a, c, g, or t
  modified_base (568)..(568): a, c, t, g, unknown or other
  misc_feature (568)..(568): n is a, c, g, or t
  modified_base (570)..(570): a, c, t, g, unknown or other
  misc_feature (570)..(570): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (579)..(579): a, c, t, g, unknown or other
  misc_feature (579)..(579): n is a, c, g, or t
  modified_base (593)..(593): a, c, t, g, unknown or other
  misc_feature (593)..(593): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
  modified_base (602)..(602): a, c, t, g, unknown or other
  misc_feature (602)..(602): n is a, c, g, or t
tcagtagtgtagatcacgaccggtgctcgattttagctagtcactcgaagggaaagggggctgggagtcgggtctcagcgtaattaatggggaattggtgataccacatactacgcagaactccgtgaagggccggttcacccatctcctagggacaattcccaaggtaaccacactgtcttactgcaaatgaacagcctgagagtcgaggacgacggccttatattactgtgtgaagggacctntagtccccttatacgcagcgctcggtcctggttacttttcgaccgtactgggacccagggtaaccctggtccaccgtctccgtcacgcctccacccgaagggcccaagtccggactcccccgtggccnccctgccttccgtagacgtccaccgtccgagacgacaccgaacggccgacccgtgggccctacggtcccgtaggggtaccaaacgggtaccttaaccttcccaattccctaacgaccgtaactaggacggtaccgggctacggccgaaggtccgacgtaacgtacgnacncgcnganacngacgacncgagcatntntgncgntanagtgtcgtagtgtnagagngngngcg

SEQ ID NO: 294444 - DNA, 547 bp, Homo sapiens
  misc_feature: GYAE6OF01C40VP.37.77.G11.1.454.CMB.1.raw
  modified_base (233)..(233): a, c, t, g, unknown or other
  misc_feature (233)..(233): n is a, c, g, or t
  modified_base (516)..(547): a, c, t, g, unknown or other
  misc_feature (516)..(547): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgcgagagatcgagacggatanagcagcagctctgactacgtcggggccaaccggaaccctggtccaccgtctcctcacgccctaccaccgaacgggcccactccggtccttcccccgtggccctacccctccctaccgaacggacgccctaccgtccggtcggggacaaccgacgggcccggcccgtcggggtcctcggcccgttacgggtaccgaaacggtaccttaaccgttacctacttcctaaccacttaacgtggaaccggtccgggtacacggggaccaaacgggccacgtaagtagnnnnnnnnnnnnnnnnnnnnnnnnnnnnnnnn

SEQ ID NO: 294445 - DNA, 482 bp, Homo sapiens
  misc_feature: GYAE6OF01ETC26.37.77.G11.1.454.CMB.1.raw
  modified_base (337)..(337): a, c, t, g, unknown or other
  misc_feature (337)..(337): n is a, c, g, or t
  modified_base (464)..(482): a, c, t, g, unknown or other
  misc_feature (464)..(482): n is a, c, g, or t
tcagtagtgtagatcacgaccggtgctcgattttagctagtcactcaaaggggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctccccagccctccaccaagggcccatcggtcttcccccgnggccgccctgctccaggagccacctccgagacgcacacggccggcccgtgggcctgcccgtgggtaccaaggtaccttacttccatcctaccactactgacgcgggctcggacaacgggcgcatagnnnnnnnnnnnnnnnnnnn

SEQ ID NO: 294446 - DNA, 417 bp, Homo sapiens
  misc_feature: GYAE6OF01A93NT.37.77.G11.1.454.CMB.1.raw
  modified_base (408)..(408): a, c, t, g, unknown or other
  misc_feature (408)..(408): n is a, c, g, or t
  modified_base (414)..(417): a, c, t, g, unknown or other
  misc_feature (414)..(417): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacacgctctatctgcaaatgaacagcctgagagccgaagacacggccgtatattactgtgtgaaaggctgggggatggggggactactggggccaggggaaccctggtcaccgtctcctcagcctccaccaagggcccatcggtcttcccccctggccacccctcctccaagagcacctctgggggcacagcggccctgggctgcctggtcaaggactacttccatctacactactgagcgggctggcaaggcncatagnnnn

SEQ ID NO: 294447 - DNA, 437 bp, Homo sapiens
  misc_feature: GYAE6OF01D0S21.37.77.G11.1.454.CMB.1.raw
  modified_base (336)..(336): a, c, t, g, unknown or other
  misc_feature (336)..(336): n is a, c, g, or t
  modified_base (349)..(349): a, c, t, g, unknown or other
  misc_feature (349)..(349): n is a, c, g, or t
  modified_base (431)..(437): a, c, t, g, unknown or other
  misc_feature (431)..(437): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcnccctgctccaggncacctccgagagcacagcggccctgggctgcctggtcaaggctactcatctacactactgagcggctggcaaggcgcatagnnnnnnn

SEQ ID NO: 294448 - DNA, 453 bp, Homo sapiens
  misc_feature: GYAE6OF01BHPZF.37.77.G11.1.454.CMB.1.raw
  modified_base (442)..(453): a, c, t, g, unknown or other
  misc_feature (442)..(453): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccagggcccatcggtctccccctggcgccctgctccaggagcacctccgagagcacagccggcccgtgggctcgccgtggtcaacggactactccattcctacactactgacgcgggctggcaaggcgcagtagnnnnnnnnnnnn

SEQ ID NO: 294449 - DNA, 452 bp, Homo sapiens
  misc_feature: GYAE6OF01BDVGH.37.77.G11.1.454.CMB.1.raw
  modified_base (345)..(345): a, c, t, g, unknown or other
  misc_feature (345)..(345): n is a, c, g, or t
  modified_base (354)..(354): a, c, t, g, unknown or other
  misc_feature (354)..(354): n is a, c, g, or t
  modified_base (429)..(452): a, c, t, g, unknown or other
  misc_feature (429)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctgccgcctgctccaggngcacctcgngagcacagcggcctggctgcctggtcaaggactactccatcacactactgagcgggctggcaaggcgacatacgnnnnnnnnnnnnnnnnnnnnnnnn

SEQ ID NO: 294450 - DNA, 469 bp, Homo sapiens
  misc_feature: GYAE6OF01DIRDP.37.77.G11.1.454.CMB.1.raw
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
  modified_base (465)..(469): a, c, t, g, unknown or other
  misc_feature (465)..(469): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccacgggaaccctggtcaccgtctcctcacgcctccaccaacgggcccagtccggtccttcccccgtggccgcccctgcctccgaggacgcacctccgagacgcacagccggccctggggcctcggcccgtggtacaaacgggtacttacttcccatcctaacactactgagcgggcnggcaaggcncatagnnnnn

SEQ ID NO: 294451 - DNA, 461 bp, Homo sapiens
  misc_feature: GYAE6OF01DUON3.37.77.G11.1.454.CMB.1.raw
  modified_base (356)..(356): a, c, t, g, unknown or other
  misc_feature (356)..(356): n is a, c, g, or t
  modified_base (444)..(444): a, c, t, g, unknown or other
  misc_feature (444)..(444): n is a, c, g, or t
  modified_base (450)..(461): a, c, t, g, unknown or other
  misc_feature (450)..(461): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatcggtccttcccctggccgcccctgcctccagggacncacctccgagacgcacagcggccctgggctgcctggtcaagggacttacgttccattctacgtactactggacgcgggctggcaggcncatagnnnnnnnnnnnn

SEQ ID NO: 294452 - DNA, 458 bp, Homo sapiens
  misc_feature: GYAE6OF01DE3K8.37.77.G11.1.454.CMB.1.raw
  modified_base (339)..(339): a, c, t, g, unknown or other
  misc_feature (339)..(339): n is a, c, g, or t
  modified_base (443)..(458): a, c, t, g, unknown or other
  misc_feature (443)..(458): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggttactttgacgacgtggggccagggaaccctgggtccaccgtctcctcagccctcaccgaacggcccatcgtctcccctggcnccctgcctccaggcgcacctccgagagcacgagcgcccgtggctcgctggcaaacggctacttccatactacactactgacgcggcgtggcgaagcgacatagnnnnnnnnnnnnnnnn

SEQ ID NO: 294453 - DNA, 467 bp, Homo sapiens
  misc_feature: GYAE6OF01E4IPU.37.77.G11.1.454.CMB.1.raw
  modified_base (457)..(467): a, c, t, g, unknown or other
  misc_feature (457)..(467): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccaggggaaccctggtcaccgtctcctcagcctccaccgaacggcccatccggtcttccccctggccgcccctcgctcccaggacgcacctccgacgacgccacacgccggccctgggctcgcctggtaccaaggtactacttccatacctacactactgacggcgggctggcaggcgcatacgnnnnnnnnnnn

SEQ ID NO: 294454 - DNA, 462 bp, Homo sapiens
  misc_feature: GYAE6OF01AXSIQ.37.77.G11.1.454.CMB.1.raw
  modified_base (452)..(462): a, c, t, g, unknown or other
  misc_feature (452)..(462): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgcccctgcctccaggacgccaccgtccgagacgccacacggccggccctggggcctggccctggtcaaggactacttccatcctacactactgagcgggctggcaaggcgcatagnnnnnnnnnnn

SEQ ID NO: 294455 - DNA, 463 bp, Homo sapiens
  misc_feature: GYAE6OF01EPHW8.37.77.G11.1.454.CMB.1.raw
  modified_base (446)..(446): a, c, t, g, unknown or other
  misc_feature (446)..(446): n is a, c, g, or t
  modified_base (452)..(463): a, c, t, g, unknown or other
  misc_feature (452)..(463): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctcccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctcaaccgagggcccagtccggtccttccccctggccgcccctgcctccaggcgccacctccgagacgcacacgcggccctgggctcgcctggtccaaggacctacttccattcctacactactgacgcgggctggcaaggcncatagnnnnnnnnnnnn

SEQ ID NO: 294456 - DNA, 547 bp, Homo sapiens
  misc_feature: GYAE6OF01A8MRW.37.77.G11.1.454.CMB.1.raw
  modified_base (516)..(547): a, c, t, g, unknown or other
  misc_feature (516)..(547): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaatacggtctatctggaaatgaacagcctgagagccgaggacacggccctctattactgtgcgagagatcagacggagtatagcagcagctctgactacgtggggccacggaaccctggtccaccgtctcctcacgcctccaccacgggcccactccggtccttccccctggccaccccgtcctccaagacgccacctcgtcgggggccacgacgccgggccccgttcggggcctcggccgttacggtccaaacggggtaccttaaccgtttccctacgttaccctaacctaaccgttaaccgtcgggaacgggtccgggggtccgttacggggaccgaaaggggcccgtacaacgttaaggnnnnnnnnnnnnnnnnnnnnnnnnnnnnnnnn

SEQ ID NO: 294457 - DNA, 599 bp, Homo sapiens
  misc_feature: GYAE6OF01C7TG5.37.77.G11.1.454.CMB.1.raw
  modified_base (573)..(599): a, c, t, g, unknown or other
  misc_feature (573)..(599): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaaagaacacactgtctctgacaaatgaacagcctgagagtcgagacacggccttatattactgtgtagaacgggacctctacgtcccttatacgcgagcggcgtcggtccgttggtactttgacggacgtcggggacacgggaacctggtccaccgtctcctcacgccctaccgaccgaacgggccctacgtcccggtcccttcccccggtcggcccgtcccgtgccctccgagggaccgacctacccgtaccggaacgacgacccgaccgaccgggtcccggacccggtggggacccttcgggacccgtttacggggaccgtaaacggtacccttacccgttacccaacttacccgtaacctaccgttacggtacggaccgggtccgggacgtacgggaccgaacgggtcaacgtagagctnnnnnnnnnnnnnnnnnnnnnnnnnnn

SEQ ID NO: 294458 - DNA, 526 bp, Homo sapiens
  misc_feature: GYAE6OF01EMBC5.37.77.G11.1.454.CMB.1.raw
  modified_base (361)..(361): a, c, t, g, unknown or other
  misc_feature (361)..(361): n is a, c, g, or t
  modified_base (503)..(526): a, c, t, g, unknown or other
  misc_feature (503)..(526): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccgaacgggcccactcggtccttcccccgtggccgcccctgcctccgaggacnccacctccggaagacgccaaccacggcccggcccgtggggcctcggccctcggggtaccaaacgggtaaccttaccgtttccaacttcccgtaacaccttaacgtgacggtcggggctgggacaacgggtccgcaagtacgnnnnnnnnnnnnnnnnnnnnnnnn

SEQ ID NO: 294459 - DNA, 452 bp, Homo sapiens
  misc_feature: GYAE6OF01AUSTS.37.77.G11.1.454.CMB.1.raw
  modified_base (440)..(452): a, c, t, g, unknown or other
  misc_feature (440)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtcttccccctggcgccctgctccaggagcacctctgggggcacagcggccctgggctgcctggtcaaggactacttccatctacactactgacgcgggcgtggcaagggcgcagtacgnnnnnnnnnnnnn

SEQ ID NO: 294460 - DNA, 443 bp, Homo sapiens
  misc_feature: GYAE6OF01BY3AO.37.77.G11.1.454.CMB.1.raw
  modified_base (440)..(443): a, c, t, g, unknown or other
  misc_feature (440)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccgcccctgcctccaggagccacctccgagacgcacagccggccctgggctgcctggtcaaggctacttcatctacacactgagcgggctggcaaggcgcatagnnnn

SEQ ID NO: 294461 - DNA, 538 bp, Homo sapiens
  misc_feature: GYAE6OF01B2LOL.37.77.G11.1.454.CMB.1.raw
  modified_base (518)..(538): a, c, t, g, unknown or other
  misc_feature (518)..(538): n is a, c, g, or t
tcagtagtgtagatcacgaccggtgctcgattttagctagtcactcaaggggaaagggctgggagtgggtcttcagctattaactgggaatggtgatacccacatactacgcaagacttccgtgaaagggtccggtttctaccatctcccaggggacaaattcctaacgaacactacgtgtcgtcctgcaaagtgaacagacctagagagtcgaggaccacggccttatattactgtgtgaacgggcctctacgcccttatagcagcgctggtcctggtacttgacgacgtgggccaggacctgtcaccgtctcctcagccctccaccgaacgggccccacgtccggtcccttcccccgtggcccgcccctggcctccgaggacgccaccctccgagacgcacacggccggccctcggggacctcgcccgttggtaccgaagggtaccttaccgtttccaacttcctaaccgacctacgtagacggccgggcgtgggaccgaagggccgacacgtagnnnnnnnnnnnnnnnnnnnnn

SEQ ID NO: 294462 - DNA, 466 bp, Homo sapiens
  misc_feature: GYAE6OF01E09TI.37.77.G11.1.454.CMB.1.raw
  modified_base (451)..(451): a, c, t, g, unknown or other
  misc_feature (451)..(451): n is a, c, g, or t
  modified_base (455)..(466): a, c, t, g, unknown or other
  misc_feature (455)..(466): n is a, c, g, or t
tcagtagtgtagatcacgaccggtgctcgatttagctagtcactcaagggaaaggggctggagtgggtctcagctattaatgggaatggtgataccacatactacgcagactcccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcgagccctccaccgaagggcccatccgggtccttccccctcgggcgcccctggcctccgaggacgccacctccgagcgcacacgcggccctgggctcgcctggtcaaggactaccgttccatcctacactactgacgcgggctggcgaggcnatgnnnnnnnnnnnn

SEQ ID NO: 294463 - DNA, 462 bp, Homo sapiens
  misc_feature: GYAE6OF01D8EBR.37.77.G11.1.454.CMB.1.raw
  modified_base (444)..(462): a, c, t, g, unknown or other
  misc_feature (444)..(462): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctagccccttatagcagcggctggtcctggtactttgacgactggggccagggaaccctggtcaccgtctcctcagcctccaccaagggcccatcggtctccccctggccgcccctgctccaggacgcacctcgacgagcacgagccggccctgggctcgcctggtcaaggactaccttccatcctacactactgagcgggctggcaaggccgcagtagnnnnnnnnnnnnnnnnnnn

SEQ ID NO: 294464 - DNA, 437 bp, Homo sapiens
  misc_feature: GYAE6OF01ANYJD.37.77.G11.1.454.CMB.1.raw
  modified_base (430)..(437): a, c, t, g, unknown or other
  misc_feature (430)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggccatcggtctcccctggcacccctcctccaagacgcacctctggggcacagcggccctggctcgctggtcaaggctacgttccatcctacactactgagcggctggcagcgcatcgnnnnnnnn

SEQ ID NO: 294465 - DNA, 542 bp, Homo sapiens
  misc_feature: GYAE6OF01BI2QF.37.77.G11.1.454.CMB.1.raw
  modified_base (340)..(340): a, c, t, g, unknown or other
  misc_feature (340)..(340): n is a, c, g, or t
  modified_base (514)..(542): a, c, t, g, unknown or other
  misc_feature (514)..(542): n is a, c, g, or t
tcagtagtgtagatcacgaccggtgctcgattttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacgccttatattacgtgtgtagaacgggacctcgtacgtccccttatagcagcgctggtcctgtacttgacgactgggccagggaccctggtcaccgtctcctcagcctaccaccgtaacgggcccagttccggtccttccccgnggccgtccccgttcgccttcccgaggacgtccgtaccgtccgaggacgcccaacgacggtcccgggcccgtggggacctccggccgtcgggttacaaacgggtacttaaccttccgatacccgtaacgacctagtcgaacgggcggtactgggaccaagggtcacgtaatcgannnnnnnnnnnnnnnnnnnnnnnnnnnnn

SEQ ID NO: 294466 - DNA, 450 bp, Homo sapiens
  misc_feature: GYAE6OF01AQ0UX.37.77.G11.1.454.CMB.1.raw
  modified_base (435)..(450): a, c, t, g, unknown or other
  misc_feature (435)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaccctggtcaccgtctcctcagcctccaccaagggcccatccggtcttccccctggccgccctgcctccaggagcacctccgagagcacagcggccctggctgcctggtcaaggctacttccatctacactactgagcggctggcaaggcgcatagnnnnnnnnnnnnnnnn

SEQ ID NO: 294467 - DNA, 452 bp, Homo sapiens
  misc_feature: GYAE6OF01CBJ18.37.77.G11.1.454.CMB.1.raw
  modified_base (355)..(355): a, c, t, g, unknown or other
  misc_feature (355)..(355): n is a, c, g, or t
  modified_base (446)..(452): a, c, t, g, unknown or other
  misc_feature (446)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatcggtcttccccctggccgcccctgcctccaggganccacctccgagacgcacaggccggccctgggctgcctggtcaaggactacttccatctacactactgagcgggctggcaaggcgcatacgnnnnnnn

SEQ ID NO: 294468 - DNA, 439 bp, Homo sapiens
  misc_feature: GYAE6OF01D8G17.37.77.G11.1.454.CMB.1.raw
  modified_base (333)..(333): a, c, t, g, unknown or other
  misc_feature (333)..(333): n is a, c, g, or t
  modified_base (425)..(439): a, c, t, g, unknown or other
  misc_feature (425)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcncctgctccagagcacctcgagacgcacagcggccctggctgcctggcaggactactcatctacactactgagcggctggcaaggcgcatagnnnnnnnnnnnnnnn

SEQ ID NO: 294469 - DNA, 442 bp, Homo sapiens
  misc_feature: GYAE6OF01B9Z34.37.77.G11.1.454.CMB.1.raw
  modified_base (438)..(442): a, c, t, g, unknown or other
  misc_feature (438)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgcccctgctccaggacgcacctccgagagcacagcggccctgggctgcctggtcaaggactacttccatctacactactgagcgggctggcaaggcgcatagnnnnn

SEQ ID NO: 294470 - DNA, 461 bp, Homo sapiens
  misc_feature: GYAE6OF01DHPIW.37.77.G11.1.454.CMB.1.raw
  modified_base (339)..(339): a, c, t, g, unknown or other
  misc_feature (339)..(339): n is a, c, g, or t
  modified_base (448)..(461): a, c, t, g, unknown or other
  misc_feature (448)..(461): n is a, c, g, or t
tcagtagtgtagatcacgaccggtgctcgatttagctagtcactcaagggaaaggggctggagtgggtctcagctattaatgggaatggtgataccacatactacgcagactccgtgaaggggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatcggtccttcccctggccncccctgcctccgaggacgcacctccgagagcacagccggccctgggctcgcctggtacgaaggacctactccatctaacactactgacgcggctggcaaggcgcatcgnnnnnnnnnnnnnn

SEQ ID NO: 294471 - DNA, 599 bp, Homo sapiens
  misc_feature: GYAE6OF01CM8Y1.37.77.G11.1.454.CMB.1.raw
  modified_base (359)..(359): a, c, t, g, unknown or other
  misc_feature (359)..(359): n is a, c, g, or t
  modified_base (517)..(517): a, c, t, g, unknown or other
  misc_feature (517)..(517): n is a, c, g, or t
  modified_base (533)..(533): a, c, t, g, unknown or other
  misc_feature (533)..(533): n is a, c, g, or t
  modified_base (552)..(552): a, c, t, g, unknown or other
  misc_feature (552)..(552): n is a, c, g, or t
  modified_base (589)..(589): a, c, t, g, unknown or other
  misc_feature (589)..(589): n is a, c, g, or t
  modified_base (593)..(593): a, c, t, g, unknown or other
  misc_feature (593)..(593): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggctatattacgtgtggtgaagggacctctagccccttagtagcagccgctggtctggtatttgacgcgtggggccagggaaccctggtccaccgtctcctcacgcctaccgaccaagggcccagtccggtccttcccctggccgccctcgctccgaggacnccacctccgagagcacacgccggcccgtagggcctcgtcccgtaggtaccgaaacgggaccttacttaccaacgttaccctaacctacgtttaaccgtcgggaaggtcccggggtactacgggaacccgtaaaggggcccggtaccaaggttaccggngactcgacgcgctcgngtctcgtcgtagtgtacgngctacgcgacgacgacgcgtcgacgacgcgtcgacgngcgngtcgcg

SEQ ID NO: 294472 - DNA, 465 bp, Homo sapiens
  misc_feature: GYAE6OF01EKA78.37.77.G11.1.454.CMB.1.raw
  modified_base (339)..(339): a, c, t, g, unknown or other
  misc_feature (339)..(339): n is a, c, g, or t
  modified_base (448)..(465): a, c, t, g, unknown or other
  misc_feature (448)..(465): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccgaagggcccatccggtccttcccctggccnccctgctccaggacgcacctcgagagcacgacgcggccctgggctcgccgtggtcaaggactacttccatcctacactacgtgacgcggctggacaaggcacgtatagnnnnnnnnnnnnnnnnnn

SEQ ID NO: 294473 - DNA, 517 bp, Homo sapiens
  misc_feature: GYAE6OF01CV5BI.37.77.G11.1.454.CMB.1.raw
  modified_base (496)..(517): a, c, t, g, unknown or other
  misc_feature (496)..(517): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggcaggaacctggtcaccgtctcctcagcctaccaccaacgggcccatccggtccttccccgtcggcctaccccgttccacccgaacgtacggaccctaccttccggtcgggggaccacgacggccggcccgtcgggccgtcggcctgggtacgtaaacggtaccttaccttaccgtactcctaactactacgtgacggcgggctcggacgtaaggcgacagtagnnnnnnnnnnnnnnnnnnnnnn

SEQ ID NO: 294474 - DNA, 446 bp, Homo sapiens
  misc_feature: GYAE6OF01BK5TZ.37.77.G11.1.454.CMB.1.raw
  modified_base (434)..(446): a, c, t, g, unknown or other
  misc_feature (434)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctgcgccctgctccaggagcacctccgagagcacagcggccctgggctgcctggtcaaggctacttccatctacactactgagcgggctggcaaggcgcatagnnnnnnnnnnnnn

SEQ ID NO: 294475 - DNA, 446 bp, Homo sapiens
  misc_feature: GYAE6OF01CJ8JV.37.77.G11.1.454.CMB.1.raw
  modified_base (434)..(446): a, c, t, g, unknown or other
  misc_feature (434)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctcccctgcaccctcctccaagagcacctctggggcacagcggccctgggctgcctggtcaaggactactccatctacactactgagcgggctggacaagggcgcatacgnnnnnnnnnnnnn

SEQ ID NO: 294476 - DNA, 455 bp, Homo sapiens
  misc_feature: GYAE6OF01A3K48.37.77.G11.1.454.CMB.1.raw
  modified_base (444)..(444): a, c, t, g, unknown or other
  misc_feature (444)..(444): n is a, c, g, or t
  modified_base (450)..(455): a, c, t, g, unknown or other
  misc_feature (450)..(455): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagccctccaccaacgggcccatccggtccttccccctggccgcccctgcctccaggacgccacctccgagacgcacgagccggccctggggctggcctggtcaaggacctacttccatctacactactgagcggctggcaaggcncatagnnnnnn

SEQ ID NO: 294477 - DNA, 440 bp, Homo sapiens
  misc_feature: GYAE6OF01DOKOO.37.77.G11.1.454.CMB.1.raw
  modified_base (406)..(406): a, c, t, g, unknown or other
  misc_feature (406)..(406): n is a, c, g, or t
  modified_base (435)..(440): a, c, t, g, unknown or other
  misc_feature (435)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagccacctccgagagcacagcggccctgggctgcctggtcaaaggctactccatctacnctactgagcgggctggcaaggcgcatagnnnnnn

SEQ ID NO: 294478 - DNA, 444 bp, Homo sapiens
  misc_feature: GYAE6OF01B02LS.37.77.G11.1.454.CMB.1.raw
  modified_base (335)..(335): a, c, t, g, unknown or other
  misc_feature (335)..(335): n is a, c, g, or t
  modified_base (350)..(350): a, c, t, g, unknown or other
  misc_feature (350)..(350): n is a, c, g, or t
  modified_base (405)..(405): a, c, t, g, unknown or other
  misc_feature (405)..(405): n is a, c, g, or t
  modified_base (433)..(444): a, c, t, g, unknown or other
  misc_feature (433)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactggggccagggaaccctggtcaccgtctcctcagcctccaccaaggcccatcggtcttcccctggcnccctgctccaggacncacctcgagagcacagcggccctgggctgcctggtcaaggctacttccatctacnctactgagcggctggcaaggcgcatagnnnnnnnnnnnn

SEQ ID NO: 294479 - DNA, 506 bp, Homo sapiens
  misc_feature: GYAE6OF01DVXA9.37.77.G11.1.454.CMB.1.raw
  modified_base (336)..(336): a, c, t, g, unknown or other
  misc_feature (336)..(336): n is a, c, g, or t
  modified_base (348)..(348): a, c, t, g, unknown or other
  misc_feature (348)..(348): n is a, c, g, or t
  modified_base (492)..(506): a, c, t, g, unknown or other
  misc_feature (492)..(506): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaagggcccatccggtcccttccccgnggccgccccgtncctcccgaggacgccacctccgagacgcacgacgccggcccgtggggcctcggcccttcgggtacctaaacgggaaccttaccgttaccactccttaaccaacttaccgtggacggcgggtctcgggcgaacggccgacatagnnnnnnnnnnnnnnn

SEQ ID NO: 294480 - DNA, 510 bp, Homo sapiens
  misc_feature: GYAE6OF01CGL5J.37.77.G11.1.454.CMB.1.raw
  modified_base (368)..(368): a, c, t, g, unknown or other
  misc_feature (368)..(368): n is a, c, g, or t
  modified_base (494)..(510): a, c, t, g, unknown or other
  misc_feature (494)..(510): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctacgcccttatagcagcggctggtcctggtatttgacgactggggccagggaacctggtcaccgtctcctcacgtccctcccaccgaaacggccccaacgtccggttccttcccccgtggcccgccccttgcctccgacgganccacctccgagacgcaacgagcccggcctgggctcgccgtggtaccaaggtaccttaccttccacttcctaacctacgtaacgtcggacgcggggtacctagggaccgaaggccggactagtagcnnnnnnnnnnnnnnnnn

SEQ ID NO: 294481 - DNA, 583 bp, Homo sapiens
  misc_feature: GYAE6OF01DELJM.37.77.G11.1.454.CMB.1.raw
  modified_base (207)..(207): a, c, t, g, unknown or other
  misc_feature (207)..(207): n is a, c, g, or t
  modified_base (246)..(246): a, c, t, g, unknown or other
  misc_feature (246)..(246): n is a, c, g, or t
  modified_base (564)..(583): a, c, t, g, unknown or other
  misc_feature (564)..(583): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggccttatnttactgtgtgaagggacctctagcccttatagcagcggntggtctggtacttgacgacgtggggccagggaccctggtcaccgtctcctcacgccctacccaccgtaacgggcccctaagtcccgggttccctttcccccggtcggcccgtcccccgttcggaccctcccgaacgggtccgacctaccgtccggaaaagcggaccaaccgacggcccggtcccgtggggtccctcggtcccgtagggtccgtaaaacgggtccctttaaccttacccgtaacttacccttaaccgtactttaccgttaggaccggtccggggtaccgttagggacccgaagggccggactagtacgnnnnnnnnnnnnnnnnnnnn

SEQ ID NO: 294482 - DNA, 525 bp, Homo sapiens
  misc_feature: GYAE6OF01DHCG4.37.77.G11.1.454.CMB.1.raw
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (496)..(496): a, c, t, g, unknown or other
  misc_feature (496)..(496): n is a, c, g, or t
  modified_base (500)..(525): a, c, t, g, unknown or other
  misc_feature (500)..(525): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgactggggccagggaaccctggtcaccgtctctcncgcctccaccaaggcccatcggtcttccccnggccgccctgctccaggcgcaccgtccgagacgacacgacgcccggcccgcgggtcctcggtccctgggttacccgaaacgggtaccttaaccttccccgaatcccttaaccactaaccgttggacggccgggtgtcggaccgaacgggccgagtactaagggncgannnnnnnnnnnnnnnnnnnnnnnnnn

SEQ ID NO: 294483 - DNA, 445 bp, Homo sapiens
  misc_feature: GYAE6OF01DAR0Y.37.77.G11.1.454.CMB.1.raw
  modified_base (441)..(445): a, c, t, g, unknown or other
  misc_feature (441)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcaacggctggtcctggtactttgacgactggggccagggaacccctggtcaccgtctcctcagcctccaccaagggcccatcggtcttccccctggcgccctgctccaggagcacctccgagacgcacagcggccctgggctgcctggtcaaggactacttccatcctacactactgacgcgggctggcaagggcgcatagnnnnn

SEQ ID NO: 294484 - DNA, 465 bp, Homo sapiens
  misc_feature: GYAE6OF01D5HP3.37.77.G11.1.454.CMB.1.raw
  modified_base (214)..(214): a, c, t, g, unknown or other
  misc_feature (214)..(214): n is a, c, g, or t
  modified_base (356)..(356): a, c, t, g, unknown or other
  misc_feature (356)..(356): n is a, c, g, or t
  modified_base (374)..(374): a, c, t, g, unknown or other
  misc_feature (374)..(374): n is a, c, g, or t
  modified_base (451)..(465): a, c, t, g, unknown or other
  misc_feature (451)..(465): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtntgaagggacctctagccccttatagcagcggctggtcctggtactttgacgacgtggggccagggaaccctggtccaccgtctcctcacgcctccaccaacgggcccatcggtcctccccgtggccgccctgctccgaggcnccacctccgagacgcacngccggcccgtgggctcgcctggtacaggactttccatctacactacgtgacggcgggctggacagggcgacagtagnnnnnnnnnnnnnnn

SEQ ID NO: 294485 - DNA, 472 bp, Homo sapiens
  misc_feature: GYAE6OF01BLZI6.37.77.G11.1.454.CMB.1.raw
  modified_base (430)..(430): a, c, t, g, unknown or other
  misc_feature (430)..(430): n is a, c, g, or t
  modified_base (459)..(472): a, c, t, g, unknown or other
  misc_feature (459)..(472): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgccctccaccgaacgggcccatccggtccttcccccgtggccgcccctgcctccgaggacgccacctccgagacgcacagccggcccgtggctcgctggtacaaggaccttactccatctaacactacnggacgcggctcggacgaggcgcagtacgnnnnnnnnnnnnnn

SEQ ID NO: 294486 - DNA, 477 bp, Homo sapiens
  misc_feature: GYAE6OF01ABWZL.37.77.G11.1.454.CMB.1.raw
  modified_base (432)..(432): a, c, t, g, unknown or other
  misc_feature (432)..(432): n is a, c, g, or t
  modified_base (438)..(440): a, c, t, g, unknown or other
  misc_feature (438)..(440): n is a, c, g, or t
  modified_base (442)..(443): a, c, t, g, unknown or other
  misc_feature (442)..(443): n is a, c, g, or t
  modified_base (445)..(445): a, c, t, g, unknown or other
  misc_feature (445)..(445): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (456)..(456): a, c, t, g, unknown or other
  misc_feature (456)..(456): n is a, c, g, or t
  modified_base (458)..(471): a, c, t, g, unknown or other
  misc_feature (458)..(471): n is a, c, g, or t
  modified_base (473)..(475): a, c, t, g, unknown or other
  misc_feature (473)..(475): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttagtattactgtgtgaagggacctctagccccttatagcagcggctggtcctggtactttgacgactggggccagggaaccctggtcaccgtctcctcagcctcaccaggcccatcggtcttcccctggcgccctgctccaggcgcacctccgagacgcacagcggccctgggctgccctggtcaaggctacgttccagtctacactactgacgcgggctgggcaagggcncatagnnntnngntantnannacngnnnnnnnnnnnnnnannngc

SEQ ID NO: 294487 - DNA, 581 bp, Homo sapiens
  misc_feature: GYAE6OF01B6FYV.37.77.G11.1.454.CMB.1.raw
  modified_base (307)..(307): a, c, t, g, unknown or other
  misc_feature (307)..(307): n is a, c, g, or t
  modified_base (355)..(355): a, c, t, g, unknown or other
  misc_feature (355)..(355): n is a, c, g, or t
  modified_base (374)..(374): a, c, t, g, unknown or other
  misc_feature (374)..(374): n is a, c, g, or t
  modified_base (552)..(552): a, c, t, g, unknown or other
  misc_feature (552)..(552): n is a, c, g, or t
  modified_base (555)..(581): a, c, t, g, unknown or other
  misc_feature (555)..(581): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtagaagggacctctacgccccttatagcagcggctggtccttggtactttgacgacgtggggccagggaaccctggtccaccggtctccctcncgccctccaccgaacgggccccacgtccggttccttcccccgtggccncccctggcctccaggtacnccacccgtccgaggtacgccaacgacggccccgggtcccgtcggggcctcgggccccgttggggtaacccaaacgggtaaccttacccgtttacccgactttaccctaacccgtaacgttaaccgttcgggaacgggtccggggacgtacgggaccgtaagggccgtaccagtaggcnatnnnnnnnnnnnnnnnnnnnnnnnnnnn

SEQ ID NO: 294488 - DNA, 498 bp, Homo sapiens
  misc_feature: GYAE6OF01C6EWT.37.77.G11.1.454.CMB.1.raw
  modified_base (481)..(498): a, c, t, g, unknown or other
  misc_feature (481)..(498): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgccctccaccaacgggcccactccggtccttcccccgtggccgcccctgcctccaggacgccaccgtaccgagagccacgacgcggcccctgggcctcgccgtaggtccaaagggaccttaccgttcctatcctaaccactacgtgaacggcgggctggacgaacgggccgcaattacgnnnnnnnnnnnnnnnnnn

SEQ ID NO: 294489 - DNA, 595 bp, Homo sapiens
  misc_feature: GYAE6OF01DMASK.37.77.G11.1.454.CMB.1.raw
  modified_base (566)..(595): a, c, t, g, unknown or other
  misc_feature (566)..(595): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaaagaacacactgtctctgcaaatgaaacagccgtgagagcgaggacgaccgtcttatagttacgtgtgtaggaacgggtaccttctaccgtacccttagacgcgaggcggtcgtacggtttccgtaggtttacgtttcggaacgtacggtcggggaccgtaacgggtaacccgtcggtacccgtaccgttcctcccgtccgacgtccccaaccgaaccggaaccggaccctacgttcccgttcccctccccgtcggccctcccgtcgccgtaccgacggactaccgacccgtacgacgacgaccacgacggcccgtccggtggtcctcggtcccgtagtaccgaacgtaccttacctcgactactacgtactacgtggaacggcggtacgtacggaacgtacggccagtatacgnnnnnnnnnnnnnnnnnnnnnnnnnnnnnn

SEQ ID NO: 294490 - DNA, 559 bp, Homo sapiens
  misc_feature: GYAE6OF01C702W.37.77.G11.1.454.CMB.1.raw
  modified_base (343)..(343): a, c, t, g, unknown or other
  misc_feature (343)..(343): n is a, c, g, or t
  modified_base (363)..(363): a, c, t, g, unknown or other
  misc_feature (363)..(363): n is a, c, g, or t
  modified_base (529)..(559): a, c, t, g, unknown or other
  misc_feature (529)..(559): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatacgcagcggctggtcctggtactttgacgacgtcggggcacgggaaccctggtccaccgtctcctcacgccctccaccgaagggcccagtccggtccttccccgnggccgccctgcctccaggcncacctcgagcgcacgacgccggcccgtgggcctcggtcccgtagggttaccaaacgggtaccttaacccgtttccaacgttccctaacctaaccttaacggttacgggaacggcccgggggtaccgtcggggacccgtaaaggggcccgacgaacgttaaggcgannnnnnnnnnnnnnnnnnnnnnnnnnnnnnn

SEQ ID NO: 294491 - DNA, 493 bp, Homo sapiens
  misc_feature: GYAE6OF01D33GD.37.77.G11.1.454.CMB.1.raw
  modified_base (340)..(340): a, c, t, g, unknown or other
  misc_feature (340)..(340): n is a, c, g, or t
  modified_base (366)..(366): a, c, t, g, unknown or other
  misc_feature (366)..(366): n is a, c, g, or t
  modified_base (466)..(493): a, c, t, g, unknown or other
  misc_feature (466)..(493): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctgggtcctggtactttgacgactggggccagggaaccctggtcaccgtctcctcagccctccaccaagggcccatccggtcctcccctggccnccctgctccaggcgccacctcgagancacgacgccggccctgggcctcgcctggtacaagggactccttccactctaaccacttactggacgcgggtctcggacgtaacggccgacgtatagcgtnnnnnnnnnnnnnnnnnnnnnnnnnnnn

SEQ ID NO: 294492 - DNA, 626 bp, Homo sapiens
  misc_feature: GYAE6OF01CHM96.37.77.G11.1.454.CMB.1.raw
  modified_base (585)..(585): a, c, t, g, unknown or other
  misc_feature (585)..(585): n is a, c, g, or t
  modified_base (591)..(591): a, c, t, g, unknown or other
  misc_feature (591)..(591): n is a, c, g, or t
  modified_base (593)..(593): a, c, t, g, unknown or other
  misc_feature (593)..(593): n is a, c, g, or t
  modified_base (602)..(603): a, c, t, g, unknown or other
  misc_feature (602)..(603): n is a, c, g, or t
  modified_base (605)..(606): a, c, t, g, unknown or other
  misc_feature (605)..(606): n is a, c, g, or t
  modified_base (609)..(618): a, c, t, g, unknown or other
  misc_feature (609)..(618): n is a, c, g, or t
  modified_base (620)..(625): a, c, t, g, unknown or other
  misc_feature (620)..(625): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttcccccgtgggccgccctgcctccgaggacgccaccctccggagacgcgacgacgccgggccccgttggggcctcgggaccccttggggtaccgaaaacggggtaccctttaacccgtttacccgaacgtttaccccgttaaaccgtaacccgtttaaacccggttacgggtaaccggggtacccggggggtacccgtttcggggggaacccgtaaaacggggccccgggaacgaaacgtttaacgggcgtcgcgacncgacgngngcgcgacgnngnncgnnnnnnnnnncnnnnnng

SEQ ID NO: 294493 - DNA, 639 bp, Homo sapiens
  misc_feature: GYAE6OF01B2FPM.37.77.G11.1.454.CMB.1.raw
  modified_base (556)..(556): a, c, t, g, unknown or other
  misc_feature (556)..(556): n is a, c, g, or t
  modified_base (559)..(559): a, c, t, g, unknown or other
  misc_feature (559)..(559): n is a, c, g, or t
  modified_base (584)..(584): a, c, t, g, unknown or other
  misc_feature (584)..(584): n is a, c, g, or t
tcagtagtgtagatcacgaccggtgctcgatttagctagtcactcaagggaaaagggggctggagtgggtctcgagcctattaactggggaattggtgattaccactatactacgcagactccgtagaagggccggttcaccatctccgagggtacaattccaagaacacgaccttgttctcgtgacttaaaaagtgaaccagccgtgagagtcgaaggacgacggccttagtagttactgtgtgaacgggtccgtctagcccttatacgcaggcgctggtcctggtacttcgacgtacgtcgggaccaacggtacccgtggtccaccgtcgtccgtcgaccgcccgtaccgaccggaaccgggccctacgttccggtcccgttccccgtggccgtccgtcgtccgtacgaggacgtaccgaccgtacgaagacgacacgacggcccggtccgtggccgtcggtcccgtcggtaccgaacggtaccttaccgtaccgtacgtacctaacgtactacgaggacggcggtcgtacggacgaacgcgagtaagtacgcngcngagcgagcgtcgacgacgtatctgngtcgacgatcgctagacgtcgaccgtaccacgtcctagttacgtcttggtgtcgg

SEQ ID NO: 294494 - DNA, 538 bp, Homo sapiens
  misc_feature: GYAE6OF01EII83.37.77.G11.1.454.CMB.1.raw
  modified_base (365)..(365): a, c, t, g, unknown or other
  misc_feature (365)..(365): n is a, c, g, or t
  modified_base (506)..(506): a, c, t, g, unknown or other
  misc_feature (506)..(506): n is a, c, g, or t
  modified_base (510)..(538): a, c, t, g, unknown or other
  misc_feature (510)..(538): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaaccctggtcaccgtctcctcacgccctccaccgaacgggcccacgtccggtccttccccctggccgccctcgcctccgacggacnccaccgtcccggagacgcacgacgccggcccgtgggctcgccgtcggtacgaacggtaccttaccttaccgacttaccctaaccaaccttacggtggaacgggcccggggcgtacgggaccgaagggccggacgaagtagngcgnnnnnnnnnnnnnnnnnnnnnnnnnnnnn

SEQ ID NO: 294495 - DNA, 454 bp, Homo sapiens
  misc_feature: GYAE6OF01DIASI.37.77.G11.1.454.CMB.1.raw
  modified_base (439)..(439): a, c, t, g, unknown or other
  misc_feature (439)..(439): n is a, c, g, or t
  modified_base (444)..(454): a, c, t, g, unknown or other
  misc_feature (444)..(454): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactggggccaggggaaccctggtcaccgtctcctcacgcctccaccaacgggcccatccggtccttcccccgtggccgcccctgcctccaggacgcacctccgagacgcacagcggccctgggctgcctggtcaaggactacttccatctacactatgagcggctggcaggcnatagnnnnnnnnnnn

SEQ ID NO: 294496 - DNA, 540 bp, Homo sapiens
  misc_feature: GYAE6OF01AG0K2.37.77.G11.1.454.CMB.1.raw
  modified_base (284)..(284): a, c, t, g, unknown or other
  misc_feature (284)..(284): n is a, c, g, or t
  modified_base (514)..(540): a, c, t, g, unknown or other
  misc_feature (514)..(540): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccctctattactgtgcgagagatcagacggagtatagcagcagctctgactacgtggggccacggacctggtcaccgtctcctcncgcctccaccgaacgggcccatccggtccttccccgtcggccacccctccgtccaacgacgccaccgtcggtcggggaccaccgacggcccgggcccgttggggccttcggcccgttacgggtacgaacgggtacctttaccgttcccaacttcccgtaacctaccgttaccgttacgggaaccgggccgggtaccggttcgggaaccgtaacgggccgtacgagtacgnnnnnnnnnnnnnnnnnnnnnnnnnnn

SEQ ID NO: 294497 - DNA, 534 bp, Homo sapiens
  misc_feature: GYAE6OF01EY22X.37.77.G11.1.454.CMB.1.raw
  modified_base (506)..(534): a, c, t, g, unknown or other
  misc_feature (506)..(534): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggcgtggtcctggtactttgacgacgtggggccagggaaccctggtcaccgtctcctcagccctccaccgaacgggcccagtccggtcccttcccctgggccgccctgcctccagggacgccaccgtccgaggacgcaccgacggccgggtccctggggctcgcccgttgggtaccaacgggaccttacctttccgaacttccgtaacacgttactacggaggtccggggtactcgggacctaagggccgacaagttacgannnnnnnnnnnnnnnnnnnnnnnnnnnnn

SEQ ID NO: 294498 - DNA, 461 bp, Homo sapiens
  misc_feature: GYAE6OF01BMFZT.37.77.G11.1.454.CMB.1.raw
  modified_base (344)..(344): a, c, t, g, unknown or other
  misc_feature (344)..(344): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
  modified_base (437)..(461): a, c, t, g, unknown or other
  misc_feature (437)..(461): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccaggggacaattccaagaacacactgtctctgcaaatgaacagcctgagagtcgaggacacggccttatattactgtgtgaagggacctcgtagccccttatagcagcggctggtcctggtactttgacgactggggccagggaacccttggtcaccgtctcctcacgcctccaccgaagggcccagtccggtcttccccctggccnccctgctccaggacgcacctcgagagcacagccggcctggctgcctggcaaggctactccatctacactacngacgcggctggcagcnatagnnnnnnnnnnnnnnnnnnnnnnnnn

SEQ ID NO: 294499 - DNA, 498 bp, Homo sapiens
  misc_feature: GYAE6OF01BOIN1.37.77.G11.1.454.CMB.1.raw
  modified_base (359)..(359): a, c, t, g, unknown or other
  misc_feature (359)..(359): n is a, c, g, or t
  modified_base (368)..(368): a, c, t, g, unknown or other
  misc_feature (368)..(368): n is a, c, g, or t
  modified_base (444)..(444): a, c, t, g, unknown or other
  misc_feature (444)..(444): n is a, c, g, or t
  modified_base (481)..(498): a, c, t, g, unknown or other
  misc_feature (481)..(498): n is a, c, g, or t
tcagtagtgtagatcacgaccggtgctcgatttagctagtcactcaagggaaagggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaacgggacctctacgccccttaagtacgctagcggtctgggtcctggtactttgacgacgtgggccaggaaccctggtccaccgtctccgtcacgccctccacgacggccctacgtccggtccttccccgtgcctacccctccncctaagacnccgacctcggcggggcacgacggccgtccgtcggctcgcccgtggaccaacggtccttacgttaccacttctaacncttacgtcgagccggcgtggacgaggcgactagacgnnnnnnnnnnnnnnnnnn

SEQ ID NO: 294500 - DNA, 638 bp, Homo sapiens
  misc_feature: GYAE6OF01BG2PN.37.77.G11.1.454.CMB.1.raw
  modified_base (598)..(598): a, c, t, g, unknown or other
  misc_feature (598)..(598): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
  modified_base (614)..(614): a, c, t, g, unknown or other
  misc_feature (614)..(614): n is a, c, g, or t
  modified_base (616)..(638): a, c, t, g, unknown or other
  misc_feature (616)..(638): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactctatctgcaaatgaacagcctgagaactgaggacacggctgtgtatcactgtgacgaaccgtaaggggggtttgagatgcagcgtgggagggtgtagttggttttgtagttttaggcggggtaccgaaaggggacctaagtcggtacctaaccccggttcttccttccgacgtccccctacccgaacccggaacgggtccccctaagtttcccgtttcccccttccccccgtggtccccctaacccccgtttcccctacccgaaacggtaccgccgtacccgttcggtcggggggaccacgacgggcccggtcccgtgggcctcgggtacccgtggtaccgaaccggtaccttaccgttaccacttccctaaccgtaacttacgtaggaacgggtccgggtacgtcgggaccgaaagggacccgacgtaaagtcggntacgngngngnngngngnnnnnnnnnnnnnnnnnnnnnnn

SEQ ID NO: 294501 - DNA, 548 bp, Homo sapiens
  misc_feature: GYAE6OF01CQW12.37.77.G11.1.454.CMB.1.raw
  modified_base (304)..(304): a, c, t, g, unknown or other
  misc_feature (304)..(304): n is a, c, g, or t
  modified_base (365)..(365): a, c, t, g, unknown or other
  misc_feature (365)..(365): n is a, c, g, or t
  modified_base (526)..(548): a, c, t, g, unknown or other
  misc_feature (526)..(548): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatatactgtgtgaagggacctctagccccttatagcagcggctggtcctggtactttgacgacgtggggccacgggaccctggtccaccgtcctcctcacnccctccaccgaacgggcccagtccgtccttcccccgtggccgccctcggcctccgaggacnccgaccctcgagacgccacgacggcggccccgtcggggcctcggccgttaggtaccgtaaacgggtaccctttaccttccctaattccctaaccgtaaccgtaacgttgggaccggtcggggtaccgtcggggaccgaaacgggtccacgaagtacgcagnnnnnnnnnnnnnnnnnnnnnnn

SEQ ID NO: 294502 - DNA, 555 bp, Homo sapiens
  misc_feature: GYAE6OF01D7DQ1.37.77.G11.1.454.CMB.1.raw
  modified_base (246)..(246): a, c, t, g, unknown or other
  misc_feature (246)..(246): n is a, c, g, or t
  modified_base (519)..(519): a, c, t, g, unknown or other
  misc_feature (519)..(519): n is a, c, g, or t
  modified_base (524)..(555): a, c, t, g, unknown or other
  misc_feature (524)..(555): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaactccaacaacacgctgtctctgcaacttaacagcctgagagacgaggacacggccgtatattactgtgcgaaggaagggtctagcagtgcctggtaccncccactactatatggacgtcgtggggacaaaggaatcggcggtcaccgtctcctcacgccctccaccgaacgggccctacgtccggttcccttcccccgtcgggccctacccccgtcccttacccgaaacgtacgccctacccgtcggtacgggggccacgacggccggcccgtgggcctcggccgtcgggtacgaaacggtaccttaccgttccattacctacctacctacgtggacggtccgggtctcgggacgaacgggccgacagtagntgacnnnnnnnnnnnnnnnnnnnnnnnnnnnnnnnn

SEQ ID NO: 294503 - DNA, 490 bp, Homo sapiens
  misc_feature: GYAE6OF01CDUW1.37.77.G11.1.454.CMB.1.raw
  modified_base (337)..(337): a, c, t, g, unknown or other
  misc_feature (337)..(337): n is a, c, g, or t
  modified_base (471)..(471): a, c, t, g, unknown or other
  misc_feature (471)..(471): n is a, c, g, or t
  modified_base (476)..(477): a, c, t, g, unknown or other
  misc_feature (476)..(477): n is a, c, g, or t
  modified_base (479)..(490): a, c, t, g, unknown or other
  misc_feature (479)..(490): n is a, c, g, or t
tcagtagtgtagatcacgaccggtgctcgatttagctagtcactcaagggaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgactggggccagggaaccctggtcaccgtctcctcagcctccaccaacgggcccatccggtccttcccccgnggccgcccctcgctccagggacgcacctccgacgacgccacgacggccggcccgtgggcctcgccgtggtaccaaacgggtacctaccgttccacttccgtaaccactactggacggcgggctggacaagggcncatgnncnnnnnnnnnnnn

SEQ ID NO: 294504 - DNA, 493 bp, Homo sapiens
  misc_feature: GYAE6OF01D8PCJ.37.77.G11.1.454.CMB.1.raw
  modified_base (381)..(381): a, c, t, g, unknown or other
  misc_feature (381)..(381): n is a, c, g, or t
  modified_base (452)..(452): a, c, t, g, unknown or other
  misc_feature (452)..(452): n is a, c, g, or t
  modified_base (479)..(479): a, c, t, g, unknown or other
  misc_feature (479)..(479): n is a, c, g, or t
  modified_base (485)..(493): a, c, t, g, unknown or other
  misc_feature (485)..(493): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacaccctgtctctgcaaatgaacaacctgagagccgaggacacggccctatattactagtaacgaaaatggcctacggatatgactactagttggactggtacttcgatcgtcgtcgggggccgtcggcctacccgtggtcctacttgtcctcctcacgtccctacccgaaccgacgggccctacgtccggttcccttcccccgtggccctccctgcctccgaggcncccaccgtcgagacgccacgacgccggcccgtggctcgcgtcgtacgacggacttactccattccaacctntacgtggacggcgggctggacgaggcncagcgnnnnnnnnn

SEQ ID NO: 294505 - DNA, 594 bp, Homo sapiens
  misc_feature: GYAE6OF01C2YBE.37.77.G11.1.454.CMB.1.raw
  modified_base (565)..(594): a, c, t, g, unknown or other
  misc_feature (565)..(594): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggcttatattactgtgtgaacgggacctctacgtccccttatagcagcggctggtccttggtactttgacgacgtggggccacgggaacccgtggtccaccgtcctcctcacgccctaccgaaccgtaacggggcccctacgtcccgggttcccctttcccccgtgggccccgtccccgtcgccctcccgacgggacgaccctacccgtccgagacgccgaaccgcgggcccggtcccgtggggcctcggtcccgtagggtaccgaaacggtacccttaccttaccctaacgttcccttaaacctacttacggtacggtacgggccggggtacgtcgggaacccgtaaggggccgaacgtactaggcnnnnnnnnnnnnnnnnnnnnnnnnnnnnnn

SEQ ID NO: 294506 - DNA, 441 bp, Homo sapiens
  misc_feature: GYAE6OF01A0PBR.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcgccctgctccaggagcacctccgagagcacagcggccctgggctgcctggtcaagggctacttccatctacactactgagcgggctgggcaagggcgcatagnnnnnnn

SEQ ID NO: 294507 - DNA, 811 bp, Homo sapiens
  misc_feature: GYAE6OF01EXYH2.37.77.G11.1.454.CMB.1.raw
  modified_base (92)..(92): a, c, t, g, unknown or other
  misc_feature (92)..(92): n is a, c, g, or t
  modified_base (318)..(318): a, c, t, g, unknown or other
  misc_feature (318)..(318): n is a, c, g, or t
  modified_base (378)..(379): a, c, t, g, unknown or other
  misc_feature (378)..(379): n is a, c, g, or t
  modified_base (679)..(679): a, c, t, g, unknown or other
  misc_feature (679)..(679): n is a, c, g, or t
  modified_base (706)..(706): a, c, t, g, unknown or other
  misc_feature (706)..(706): n is a, c, g, or t
  modified_base (776)..(776): a, c, t, g, unknown or other
  misc_feature (776)..(776): n is a, c, g, or t
  modified_base (778)..(778): a, c, t, g, unknown or other
  misc_feature (778)..(778): n is a, c, g, or t
  modified_base (780)..(780): a, c, t, g, unknown or other
  misc_feature (780)..(780): n is a, c, g, or t
  modified_base (782)..(782): a, c, t, g, unknown or other
  misc_feature (782)..(782): n is a, c, g, or t
  modified_base (784)..(784): a, c, t, g, unknown or other
  misc_feature (784)..(784): n is a, c, g, or t
  modified_base (789)..(789): a, c, t, g, unknown or other
  misc_feature (789)..(789): n is a, c, g, or t
  modified_base (791)..(791): a, c, t, g, unknown or other
  misc_feature (791)..(791): n is a, c, g, or t
  modified_base (795)..(795): a, c, t, g, unknown or other
  misc_feature (795)..(795): n is a, c, g, or t
  modified_base (797)..(797): a, c, t, g, unknown or other
  misc_feature (797)..(797): n is a, c, g, or t
  modified_base (803)..(803): a, c, t, g, unknown or other
  misc_feature (803)..(803): n is a, c, g, or t
  modified_base (805)..(806): a, c, t, g, unknown or other
  misc_feature (805)..(806): n is a, c, g, or t
  modified_base (808)..(808): a, c, t, g, unknown or other
  misc_feature (808)..(808): n is a, c, g, or t
  modified_base (810)..(811): a, c, t, g, unknown or other
  misc_feature (810)..(811): n is a, c, g, or t
tcagtagtgtagatcacgaccggtgctcgatttagctagtcactcaagggaaaggggctggagtgggtctcagctattaatgggaatgggtnataccacatactacgcagactccgtggacgggtccggttccaccactcctccgacggactaacttaccaaacgaacacactcgtctctgacaaagtagaacacgccgtaggacggaggtacggacggaccgtaccggtacctttaacgttacgtttacgttggttaggtacggtaacgggtaccgtaccgttaccgtaccccgttacgtacggacgacggccgggntccgttcggttccgttacggttaccgtttacggtaccggtaccggtaccggggacccggnngaaccgggtaaccccggttcggtcccgtaccgacccgctttccctaccgaactttcccccgtaccccgtaacccggtaacccgggtaccccccgtaccggttcccgggttcccccgtttcccccggttccggtccccgtaccccggtaccgtcccgtaccccggtaccgggacggacccgtaccccgtacccggaacgggaccggacccgtaccggaccggtcccgggtccccgggctttcgggggtcccgttacgggtaccccgttaacggggttaccctaaaccggttaccccgttanaaccctttacccgtaaccgttacccgngttaaccgtaccggtaaccggttcgggacggaccggggaccgtacgggccgaacgggtacgcactacgcncncncncnactcncncgcncngtcgcncnncngnn

SEQ ID NO: 294508 - DNA, 513 bp, Homo sapiens
  misc_feature: GYAE6OF01B4MIM.37.77.G11.1.454.CMB.1.raw
  modified_base (489)..(489): a, c, t, g, unknown or other
  misc_feature (489)..(489): n is a, c, g, or t
  modified_base (491)..(513): a, c, t, g, unknown or other
  misc_feature (491)..(513): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaccctggtccaccgtctcctcacgccctccaccgacgggcccattccgggtccttcccccgtggccgcccctgcctccgaggacgccaccctccgagagccacgacggccggcccgtggggcctcggcccttgggtaccaacgggtacccttacttcccattcctaccacttactggacggcgggctgggaccaacgggtcgcgacgtagncnnnnnnnnnnnnnnnnnnnnnnn

SEQ ID NO: 294509 - DNA, 579 bp, Homo sapiens
  misc_feature: GYAE6OF01EISJ1.37.77.G11.1.454.CMB.1.raw
  modified_base (251)..(251): a, c, t, g, unknown or other
  misc_feature (251)..(251): n is a, c, g, or t
  modified_base (357)..(357): a, c, t, g, unknown or other
  misc_feature (357)..(357): n is a, c, g, or t
  modified_base (551)..(579): a, c, t, g, unknown or other
  misc_feature (551)..(579): n is a, c, g, or t
tcagtagtgtagatcacgaccggtgctcgatttagctagtcactcaaagggaaaggggctggagtgggtctcagctattaatgggaatggtgataccacatactacgcagactccatgaagggccggttcaccatctccagggacaattccaagaacacactgtctctgcaaatgaacagcctgagagtcgaggacacggccttatattactgtgtaggaagggacctctacgccccttatacgcagcggntcggtcctggttacttgacgtacgtggggccacgggaaccctggtccaccgtcctcctcacgtccctaccaccgaacgggccccagttccggttcccttcccccgnggcccgtccccgtgccctccgacggacgcctaacccgtccggagacgaccaacgacggcccggcccgtggggtccgtcgcccgttcgggtaccgaacgggtaccttaccttacccgacttaccgtacctaaccgttaccgtggacgggtccggggtacgttcggggaccggaacgggccgactacggtagacgnnnnnnnnnnnnnnnnnnnnnnnnnnnnn

SEQ ID NO: 294510 - DNA, 536 bp, Homo sapiens
  misc_feature: GYAE6OF01DJ904.37.77.G11.1.454.CMB.1.raw
  modified_base (346)..(346): a, c, t, g, unknown or other
  misc_feature (346)..(346): n is a, c, g, or t
  modified_base (507)..(536): a, c, t, g, unknown or other
  misc_feature (507)..(536): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtcctctgacaaatgaacagcctgagagtcgaggacacggccttatatactgtgtgaagggcctctacgccccttatagcagcgcgtggtccttggttacttggacgacgtcggggccagggaccctggtccaccgtctccctcacgccctccaaccgaacggcccagtccgttcccttccccgnggcccgtccctccgccccgaggacgccacccgtcgacgacgacacgacgccggcccgtcgggctcgaccgtggtacgaacggtacgttacccttcaacttcctaaccacgttaaccgtgggacggccggggttcacggggacgaacgccgaagtacagcgnnnnnnnnnnnnnnnnnnnnnnnnnnnnnn

SEQ ID NO: 294511 - DNA, 593 bp, Homo sapiens
  misc_feature: GYAE6OF01BDZ1X.37.77.G11.1.454.CMB.1.raw
  modified_base (376)..(376): a, c, t, g, unknown or other
  misc_feature (376)..(376): n is a, c, g, or t
  modified_base (561)..(563): a, c, t, g, unknown or other
  misc_feature (561)..(563): n is a, c, g, or t
  modified_base (565)..(593): a, c, t, g, unknown or other
  misc_feature (565)..(593): n is a, c, g, or t
tcagtagtgtagatcacgaccggtgctcgatttagctagtcactcaaggggaaaggggctggagtgggtctcagctattaatgggaatggtgataccacatactacgcagactccgtgaagggccggttcaccatctccagggacaattccaagaacaccctgtctctgacaaaatgaaacaacctgagagccgaggacacggcctatattactagtaacgaaaaatggacctaacggatatagactaactagttgggactggtacttcgatcgtcgtggggccgtggccacccgtggtaccacgttcgtcctacctcgacgtcccctacccgaaccgaacgggacccctaacgttcccggttccctttcccccgngggcccgcccgtcgtacctaccggaacggacgtccacccgtccgagacacgacgacggccgacccgtgggacctgcgtacggtacgaaacggtaaccttaccttaccgtacttaccgtaaacctaaccgtaacgtacgggtacggccggggtagtaccgggaacgaacgggctaccgaagtacgnnncnnnnnnnnnnnnnnnnnnnnnnnnnnnnn

SEQ ID NO: 294512 - DNA, 575 bp, Homo sapiens
  misc_feature: GYAE6OF01BREFM.37.77.G11.1.454.CMB.1.raw
  modified_base (544)..(544): a, c, t, g, unknown or other
  misc_feature (544)..(544): n is a, c, g, or t
  modified_base (546)..(575): a, c, t, g, unknown or other
  misc_feature (546)..(575): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccttatagcagcggctggtcctggttactttgacgtacgtggggccagggaaccctggtccaccgtctcctcgacgtccctaccaccgaacgggccccacgttccggttcccttcccccgtggccccgtccccgtgcccgtccgacggacgccacccgtcccgagacggaccacgacgcccgggtccctggggtctcgcccgttaggtacccgaaacggtaccttaaccgttcccaacgttccttaacctaaccgtttaacgcggaaccgggtcggggtcccgtagggaccgaacgggccgacctaaagtcggnannnnnnnnnnnnnnnnnnnnnnnnnnnnnn

SEQ ID NO: 294513 - DNA, 671 bp, Homo sapiens
  misc_feature: GYAE6OF01B754Q.37.77.G11.1.454.CMB.1.raw
  modified_base (260)..(260): a, c, t, g, unknown or other
  misc_feature (260)..(260): n is a, c, g, or t
  modified_base (387)..(387): a, c, t, g, unknown or other
  misc_feature (387)..(387): n is a, c, g, or t
  modified_base (398)..(398): a, c, t, g, unknown or other
  misc_feature (398)..(398): n is a, c, g, or t
  modified_base (404)..(404): a, c, t, g, unknown or other
  misc_feature (404)..(404): n is a, c, g, or t
  modified_base (517)..(517): a, c, t, g, unknown or other
  misc_feature (517)..(517): n is a, c, g, or t
  modified_base (571)..(571): a, c, t, g, unknown or other
  misc_feature (571)..(571): n is a, c, g, or t
tcagtagtgtagatcacgaccggtgctcgatttagctagtcactcgtaaggggaaaggggctggagtgggtctcgacgctagttaatgggaatgggtagactaccacatactacgcagactccgtgaacgggtccgttcaccatctccagggaccaattccgaagaacactactgtctcgtgacaaatcgaacagcctagagagtcgaggacacggaccgttatacttacgtcgtgtgaacggacttcgacgccctttanacgcacgggcgcgtggtccgttaggtactttcggacgtacgtcgggacctaagggaaccctggtcaccgtcgtccgtacacggccctaccaccaacgggcctacgtccgtcctcccgtcggccgccncggtcctacgnggaacncaccgtacggagacgcgacgtaacggcccggtaccgtcggtctaccggtccgtacggttaccgaaacgttccgttaaccgtcccgtaacttacctaacgtaccgtttaacggnggtaacgggaccggttactgggaacccgttaaaggggccgttaacctaaagggngtacgagttagaaccttgcgtacgacgtacgacgacgtcgacgacgacgacgagacgacgacgtagtcgcgcgacgtacgtcgtactactctgtagtacg

SEQ ID NO: 294514 - DNA, 459 bp, Homo sapiens
  misc_feature: GYAE6OF01A4V52.37.77.G11.1.454.CMB.1.raw
  modified_base (448)..(459): a, c, t, g, unknown or other
  misc_feature (448)..(459): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacgctgtatctgcaaatgaacagcctgagagccgaggacacggccgtatattactgttcgaaagataggtactctggttcggcgtacttttttaatgtccatctttgaccactggggccagggaaccctggtcaccgtctcctcagcctccaccaagggccccagtcggtccttccccctggccgccctcgctccaggacgcacctccgagacgcacaggccgcctgggctgccgtgcaaggctacttccatctacactacgtgacggcgggctggacaaggcgacagtagnnnnnnnnnnnn

SEQ ID NO: 294515 - DNA, 635 bp, Homo sapiens
  misc_feature: GYAE6OF01EZMIN.37.77.G11.1.454.CMB.1.raw
  modified_base (92)..(92): a, c, t, g, unknown or other
  misc_feature (92)..(92): n is a, c, g, or t
  modified_base (248)..(248): a, c, t, g, unknown or other
  misc_feature (248)..(248): n is a, c, g, or t
  modified_base (307)..(307): a, c, t, g, unknown or other
  misc_feature (307)..(307): n is a, c, g, or t
  modified_base (482)..(482): a, c, t, g, unknown or other
  misc_feature (482)..(482): n is a, c, g, or t
  modified_base (587)..(587): a, c, t, g, unknown or other
  misc_feature (587)..(587): n is a, c, g, or t
tcagtagtgtagatcacgaccggtgctcgatttagctagtcactcaagggaaaggggctggagtgggtctcagctattaatgggaatggtgntaccacatactacgcagactccgtgaagggccggttcaccatctccagggacaattccaagaacacactgtctctgcaaatgaacagcctgagagtcgaggacacggccttatattactgtgtgaagggacctctagccccttatagcagcggcgntggtcctgtacgttgacgacgtcggggccgacgggacccgtcggtccacccgtcctccntaccacgcccgcctacccgaccccaaacggggtccccgtacttccccggttccgttccccccgtccggccgtcccctcggccgtcccgaccggacgcaccgtccgacgacgcgaccgacggcggcccgtcgggtcgtcgccgtacggtactaacggtacctacttcccactactnacacgtaccgtcggcggtccggggtccgtacgggaccggtaaacggggtcccggaccgtaacgttaacggacgtacgtcgtacgacgtacgacgcgtacgtacgncgtacgtacggtccgacgtacgtacgtactacgaccgcgtcgtcgtcg

SEQ ID NO: 294516 - DNA, 484 bp, Homo sapiens
  misc_feature: GYAE6OF01AU3Z7.37.77.G11.1.454.CMB.1.raw
  modified_base (465)..(484): a, c, t, g, unknown or other
  misc_feature (465)..(484): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagccctccaccaacgggcccactccggtccttcccccgtggccgcccctgcctcccagggacgccacctccgagagcaccagccggccctgggctcgccgtcggtacaacggctacttccactcctacactctagcggcgggtctggcaagggcgctaacgtgcnnnnnnnnnnnnnnnnnnnn

SEQ ID NO: 294517 - DNA, 536 bp, Homo sapiens
  misc_feature: GYAE6OF01EXD31.37.77.G11.1.454.CMB.1.raw
  modified_base (369)..(369): a, c, t, g, unknown or other
  misc_feature (369)..(369): n is a, c, g, or t
  modified_base (508)..(521): a, c, t, g, unknown or other
  misc_feature (508)..(521): n is a, c, g, or t
  modified_base (523)..(536): a, c, t, g, unknown or other
  misc_feature (523)..(536): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggttactttgacgacgtggggccagggaccctggtcaccgtctcctcacgccctaccaccgaacgggcccctagtccggttcccttcccccgtggcccgccctgcctccgaggcnccaccgtcgagacgcacgcggccggcccgtgggctcgccgtaggaccgaacggtccttaccttcacttaccctaccacgttacgtgggacggccgggtcgtacggaccgaacggggccaacgtagtaggctgactgcgnnnnnnnnnnnnnngnnnnnnnnnnnnnn

SEQ ID NO: 294518 - DNA, 531 bp, Homo sapiens
  misc_feature: GYAE6OF01A42RW.37.77.G11.1.454.CMB.1.raw
  modified_base (478)..(478): a, c, t, g, unknown or other
  misc_feature (478)..(478): n is a, c, g, or t
  modified_base (499)..(500): a, c, t, g, unknown or other
  misc_feature (499)..(500): n is a, c, g, or t
  modified_base (502)..(502): a, c, t, g, unknown or other
  misc_feature (502)..(502): n is a, c, g, or t
  modified_base (505)..(531): a, c, t, g, unknown or other
  misc_feature (505)..(531): n is a, c, g, or t
tcagtagtgtagatcacgaccggtgctcgatttagctagtcactcaagggaaagggggcgtggagtgggtctcagctattaatggggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggcgtggtcctggtactttgacgacttggggccaggggaaccctggtcaccgtctcctcgacgccctccaccaagggcccatcggtccttcccccgtcggcgcccctcgccttccagggacgcctacccgtcccgagacgcaccgacggccggcccgtggggtcctcggtcccgtcgggtaccaaacgggtacctaccgtttccactcctaacacttacgtgacgccgggntcgggacgaaggcacgtatgnncntcnnnnnnnnnnnnnnnnnnnnnnnnnnn

SEQ ID NO: 294519 - DNA, 570 bp, Homo sapiens
  misc_feature: GYAE6OF01DS6TV.37.77.G11.1.454.CMB.1.raw
  modified_base (537)..(537): a, c, t, g, unknown or other
  misc_feature (537)..(537): n is a, c, g, or t
  modified_base (540)..(541): a, c, t, g, unknown or other
  misc_feature (540)..(541): n is a, c, g, or t
  modified_base (543)..(570): a, c, t, g, unknown or other
  misc_feature (543)..(570): n is a, c, g, or t
tcagtagtgtagatcacgaccggtgctcgatttagctagtcactcaagggaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgacgtggggccagggaaccctggtcaccgtctcctcacgcctccaccgaagggcccctaacgtccggttccttccccctgggcccgtcccctgcctccgacggacgccaccgtccgagacgacacgacggcccggtccccgtgggtctcggtcccgttgggttaccgaaacgggtaccttaccgttcccaacttcccttaaccacttaaacggtcgggacggtcccgggggtactacgggacctaaacggggtccgaaccgtaagtaacggnacnngnnnnnnnnnnnnnnnnnnnnnnnnnnnn

SEQ ID NO: 294520 - DNA, 565 bp, Homo sapiens
  misc_feature: GYAE6OF01BO4Z0.37.77.G11.1.454.CMB.1.raw
  modified_base (536)..(565): a, c, t, g, unknown or other
  misc_feature (536)..(565): n is a, c, g, or t
tcagtagtgtagatcacgaccggtgctcgatttagctagtcactcaagggaaaggggctggagtgggtctcagctattaatgggaatggtgataccacatactacgcagactcccgtgaagggccggttcaccatctccagggacaattccaagaacacactgtctctgcaaatgaacagcctgagagtcggaggacacggccttatatttactgtgcgagagatcagacggatagtgcagcagctctgactacgtcggggacccaaccggaacccgtcggtacctacccgttcctccctcgaccgccctaccgacccgaaaccgggtccccaacgttccggttcccttccccgtaccgtccggcctaccccgtaccctaccgaacgtacgccacccgtcggtcgggggaccacgacggccggcccgtacgggcctcgccgtggaccgaacggtaccttaccttccgaactccgtaacctacgtaccgtggacgggtccgggcttacgggacgtaacgggcgtacgagtacggacnnnnnnnnnnnnnnnnnnnnnnnnnnnnnn

SEQ ID NO: 294521 - DNA, 464 bp, Homo sapiens
  misc_feature: GYAE6OF01DCLOR.37.77.G11.1.454.CMB.1.raw
  modified_base (445)..(464): a, c, t, g, unknown or other
  misc_feature (445)..(464): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccctctattactgtgcgagagatcagacggagtatagcagcagtctctgactacgtggggcccaggggaaccctggtcaccgtctcctcacgcctccaccaaggcccatccggtccttccccctggccacccctctaccaagacgcacctcgtggggcacaggccgtcccgtgggcctgccgtggtcaaggtacttactccgatcctacaccttactgacgcgggtctggacgaggcacgatagnnnnnnnnnnnnnnnnnnnn

SEQ ID NO: 294522 - DNA, 686 bp, Homo sapiens
  misc_feature: GYAE6OF01EGVHK.37.77.G11.1.454.CMB.1.raw
  modified_base (237)..(237): a, c, t, g, unknown or other
  misc_feature (237)..(237): n is a, c, g, or t
  modified_base (415)..(415): a, c, t, g, unknown or other
  misc_feature (415)..(415): n is a, c, g, or t
  modified_base (616)..(616): a, c, t, g, unknown or other
  misc_feature (616)..(616): n is a, c, g, or t
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
  modified_base (637)..(637): a, c, t, g, unknown or other
  misc_feature (637)..(637): n is a, c, g, or t
  modified_base (639)..(639): a, c, t, g, unknown or other
  misc_feature (639)..(639): n is a, c, g, or t
  modified_base (643)..(643): a, c, t, g, unknown or other
  misc_feature (643)..(643): n is a, c, g, or t
  modified_base (646)..(646): a, c, t, g, unknown or other
  misc_feature (646)..(646): n is a, c, g, or t
  modified_base (654)..(654): a, c, t, g, unknown or other
  misc_feature (654)..(654): n is a, c, g, or t
  modified_base (664)..(664): a, c, t, g, unknown or other
  misc_feature (664)..(664): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (678)..(678): a, c, t, g, unknown or other
  misc_feature (678)..(678): n is a, c, g, or t
  modified_base (683)..(683): a, c, t, g, unknown or other
  misc_feature (683)..(683): n is a, c, g, or t
tcagtagtgtagatcacgaccggtgctcgatttagctagtcactcaaagggaaaggggctggagttggtctcagctattaatgggaatggtgataccacatactacgcagactccgtgaagggccggttcacatctccaggacattccaagaacacactgtctctgacaaatgaacagcctgagagtcgaggacacgtccttatattactgtgtagaacggcctctacgtcccttanacgcgagcggtcttggtccttaggttacgtttgacgtcggtcggggcctaaacgggtaccgtcggtaccgtacccgttcctcccgtcgacgtccctacccgaaccggaaccggtcccctacggttcccggttcccgttcccccgtcggcccgtaccccttcgcctaccgacgggtacncccgaccgtcgacgacgacccacgaccggcccggtacccggtgggtacccgttaccggtcccgttaggtaaacccgtaaaccgggttaaccttttaacccgttacccgtaacctttacccgttaaccgtaaccgttaccgttagggaaccggttccggggacgtccgggaaccgggtaacggtcccgtaagaacgttacgngtcgactcncacgacgntcgncncgcncgngcgcgacncgcgagacgnacgtcgngngacancgcgngcg

SEQ ID NO: 294523 - DNA, 508 bp, Homo sapiens
  misc_feature: GYAE6OF01A9KML.37.77.G11.1.454.CMB.1.raw
  modified_base (347)..(347): a, c, t, g, unknown or other
  misc_feature (347)..(347): n is a, c, g, or t
  modified_base (360)..(360): a, c, t, g, unknown or other
  misc_feature (360)..(360): n is a, c, g, or t
  modified_base (447)..(447): a, c, t, g, unknown or other
  misc_feature (447)..(447): n is a, c, g, or t
  modified_base (452)..(453): a, c, t, g, unknown or other
  misc_feature (452)..(453): n is a, c, g, or t
  modified_base (455)..(457): a, c, t, g, unknown or other
  misc_feature (455)..(457): n is a, c, g, or t
  modified_base (459)..(460): a, c, t, g, unknown or other
  misc_feature (459)..(460): n is a, c, g, or t
  modified_base (465)..(465): a, c, t, g, unknown or other
  misc_feature (465)..(465): n is a, c, g, or t
  modified_base (470)..(470): a, c, t, g, unknown or other
  misc_feature (470)..(470): n is a, c, g, or t
  modified_base (475)..(475): a, c, t, g, unknown or other
  misc_feature (475)..(475): n is a, c, g, or t
  modified_base (479)..(480): a, c, t, g, unknown or other
  misc_feature (479)..(480): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (492)..(492): a, c, t, g, unknown or other
  misc_feature (492)..(492): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (505)..(505): a, c, t, g, unknown or other
  misc_feature (505)..(505): n is a, c, g, or t
tcagtagtgtagatcacgaccggtgctcgatttagctagtcactcaaggggaaaggggctggagtgggtctcagctattaatgggaatggtgataccacgactactacgcagactccggtgaagggccggttcaccatctccagggacaattccaagaacacactgtctctgcaaatgaacagccctgacgagtcgaggacacggccttatattaacgtgtgtgaagggacctctagccccttatagccgagcggctggtcctggtactttgacgactggggtaccagggaaccctggtcaccgtctccccgagccctccaccaaggcccatcgtcttcccctgccnccctgctccaggngcacctccgagacgtcacagccggccctgggctgcctggcaaggactacttccatctacactactgacgtcggctggacaaggcganatagnncnnncnngtacngactnctgcngacnngncanacnctcncgcngcancnctntac

SEQ ID NO: 294524 - DNA, 513 bp, Homo sapiens
  misc_feature: GYAE6OF01C2B82.37.77.G11.1.454.CMB.1.raw
  modified_base (388)..(388): a, c, t, g, unknown or other
  misc_feature (388)..(388): n is a, c, g, or t
  modified_base (458)..(458): a, c, t, g, unknown or other
  misc_feature (458)..(458): n is a, c, g, or t
  modified_base (494)..(513): a, c, t, g, unknown or other
  misc_feature (494)..(513): n is a, c, g, or t
tcagtagtgtagatcacgaccggtgctcgatttagctagtcactcaagggaaaggggctggagtgggtctcagctattaatgggaatggtgataccacatactacgcagactccgtgaaggggccggttcaccatctccagggacaattccaagaacacactgtctctgacaaatgaacagcctgagagtcgaggacaccggcttatattactgtgtgaagggacctctacgccccttatagcagcggctggtcctggtactttgacgacgtcgggccgacgggaaccctggtcctaccgtcctcctcacgcctaccaccgacggccccagtccggtccttcccccgtggccgtacccgtcgcctccgaggacgcaccctccgagacncgacgacgccggcccgtgggcctcgcgtcggtacgtaaggtaccttcttccacttccgtaacacttacgnggacggacgggtctgggaccgaacggcgacagacgnnnnnnnnnnnnnnnnnnnn

SEQ ID NO: 294525 - DNA, 519 bp, Homo sapiens
  misc_feature: GYAE6OF01EBZM6.37.77.G11.1.454.CMB.1.raw
  modified_base (494)..(494): a, c, t, g, unknown or other
  misc_feature (494)..(494): n is a, c, g, or t
  modified_base (496)..(519): a, c, t, g, unknown or other
  misc_feature (496)..(519): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgcgactcggggccagggaccctggtcaccgtctcctcagccctccaccaacgggcccatccggtccttcccccgtggccgcccctgcctccacgggcgccacccgtccggacgacgcaacgacggccggcccgtgggcgtcgccgtggtaccaacggaccttaccttccattccctaccacttacgtcggacgggtccgggcgtcgggactaacgggcacgtagtacgcagngnnnnnnnnnnnnnnnnnnnnnnnn

SEQ ID NO: 294526 - DNA, 455 bp, Homo sapiens
  misc_feature: GYAE6OF01A9JOT.37.77.G11.1.454.CMB.1.raw
  modified_base (338)..(338): a, c, t, g, unknown or other
  misc_feature (338)..(338): n is a, c, g, or t
  modified_base (410)..(410): a, c, t, g, unknown or other
  misc_feature (410)..(410): n is a, c, g, or t
  modified_base (439)..(455): a, c, t, g, unknown or other
  misc_feature (439)..(455): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccaggggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcacgcctccaccagggcccatcggtcttcccctggccnccctgcctccaggcgcacctccgagagcacgagcggccctgggctgcctggtcaaggactacttcatctacnctatgagcgggctggcaaggcacagtagnnnnnnnnnnnnnnnnn

SEQ ID NO: 294527 - DNA, 500 bp, Homo sapiens
  misc_feature: GYAE6OF01A7WMZ.37.77.G11.1.454.CMB.1.raw
  modified_base (346)..(346): a, c, t, g, unknown or other
  misc_feature (346)..(346): n is a, c, g, or t
  modified_base (480)..(500): a, c, t, g, unknown or other
  misc_feature (480)..(500): n is a, c, g, or t
tcagtagtgtagatcacgaccggtgctcgatttagctagtcactcaaggggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctagccccttatagcagcggctggtcctggtactttgaccgacgtggggccagggtaaccctggtccaccgttctcctcacgccctccaccgaacggcccactcgtccttcccctggcccnccctgcctccgaggactccacctccgagacgccacgaggcccggccctagggcctcgcccgtggtaccaacgggtacctacctttcccgatacctaacactaccgtggacggcgggctgggcaaggcacatagnnnnnnnnnnnnnnnnnnnnn

SEQ ID NO: 294528 - DNA, 617 bp, Homo sapiens
  misc_feature: GYAE6OF01BEX6L.37.77.G11.1.454.CMB.1.raw
  modified_base (583)..(587): a, c, t, g, unknown or other
  misc_feature (583)..(587): n is a, c, g, or t
  modified_base (589)..(594): a, c, t, g, unknown or other
  misc_feature (589)..(594): n is a, c, g, or t
  modified_base (596)..(601): a, c, t, g, unknown or other
  misc_feature (596)..(601): n is a, c, g, or t
  modified_base (603)..(614): a, c, t, g, unknown or other
  misc_feature (603)..(614): n is a, c, g, or t
  modified_base (616)..(617): a, c, t, g, unknown or other
  misc_feature (616)..(617): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgacgtggggccacgggaacctggtccaccgtctccctcacgccctccgaccgacgggcccacgtccggtcccttccccgtcggcccgtccccgtgcctcccgacggtaccgcccgacccgtcggaacgacgaccgaaccgacgggccccggtaccccggtcgggacccgttccgggtcccgttacggggtaacccgtaaaaccgggtaaccctttacccgttacccctaacgttaccccttaaccgtaacccgttacgtcgggtaaccgggcgggtacgttaccgggaccgtaaccgggccgtacgtagtaagctacgnnnnngnnnnnngnnnnnngnnnnnnnnnnnngnn

SEQ ID NO: 294529 - DNA, 569 bp, Homo sapiens
  misc_feature: GYAE6OF01C2C24.37.77.G11.1.454.CMB.1.raw
  modified_base (526)..(527): a, c, t, g, unknown or other
  misc_feature (526)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (537)..(538): a, c, t, g, unknown or other
  misc_feature (537)..(538): n is a, c, g, or t
  modified_base (547)..(547): a, c, t, g, unknown or other
  misc_feature (547)..(547): n is a, c, g, or t
  modified_base (553)..(553): a, c, t, g, unknown or other
  misc_feature (553)..(553): n is a, c, g, or t
  modified_base (555)..(555): a, c, t, g, unknown or other
  misc_feature (555)..(555): n is a, c, g, or t
  modified_base (558)..(560): a, c, t, g, unknown or other
  misc_feature (558)..(560): n is a, c, g, or t
  modified_base (563)..(564): a, c, t, g, unknown or other
  misc_feature (563)..(564): n is a, c, g, or t
  modified_base (566)..(569): a, c, t, g, unknown or other
  misc_feature (566)..(569): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacgacggccttatattactgtgtgaagggacctctacgccccttatagcagtcggctcggtcctggtactttgacgacgtcggggccacggggaacccttggtccaccgttcctcctcgacgccctccaccgaacgggcccagtccggtccttcccccgtggccgccctcgcctccgagggcgccaccgtcgagacgcgaccaggccggccgtggggctcggcctgactacgaacggtaccttacttcccactcctaacaccttacgtcggaacggccggggtactacggggaccgtaacggggtccgaccgtaagtttacgatcgactgacnnctntntcacnncgtcgcgcngcgcgncncannncgnngnnnn

SEQ ID NO: 294530 - DNA, 580 bp, Homo sapiens
  misc_feature: GYAE6OF01EL5ET.37.77.G11.1.454.CMB.1.raw
  modified_base (512)..(512): a, c, t, g, unknown or other
  misc_feature (512)..(512): n is a, c, g, or t
  modified_base (549)..(549): a, c, t, g, unknown or other
  misc_feature (549)..(549): n is a, c, g, or t
  modified_base (551)..(580): a, c, t, g, unknown or other
  misc_feature (551)..(580): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaacgggacctctacgccccttatagcagcggctggtcctggtactttgacgactgggaccagggaaccctggtcaccgtcctcctcacgccctccaccaacgggcccacgtccggtccttcccccgtcggtcccgtcccctcgcctcccgacggacgcccaccgtcccgagacgacacgacgcccgggacccgtcggggccttcggcccgtacggtaccgtaaacggtaacccgttacctttaccgaaccttcccgttaaactaacccttaccggtaggtacgggcccgggggttnaccggggacctaacggggcggtaccaagtcggatcgngnnnnnnnnnnnnnnnnnnnnnnnnnnnnnn

SEQ ID NO: 294531 - DNA, 487 bp, Homo sapiens
  misc_feature: GYAE6OF01A72AQ.37.77.G11.1.454.CMB.1.raw
  modified_base (467)..(487): a, c, t, g, unknown or other
  misc_feature (467)..(487): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgccctccaccgacgggcccagtccggtccttcccccgtggccgcccctgcctccgaggcgccaccgtccgagacgcacgagccggcccgtgggcgtcgccgtggtcaacggtacttactccatcctactactactgacgcgggctcgggcaacggcgacagtacgnnnnnnnnnnnnnnnnnnnnn

SEQ ID NO: 294532 - DNA, 524 bp, Homo sapiens
  misc_feature: GYAE6OF01DHNZU.37.77.G11.1.454.CMB.1.raw
  modified_base (381)..(381): a, c, t, g, unknown or other
  misc_feature (381)..(381): n is a, c, g, or t
  modified_base (478)..(478): a, c, t, g, unknown or other
  misc_feature (478)..(478): n is a, c, g, or t
  modified_base (504)..(524): a, c, t, g, unknown or other
  misc_feature (504)..(524): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggcttatattactgtgtgaagggacctctacgcccttatagcagcggctcggtcctggttactttgacgacgtggggccacgggaaccctggtccaccgtctccctcacgcctacccaccgaacgggcccctagtcccggttccctttcccccgtgggcccgtccccgtgccctccgacggacncccacccgtccgagacgcacgcggccgcccgtgggctcgccgtggtacgaagtcctaccttcgacttacctacactacgtaggcgggccgggtacgngggaccaagggtccgactagtacggnnnnnnnnnnnnnnnnnnnnn

SEQ ID NO: 294533 - DNA, 542 bp, Homo sapiens
  misc_feature: GYAE6OF01CS6FA.37.77.G11.1.454.CMB.1.raw
  modified_base (355)..(355): a, c, t, g, unknown or other
  misc_feature (355)..(355): n is a, c, g, or t
  modified_base (378)..(378): a, c, t, g, unknown or other
  misc_feature (378)..(378): n is a, c, g, or t
  modified_base (517)..(542): a, c, t, g, unknown or other
  misc_feature (517)..(542): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagagcactctgtatctgacaaatgaacagcctgagtgccgaggacacggcctatattattgtgagaaagtggtgggggggagtgggggctacgtccgtggtcgttttgactacgtggggccgagggcgtcccgtggtccgacccggtcctcctcacgtccctcccgaaccgaacgggccccagttcccggttcccttcccccgnggcccgccctgcctccgaggacnccacctccgagacgcacgacggcccggcccgtgggctcggccgtagggtaccaaacggtccttaccgttacccattcctaacctaaccgtcgtagggacggtccggggctacgggacgaacgggtccgacgtagtaggnnnnnnnnnnnnnnnnnnnnnnnnnn

SEQ ID NO: 294534 - DNA, 478 bp, Homo sapiens
  misc_feature: GYAE6OF01C62VD.37.77.G11.1.454.CMB.1.raw
  modified_base (364)..(364): a, c, t, g, unknown or other
  misc_feature (364)..(364): n is a, c, g, or t
  modified_base (460)..(460): a, c, t, g, unknown or other
  misc_feature (460)..(460): n is a, c, g, or t
  modified_base (464)..(478): a, c, t, g, unknown or other
  misc_feature (464)..(478): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaacccctggtccaccgtctcctcagcctccgaccaaggggccccagtccggtccttcccccgtggccgcccctgcctccaggacncacctccgagagcacacgcggcccgtgggcctggcctggtcaagggccttaccgttcccatcctacactacctgacgcgggctggcgtaaggcgantagnnnnnnnnnnnnnnn

SEQ ID NO: 294535 - DNA, 732 bp, Homo sapiens
  misc_feature: GYAE6OF01BPK22.37.77.G11.1.454.CMB.1.raw
  modified_base (692)..(692): a, c, t, g, unknown or other
  misc_feature (692)..(692): n is a, c, g, or t
  modified_base (698)..(698): a, c, t, g, unknown or other
  misc_feature (698)..(698): n is a, c, g, or t
  modified_base (702)..(702): a, c, t, g, unknown or other
  misc_feature (702)..(702): n is a, c, g, or t
  modified_base (704)..(704): a, c, t, g, unknown or other
  misc_feature (704)..(704): n is a, c, g, or t
  modified_base (707)..(708): a, c, t, g, unknown or other
  misc_feature (707)..(708): n is a, c, g, or t
  modified_base (711)..(711): a, c, t, g, unknown or other
  misc_feature (711)..(711): n is a, c, g, or t
  modified_base (713)..(718): a, c, t, g, unknown or other
  misc_feature (713)..(718): n is a, c, g, or t
  modified_base (720)..(732): a, c, t, g, unknown or other
  misc_feature (720)..(732): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggccttatattactgtgtaggaacggcctctacgtccccttatacgcaggcggtcgttcgggtcccttagggttaccttttggaccggtaaccggttcgggggacccgaaacgggggtaacccccgttcgggttccaacccggttccttcccctaccgaccggtcccctacccgaacccggaacggggtccccctaagttccccggggttcccctttccccccgtcgggccccgtccccgtcggtcccgtcccgaacgggacgtaccctaacccgtccggaacgaccggacaaccggacgggccccgggtccccggtacggggtcccgttacgggccccgtttacggggaaaccgtaaaccggggtaaccctttaacccggttacccaaccgttttacccgaaaccgtaacccgtttaacggtccggggtaaccggccgggggttaccgttaccggggaacggaaccggggttccacgttaaacggtacgctcngacgancgcncngcnncgncnnnnnncnnnnnnnnnnnnn

SEQ ID NO: 294536 - DNA, 673 bp, Homo sapiens
  misc_feature: GYAE6OF01EDU50.37.77.G11.1.454.CMB.1.raw
  modified_base (624)..(624): a, c, t, g, unknown or other
  misc_feature (624)..(624): n is a, c, g, or t
  modified_base (631)..(631): a, c, t, g, unknown or other
  misc_feature (631)..(631): n is a, c, g, or t
  modified_base (633)..(633): a, c, t, g, unknown or other
  misc_feature (633)..(633): n is a, c, g, or t
  modified_base (636)..(636): a, c, t, g, unknown or other
  misc_feature (636)..(636): n is a, c, g, or t
  modified_base (638)..(638): a, c, t, g, unknown or other
  misc_feature (638)..(638): n is a, c, g, or t
  modified_base (644)..(644): a, c, t, g, unknown or other
  misc_feature (644)..(644): n is a, c, g, or t
  modified_base (646)..(646): a, c, t, g, unknown or other
  misc_feature (646)..(646): n is a, c, g, or t
  modified_base (648)..(653): a, c, t, g, unknown or other
  misc_feature (648)..(653): n is a, c, g, or t
  modified_base (655)..(658): a, c, t, g, unknown or other
  misc_feature (655)..(658): n is a, c, g, or t
  modified_base (660)..(673): a, c, t, g, unknown or other
  misc_feature (660)..(673): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccgagggacaattccaagaacacactgtctctgacaaatcgaacacgcctgagcgtacgaaggaccacggtacctttaattacgttacgtggttaggtacggaacgggtacccttaccgtaacgtccccttttaagacgaccgacggtccggtcgttcgggttccgttacgggtttaccgttttacggaccgtacgggtcgggggtacccggaaacgggtaacccgttcgggtaccgtacccggtcctcccgtccaccgtcccgtaccgaaccggaccgggaccctaccgttccggttcccctccccgtacgccctaccccgtcccgtaacaacggaccgccgtaccgttcggcgggacctacggaccggtccggacccgtcggtaccgtcgtccggtacggtacgaaacgtaccctttcctacccgtacttaccctacctactaacgggcgtaccgggccggtcgttacggaccgtaacggccgtanacggtgncngcngncgacancncnnnnnngnnnngnnnnnnnnnnnnnn

SEQ ID NO: 294537 - DNA, 471 bp, Homo sapiens
  misc_feature: GYAE6OF01ALURB.37.77.G11.1.454.CMB.1.raw
  modified_base (454)..(454): a, c, t, g, unknown or other
  misc_feature (454)..(454): n is a, c, g, or t
  modified_base (460)..(471): a, c, t, g, unknown or other
  misc_feature (460)..(471): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcgctggtcctggtactttgacgactggggccagggaaccctggtccaccgtctcctcacgccctccaccgaacgggcccatccgggtcctttcccccgtggccgcccctgcctcccgaggacgccacctccgagacgcacgacggcggccctgggctcgccgttgcaaggtcctacttccatcctacactactgacgcgggctggcaggcncagtgnnnnnnnnnnnn

SEQ ID NO: 294538 - DNA, 607 bp, Homo sapiens
  misc_feature: GYAE6OF01CYWVZ.37.77.G11.1.454.CMB.1.raw
  modified_base (572)..(572): a, c, t, g, unknown or other
  misc_feature (572)..(572): n is a, c, g, or t
  modified_base (575)..(575): a, c, t, g, unknown or other
  misc_feature (575)..(575): n is a, c, g, or t
  modified_base (578)..(578): a, c, t, g, unknown or other
  misc_feature (578)..(578): n is a, c, g, or t
  modified_base (580)..(607): a, c, t, g, unknown or other
  misc_feature (580)..(607): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaaccctggtccaccgtctcctcacgtccctccgaaccgaacggggcccagtccggtaccctttcccccgtggcccgcccctgcctaccgagggtacgccaacccgtccgaacggacgacctaccgaacgggccggtccccgtaggggccctacggcccggttcgggttaaccgaaacgggtaacctttaccgtttcccctaaattcccgttaaacctaccgtttaaccgtacggtacggggtacccggggcgttacggggaaccgaaacggggcgaaccgtaacgttaacggncgngcngnnnnnnnnnnnnnnnnnnnnnnnnnnnn

SEQ ID NO: 294539 - DNA, 699 bp, Homo sapiens
  misc_feature: GYAE6OF01DT7LS.37.77.G11.1.454.CMB.1.raw
  modified_base (670)..(699): a, c, t, g, unknown or other
  misc_feature (670)..(699): n is a, c, g, or t
tcagtagtgtagatcacgaccggtgctcgatttagctagtcactcaaggggaaaggggctggagtgggtctcagctattaatgggaatggtgataccacatactacgcagactccgtgaagggccgttcacatctcagggacaatccaagaacacactgtctctgacaaatgaacagcctagagagtcggaaggacgaccggtcctttaattactttacgtggtaggtaggaacgggtaccttacgtaccgtaccctttaagacgacgacggtccggtcgttcgggttaccgttagggtttaccgttttcggaaccggtacgggtacgggggaccgtaaccggggtaacccgttcgggtcccgtacccggttcctcccgtaccgccgtcccctaaccccgaaccggtaaccgggtacccctaccggtttcccggttccccgtttcccccgtccgggcccctccccgttcgtccccgtacgaccgggaccgacccgtaccccgtaccggaacgaccgaccgaaccggccgggtccccgggtacccggtcgggtcccgtcgggtaccggttacggtaaccgaaccggttaccttaccgtttaccaacttacctaaccgtacgttacggtacgggcggtccggggctacgggacggtaacggccagtaagcgnnnnnnnnnnnnnnnnnnnnnnnnnnnnnn

SEQ ID NO: 294540 - DNA, 534 bp, Homo sapiens
  misc_feature: GYAE6OF01A8MH7.37.77.G11.1.454.CMB.1.raw
  modified_base (344)..(344): a, c, t, g, unknown or other
  misc_feature (344)..(344): n is a, c, g, or t
  modified_base (362)..(362): a, c, t, g, unknown or other
  misc_feature (362)..(362): n is a, c, g, or t
  modified_base (505)..(508): a, c, t, g, unknown or other
  misc_feature (505)..(508): n is a, c, g, or t
  modified_base (510)..(534): a, c, t, g, unknown or other
  misc_feature (510)..(534): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggccaggaccctggtcaccgtctcctcacgccctccaccgaacgggcccacgtccggtccttcccccgtgggccncccgtcgctccgaggacnccaccgtccgagacgcacgacgccggcccgtgggcctacgccgtggttaccaaagggtacccttacttccgaataccctaacacttacgtaggacgccggggtactacgggacaaagggtccggacctagtaagcacgtgacnnnngnnnnnnnnnnnnnnnnnnnnnnnnn

SEQ ID NO: 294541 - DNA, 793 bp, Homo sapiens
  misc_feature: GYAE6OF01EFF2N.37.77.G11.1.454.CMB.1.raw
  modified_base (742)..(742): a, c, t, g, unknown or other
  misc_feature (742)..(742): n is a, c, g, or t
  modified_base (750)..(750): a, c, t, g, unknown or other
  misc_feature (750)..(750): n is a, c, g, or t
  modified_base (763)..(793): a, c, t, g, unknown or other
  misc_feature (763)..(793): n is a, c, g, or t
tcagtagtgtagatcacgaccggtgctcgatttagctagtcactcaagggaaagggggcgtggagtggggtctcagctattaatgggaatggtgataccacatactacgcagactccgtgaagggccggttcacatctccgagggacacttacaagaacacactgtctctgacaaatagaacacgtccgaggagacggtcggaggaaccgaccggttccttattatttacgtggtagttaggaaccgggtacctcctaaccgttcccttaagtacgacgtacggccggtcggttcggtttaccgttacgggttttaccgttacgggaaccgtaccggggtaccggggggtacccggaaccggggttaacccccggttccggggtaacccttaccccggttacccttccccgtaacccggaccccggtaaccccctttaccccggaaacccggtaaccccggggtccccgttaacccggtttcccccggtttaccccccgtttcccccgggtcccggggtaccccgttcccccgttcggccccctaacgggaaccggcccggtaaccgtcccggacccggacggaccgacccggaaccgggttccgggccccgggttccgggtcggtacccggtaccgggtccgtttaaccgggacgttaaaccgggtacccttaacccggttaccctacgtaaccgttaacctaccgtacgggtacgccgggttacggaccggtacgggtanacccgggngtaccgagtaccnnnnnnnnnnnnnnnnnnnnnnnnnnnnnnn

SEQ ID NO: 294542 - DNA, 534 bp, Homo sapiens
  misc_feature: GYAE6OF01A414G.37.77.G11.1.454.CMB.1.raw
  modified_base (508)..(511): a, c, t, g, unknown or other
  misc_feature (508)..(511): n is a, c, g, or t
  modified_base (513)..(534): a, c, t, g, unknown or other
  misc_feature (513)..(534): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagccctccaccaagggcccatccggtccttcccccgtcggccgcccctcgcctcccgaggacgccaccgtccgagacgcgaaccacggccggccctcggggcctcggcccgttgggtaccgaaacggtaccttaccttcccgattccctaaccgtaccgttactggaacggccgggtctacgggccgaaacgggccgacaattacggannnncnnnnnnnnnnnnnnnnnnnnnn

SEQ ID NO: 294543 - DNA, 583 bp, Homo sapiens
  misc_feature: GYAE6OF01BN15V.37.77.G11.1.454.CMB.1.raw
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
  modified_base (557)..(557): a, c, t, g, unknown or other
  misc_feature (557)..(557): n is a, c, g, or t
  modified_base (559)..(561): a, c, t, g, unknown or other
  misc_feature (559)..(561): n is a, c, g, or t
  modified_base (563)..(583): a, c, t, g, unknown or other
  misc_feature (563)..(583): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggttactttgacgacgtggggccagggaaccctggtccaccgtcctcctcacgccctcccaccgaacgggccccagttccggtcccttccccccgtggccgtccccgtcgcctacccgaggacgccacccgtcccgaggacgccaaccgacggcccggccccgtcggggtcctccggtcccggtcggtaccgtaaaccgggtacccttacccgtttcccaaccgttacctaaccctaaccttaaccgtcggacgggcccgggtacggtacggacccggagggcccganaacggtacgngcgncnnncnnnnnnnnnnnnnnnnnnnnn

SEQ ID NO: 294544 - DNA, 586 bp, Homo sapiens
  misc_feature: GYAE6OF01D11U4.37.77.G11.1.454.CMB.1.raw
  modified_base (552)..(552): a, c, t, g, unknown or other
  misc_feature (552)..(552): n is a, c, g, or t
  modified_base (554)..(558): a, c, t, g, unknown or other
  misc_feature (554)..(558): n is a, c, g, or t
  modified_base (560)..(563): a, c, t, g, unknown or other
  misc_feature (560)..(563): n is a, c, g, or t
  modified_base (565)..(586): a, c, t, g, unknown or other
  misc_feature (565)..(586): n is a, c, g, or t
tcagtagtgtagatcacgaccggtgctcgatttagctagtcactcaaggggaaaggggctggagtggggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttaatgcagcggctggtcctggttactttgacgacgtggggccgacgggaacccgtggtccgacccgtctcctcacgccctaccaccgaacgggccctacgtccggttcccttcccccgtcggtcccacccctccctacccgaacgacgacctaccgtcggtcggggccacgacggccggtccgtcgggcctcgcccgtggtacgtaaacggtaccgttaccgtttaccacttacctaacctaccgttaacgtacggtaacgggtcccgggtacgtcggggtaaccgaaacgggtccggtaccgtaagtaggctgancnnnnngnnnngnnnnnnnnnnnnnnnnnnnnnn

SEQ ID NO: 294545 - DNA, 493 bp, Homo sapiens
  misc_feature: GYAE6OF01CEWSH.37.77.G11.1.454.CMB.1.raw
  modified_base (303)..(303): a, c, t, g, unknown or other
  misc_feature (303)..(303): n is a, c, g, or t
  modified_base (345)..(345): a, c, t, g, unknown or other
  misc_feature (345)..(345): n is a, c, g, or t
  modified_base (442)..(442): a, c, t, g, unknown or other
  misc_feature (442)..(442): n is a, c, g, or t
  modified_base (472)..(473): a, c, t, g, unknown or other
  misc_feature (472)..(473): n is a, c, g, or t
  modified_base (475)..(493): a, c, t, g, unknown or other
  misc_feature (475)..(493): n is a, c, g, or t
tcagtagtgtagatcacgaccggtgctcgatttagctagtcactcaagggaaaggggctggagtggggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaaccctggcaccgtctcctcacncctccaccgaacgggcccagtcggtcccttccccgcgggccnccctgcctccgagggcgccaccctccgagacgcacgacggccggcccgtgggcctggccgtgggtacaacggtaccttactccatcctactactacngacgcggggctgggacaaggcgacgatagnnannnnnnnnnnnnnnnnnnn

SEQ ID NO: 294546 - DNA, 469 bp, Homo sapiens
  misc_feature: GYAE6OF01EL90D.37.77.G11.1.454.CMB.1.raw
  modified_base (303)..(303): a, c, t, g, unknown or other
  misc_feature (303)..(303): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (362)..(362): a, c, t, g, unknown or other
  misc_feature (362)..(362): n is a, c, g, or t
  modified_base (378)..(378): a, c, t, g, unknown or other
  misc_feature (378)..(378): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (454)..(457): a, c, t, g, unknown or other
  misc_feature (454)..(457): n is a, c, g, or t
  modified_base (459)..(469): a, c, t, g, unknown or other
  misc_feature (459)..(469): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgttgaagggacctctacgccccttatagcagcggctcggtcctggttactttgacgcgtgggccacgggaccctggtccacgtctcctcncgcctaccaccgagggcccacgtccgtcctcccctggcccnccgtcncctcgcggtacncctacctacgagtacncacncgccgccgtggctcgcgtggtacacggtactctacatcctacnctacgtcgagcggtncgcgagcntacngnnnngnnnnnnnnnnn

SEQ ID NO: 294547 - DNA, 568 bp, Homo sapiens
  misc_feature: GYAE6OF01D1WXS.37.77.G11.1.454.CMB.1.raw
  modified_base (321)..(321): a, c, t, g, unknown or other
  misc_feature (321)..(321): n is a, c, g, or t
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (538)..(568): a, c, t, g, unknown or other
  misc_feature (538)..(568): n is a, c, g, or t
tcagtagtgtagatcacgaccggtgctcgatttagctagtcactcaaggggaaagggggctggagtgggtctcagctatttaatgggaatggtgataccacatactacgcagactccgtgaagggccggttcaccatctccagggacaattccaagaaacacactgtctctgcaaatgaacagctgagagtcgaggacacggcttatatactgtgtgaagggacctctacgccccttaatagccaggcggcgtggttcctaggttactttcggacgtacgtggggacccgacggaacccttgggtaccaccgtcctcctcncgccctaccaccgaacggcccacgtccggttcccttccccgtcggcctaccctccctacaaggtacnctaccgtcggtcggggaccncgaacggccggcccgtacgggtactcggccttagggacctaaacggtaaccttacttacctacttaccgtaacaccgttaagcggtaagggccgggtcgtagggaacgtaacgggcgtactacgtagcannnnnnnnnnnnnnnnnnnnnnnnnnnnnnn

SEQ ID NO: 294548 - DNA, 598 bp, Homo sapiens
  misc_feature: GYAE6OF01AUDPO.37.77.G11.1.454.CMB.1.raw
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (539)..(539): a, c, t, g, unknown or other
  misc_feature (539)..(539): n is a, c, g, or t
  modified_base (552)..(552): a, c, t, g, unknown or other
  misc_feature (552)..(552): n is a, c, g, or t
  modified_base (560)..(561): a, c, t, g, unknown or other
  misc_feature (560)..(561): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (590)..(591): a, c, t, g, unknown or other
  misc_feature (590)..(591): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (598)..(598): a, c, t, g, unknown or other
  misc_feature (598)..(598): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccgaacgggcccatccggtcttcccccgnggccgtcccgtgctccgagggacncaccgtccgaagacgcacgagcccgggccctggggctcggcccgtgggtaccaacgggtaaccttaccgtttcccgacttcctaaccgtacccttacgttacggtaacggccgggggtacttacggggaccgaaaccggggtcccggacccgtaaagttaacccgggatcgacgacgngacgacgcgcgcncgtcgcgnntcgngngcgctagactcgcgtacncncanncgngngn

SEQ ID NO: 294549 - DNA, 479 bp, Homo sapiens
  misc_feature: GYAE6OF01AMP9V.37.77.G11.1.454.CMB.1.raw
  modified_base (446)..(446): a, c, t, g, unknown or other
  misc_feature (446)..(446): n is a, c, g, or t
  modified_base (453)..(479): a, c, t, g, unknown or other
  misc_feature (453)..(479): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttgacgactggggccagggaccctggtcaccgtctcctcacgcctccaccaagggcccagtccggtccttcccccgtggccgcccctgcctccaggtagccaccgtccgagacgcacacgccggccctgggctcgcctggccaaggactacgttccatctacactatcgaggcggctggccgaaggcncatagcnnnnnnnnnnnnnnnnnnnnnnnnnnn

SEQ ID NO: 294550 - DNA, 557 bp, Homo sapiens
  misc_feature: GYAE6OF01B3TSJ.37.77.G11.1.454.CMB.1.raw
  modified_base (529)..(557): a, c, t, g, unknown or other
  misc_feature (529)..(557): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaaccctggtccaccgtctcctcacgccctccaccgaacgggcccatccggtccttccccctggcccgcccctgcctccgaggacgccacccgtccgagacgccacgacggccggccccgtggggcctcggcccgttcgggtaccgaaacgggtaccctttaccgtttcccaactttccctaacctaccttacgtggaacggtccggggctacgggaccgtaaacggggtccgaccgtaagtcggagctannnnnnnnnnnnnnnnnnnnnnnnnnnnn

SEQ ID NO: 294551 - DNA, 855 bp, Homo sapiens
  misc_feature: GYAE6OF01D9MQK.37.77.G11.1.454.CMB.1.raw
  modified_base (830)..(855): a, c, t, g, unknown or other
  misc_feature (830)..(855): n is a, c, g, or t
tcagtagtgtagatcacgaccggtgctcgatttagctagtcactcaagggaaaggggctggagtgggtctcagctattaatgggaatggtgataccacatactacgcagactccgtaggaggggccggttcaccatctccgagggacaattaccaagaacacactgtctctgacaaatgaacagccgtgaggagtcggaggacgaccggtaccttattacttactggtggtaggaacggggtaccctacgtaccgtccccctttaatacgaccgaggccgggtccgttcggggttaccgttacggggtttaaccttttacgggaaccggtaaccggttacggggggggaccccgaaaccggggggtaaacccccggtttcggggttacccgaacccccggtttccctccccgtttaccgaacccggtccccccgttacccccaaaccccgggtaaaccgggggaccccctaacggtttcccccgggttttcccccgtttccccccccggttcgggggcccccgtccccccgttcggtcccccgttacccggaaccggggaccgtccccgtaaacccccggttacccggaacggaccggacccgaaccggtaccgggggtcccccgggtcccccggggttcggggtacccgtttcccgggacccgggtttacgggggtaacccgtaaaaccggggttaacccctttacccgtttacccgtaacctttacccgttaaaccccgtaaccgttacccggtacgggtaaccggggccgggggttaccgttaccggggaaccggaacgggtcccggacgtaacgtagcgagcagcnnnnnnnnnnnnnnnnnnnnnnnnnn

SEQ ID NO: 294552 - DNA, 519 bp, Homo sapiens
  misc_feature: GYAE6OF01BTV91.37.77.G11.1.454.CMB.1.raw
  modified_base (237)..(237): a, c, t, g, unknown or other
  misc_feature (237)..(237): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (490)..(519): a, c, t, g, unknown or other
  misc_feature (490)..(519): n is a, c, g, or t
tcagtagtgtagatcacgaccggtgctcgatttagctagtcactcaaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaaggacctctacgcccttanagcagcgctggtcctggtactttgacgacgtggggccagggaaccctggtcaccgtctcctcacgccctccaccgaacggccacgtccggtccttcccccgtggccgcccctgcctaccgagacgcaccgtcgagacgcacacgccggcccgtgggtactcggcctacggtccaacgggtacctacttccattcctaactactacgtacgacggccgggtctacgggacaacgggcgtacgagtagngntacnnnnnnnnnnnnnnnnnnnnnnnnnnnnnn

SEQ ID NO: 294553 - DNA, 551 bp, Homo sapiens
  misc_feature: GYAE6OF01BUBNY.37.77.G11.1.454.CMB.1.raw
  modified_base (319)..(319): a, c, t, g, unknown or other
  misc_feature (319)..(319): n is a, c, g, or t
  modified_base (528)..(528): a, c, t, g, unknown or other
  misc_feature (528)..(528): n is a, c, g, or t
  modified_base (532)..(551): a, c, t, g, unknown or other
  misc_feature (532)..(551): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggccttaatattactgtgtaggaacgggacctctacgtccccttaatagcaggcggctggtccgtggttactttgacgacggtcggggaccacgggaaccctggtccaccgtcctcctccncgtccctacccaccgaacgggcccctacgttccggtccccttcccccggtggccccgtcccgtgccctaccgacggcgaccctaccgtccggagacgacacgacgcccggccggtggccctacgccgtaggtaccgtaaacggaccttacgttaccacttaccgtacctacctacgtaggaccggcgggacgcggacgagggcacgtanagcnnnnnnnnnnnnnnnnnnnn

SEQ ID NO: 294554 - DNA, 616 bp, Homo sapiens
  misc_feature: GYAE6OF01C43DG.37.77.G11.1.454.CMB.1.raw
  modified_base (587)..(588): a, c, t, g, unknown or other
  misc_feature (587)..(588): n is a, c, g, or t
  modified_base (590)..(616): a, c, t, g, unknown or other
  misc_feature (590)..(616): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcggaggacacggtccttagtattactgtaacaaaagtggaccgtaaggatatgtactacgttagttacgggacttagggtacttcgtactccgtcggtcgggtccggtcggcctacccggttcggtccgtacgttcgtcctcctaccgaccgtaccccgtaccgaacccggaaccgggtcccctaccggttcccggttccccgtttcccccgtcggtccccgtcccgtccgtaccgtccggacggaccgaccgtacccgtaccggaacgacgaccgacggccggcccggtccggtcgggccgtcggtaccggtacggtaacgtaacggtacccttacctaccgtactacctaactacgtacgcggtacggtcgggtcgacggacggacggcgacgtagnncnnnnnnnnnnnnnnnnnnnnnnnnnnn

SEQ ID NO: 294555 - DNA, 500 bp, Homo sapiens
  misc_feature: GYAE6OF01E4747.37.77.G11.1.454.CMB.1.raw
  modified_base (482)..(482): a, c, t, g, unknown or other
  misc_feature (482)..(482): n is a, c, g, or t
  modified_base (485)..(500): a, c, t, g, unknown or other
  misc_feature (485)..(500): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcacccgtctcctcacgccctccaccaacggcccatccggttccttcccccctgggcccgcccctcgcctcccgacggacgccacccgtcccgaggacgcaaccgacggccgggccccgtggggcctcggccctgggtacaacgggtacctaccttccactctacactactgacgcgggcgtggacgaaggcgcanagnnnnnnnnnnnnnnnn

SEQ ID NO: 294556 - DNA, 562 bp, Homo sapiens
  misc_feature: GYAE6OF01C2X9C.37.77.G11.1.454.CMB.1.raw
  modified_base (533)..(562): a, c, t, g, unknown or other
  misc_feature (533)..(562): n is a, c, g, or t
tcagtagtgtagatcacgaccggtgctcgatttagctagtcactcaaggggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtctggtactttgacgacgtggggccaacgggaacccctggtccaccgtcctcctcacgccctccgaaccaacgggcccctagtcccggttccctttccccccgtgggcccgcccctcgcctccgacgggcgccacccgtcgaacgcgccgacgtacggcggtccccgtgggcctcggtccgtcggtaccgaaacgggtccttaccgttacctaacttccttaactaccttacgtggacggtccggggtcgtcgggacgaacgggtccgactagtaggcagnnnnnnnnnnnnnnnnnnnnnnnnnnnnnn

SEQ ID NO: 294557 - DNA, 547 bp, Homo sapiens
  misc_feature: GYAE6OF01DHU7T.37.77.G11.1.454.CMB.1.raw
  modified_base (184)..(184): a, c, t, g, unknown or other
  misc_feature (184)..(184): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (514)..(515): a, c, t, g, unknown or other
  misc_feature (514)..(515): n is a, c, g, or t
  modified_base (517)..(547): a, c, t, g, unknown or other
  misc_feature (517)..(547): n is a, c, g, or t
tcagtagtgtagatcacgaccggtgctcgatttagctagtcactcaagggaaaggggctgggagtgggtctcagctattaatgggaatggtgataccacatactacgcagactccgtgaagggccggttcaccatctccagggacaattccaagaacacactgtctctgcaaatgaacagctgngagtcgaggacacggtccttatattactgtgtagaagggcctctacgccccttatacgcagcggctggtcctggtactttgacgacgtcggggaccacgggaaccctggtccaccgtcctcctcacgtccctccaaccgaacgggccccagttccggtccttcccccgtggcccgccccttcgctcccgaaggcncctaccnccggagacgcccacgacggccggtcccgtggccttcggccgtggtaacaacggtaccttacttcccaatccgtaacctaccgtagtggaacgccgggcgtacgggacaacgggcgtacaagttacggnngnnnnnnnnnnnnnnnnnnnnnnnnnnnnnnn

SEQ ID NO: 294558 - DNA, 600 bp, Homo sapiens
  misc_feature: GYAE6OF01C560T.37.77.G11.1.454.CMB.1.raw
  modified_base (238)..(238): a, c, t, g, unknown or other
  misc_feature (238)..(238): n is a, c, g, or t
  modified_base (566)..(568): a, c, t, g, unknown or other
  misc_feature (566)..(568): n is a, c, g, or t
  modified_base (570)..(573): a, c, t, g, unknown or other
  misc_feature (570)..(573): n is a, c, g, or t
  modified_base (576)..(576): a, c, t, g, unknown or other
  misc_feature (576)..(576): n is a, c, g, or t
  modified_base (578)..(588): a, c, t, g, unknown or other
  misc_feature (578)..(588): n is a, c, g, or t
  modified_base (590)..(600): a, c, t, g, unknown or other
  misc_feature (590)..(600): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaaatgaacagcctgagagtcgaggacacggcttatattactgtgtagaagggacctctacgcccttanagcagcggctggtccgtgtacttttgaccgtacgtcggggaccacgggaacccgttgggtaccaccggttcctcctccaacgtccctaccaccgtaacgggcccctaggttcccggttcccttaccccggtgggaccctccccgtcgggtccctccccgaagggtaccgcctaacctcggaacggacacgaccggtaccggcccgggccgtgggtcccgtcgtaccgtcggtacgtaaaccggtacctttactaccctacgtacctaaacctactaacgtcggtaacggcgggtacgtcggaccgaagggaccgacgattacgcgtcnnncnnnncgntnnnnnnnnnnngnnnnnnnnnnn

SEQ ID NO: 294559 - DNA, 740 bp, Homo sapiens
  misc_feature: GYAE6OF01B1RUH.37.77.G11.1.454.CMB.1.raw
  modified_base (686)..(686): a, c, t, g, unknown or other
  misc_feature (686)..(686): n is a, c, g, or t
  modified_base (696)..(697): a, c, t, g, unknown or other
  misc_feature (696)..(697): n is a, c, g, or t
  modified_base (706)..(706): a, c, t, g, unknown or other
  misc_feature (706)..(706): n is a, c, g, or t
  modified_base (710)..(710): a, c, t, g, unknown or other
  misc_feature (710)..(710): n is a, c, g, or t
  modified_base (712)..(713): a, c, t, g, unknown or other
  misc_feature (712)..(713): n is a, c, g, or t
  modified_base (715)..(715): a, c, t, g, unknown or other
  misc_feature (715)..(715): n is a, c, g, or t
  modified_base (719)..(723): a, c, t, g, unknown or other
  misc_feature (719)..(723): n is a, c, g, or t
  modified_base (726)..(731): a, c, t, g, unknown or other
  misc_feature (726)..(731): n is a, c, g, or t
  modified_base (733)..(735): a, c, t, g, unknown or other
  misc_feature (733)..(735): n is a, c, g, or t
  modified_base (737)..(737): a, c, t, g, unknown or other
  misc_feature (737)..(737): n is a, c, g, or t
  modified_base (739)..(740): a, c, t, g, unknown or other
  misc_feature (739)..(740): n is a, c, g, or t
tcagtagtgtagatcacgaccggtgctcgatttagctagtcactcaagggaaaggggctggagtgggtctcagctattaagtgggaatggtgataccacatactacgcagactccgtgaaggccggttcaccatctccagggacaattccaagaacacactgtctctgcaaatgaacagcctgagagtcgaggacacggccttatatttacgtgtgtacgaagggaccttacgtacgacccctttaagtacggaccgaggccgggtctcgggttccgttacgggttaacgttttcggaaccggtaaccggttcggggggaccccgtaacggggtaaacccccgttggggtttaccaaccccgggtttacccttcccttccgaaacgggtcccctaccccgaacccggtaaaaccggggcccctaacggtttccccggtttcccgtttccccccgcgggtaccccgtccccgtttaccggccttccccgaacggggtaaccggcccaccccgttaccggaacggacgacccgaaccgttacgggcccggcccgtacgggggctaccggtcccgtggttaacccgaaggtaccttaacccgtttacacgttaccctaccgttacccgttaactccgggtaacggtacccgggcgtttaccggacggtaaaacgggtccgaaccgttanaaccgggtgnngacgagacncgcncnngncgcnnnnngcnnnnnngnnncngnn

SEQ ID NO: 294560 - DNA, 557 bp, Homo sapiens
  misc_feature: GYAE6OF01ENCW5.37.77.G11.1.454.CMB.1.raw
  modified_base (263)..(263): a, c, t, g, unknown or other
  misc_feature (263)..(263): n is a, c, g, or t
  modified_base (531)..(531): a, c, t, g, unknown or other
  misc_feature (531)..(531): n is a, c, g, or t
  modified_base (533)..(557): a, c, t, g, unknown or other
  misc_feature (533)..(557): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagaggtcgaggacacggccttatattactgtgcgagaacggtagcgggtcgtcgagggggaatctttactattatactanatggacgtcgtggggacaaacgggaccgtacggtccgaccgtccttcctcacgccctacccgaccgtaaccgggccctacgttcccgggtccctttccccccgtcgggaccctaccccttccctacccgaaacggtacgcctacccgtcggtcgggggacaccggacggccggcccgtggccgtcgccgtcggtacgaacgtacctacgttaccagttactacgacgttagtggacggcggacggtggaccgaaggtcgacgatacgngnnnnnnnnnnnnnnnnnnnnnnnnn

SEQ ID NO: 294561 - DNA, 558 bp, Homo sapiens
  misc_feature: GYAE6OF01DRDFW.37.77.G11.1.454.CMB.1.raw
  modified_base (237)..(237): a, c, t, g, unknown or other
  misc_feature (237)..(237): n is a, c, g, or t
  modified_base (529)..(558): a, c, t, g, unknown or other
  misc_feature (529)..(558): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatatactgtgtgaagggacctctacgccccttanagcaggcggtctggtcctggtactttgacgacgtggggccaggaaccctggtcaccgtctctcacgccctcaccgaagggcccatccggtccttccccgtggccgcccgtcgctccgaggacgcctacctccgagacgacaccgaggcccggcccgtggggtcctacggccgttagggtaccgtaaacgggacctttaccgttaccccaagtttccccttaaaccgaccttaacggtacggaacggtcgggggtacgtacgggtccgaaacggggtccgacgtagttaacgnnnnnnnnnnnnnnnnnnnnnnnnnnnnnn

SEQ ID NO: 294562 - DNA, 444 bp, Homo sapiens
  misc_feature: GYAE6OF01A634W.37.77.G11.1.454.CMB.1.raw
  modified_base (435)..(444): a, c, t, g, unknown or other
  misc_feature (435)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagactgagagtcgaggacacggccttatattactgtgtgaaggggacctctagccccttatagcagcggctggtcctggtactttgacgactggggccagggaaccctggtcaccgtctcctcagcctccaccaaggcccatcggtcttccccctggccgccctgctccaggacgcacctccgagacgcacagcggccctggctgcctggtcaggactactcatctacactactgagcgggctggcaaggcgcatagnnnnnnnnnn

SEQ ID NO: 294563 - DNA, 486 bp, Homo sapiens
  misc_feature: GYAE6OF01DHG3Y.37.77.G11.1.454.CMB.1.raw
  modified_base (441)..(441): a, c, t, g, unknown or other
  misc_feature (441)..(441): n is a, c, g, or t
  modified_base (450)..(450): a, c, t, g, unknown or other
  misc_feature (450)..(450): n is a, c, g, or t
  modified_base (456)..(486): a, c, t, g, unknown or other
  misc_feature (456)..(486): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagcgaggacacggccttatattactgtgtgaagggacctctagccccttataagcagcggctggtcctggttacctttgacgacgtcggggcaacggaacccgtggtcaccgtctcctcaggccctaccaaccgaacgggcccagtccggtcccttcccccgtggccgccctgctccgaggacgcacctcgagagcacacgcgccctggctcgcgtggtacaaaggactacgttccatctaagactagtgagcggntgacaggcnagtcannnnnnnnnnnnnnnnnnnnnnnnnnnnnnn

SEQ ID NO: 294564 - DNA, 568 bp, Homo sapiens
  misc_feature: GYAE6OF01CBY1C.37.77.G11.1.454.CMB.1.raw
  modified_base (294)..(294): a, c, t, g, unknown or other
  misc_feature (294)..(294): n is a, c, g, or t
  modified_base (524)..(524): a, c, t, g, unknown or other
  misc_feature (524)..(524): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (533)..(535): a, c, t, g, unknown or other
  misc_feature (533)..(535): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(546): a, c, t, g, unknown or other
  misc_feature (544)..(546): n is a, c, g, or t
  modified_base (548)..(550): a, c, t, g, unknown or other
  misc_feature (548)..(550): n is a, c, g, or t
  modified_base (552)..(559): a, c, t, g, unknown or other
  misc_feature (552)..(559): n is a, c, g, or t
  modified_base (561)..(565): a, c, t, g, unknown or other
  misc_feature (561)..(565): n is a, c, g, or t
  modified_base (567)..(568): a, c, t, g, unknown or other
  misc_feature (567)..(568): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaacgggacctctacgccccttatagcagcggctggtcctggtctttgacgactgggcagggaacctggcaccgtctcncacgcctccacgacggcccactcggtccttccccgtggccgtcccgtcgccgttccgaacggacgccaccgtccgagacgacgacgacggcccggacccgtcgggtcctcgtccgtacggtaccgaaacgggtaccttaccgttacctacgttaccctaacctaaccttaccggtaggaccggccggggtccgtacgggaccgaaacgggtccggaccgtaagtaacggngancgngcnnngtgcncngnnngnnngnnnnnnnngnnnnngnn

SEQ ID NO: 294565 - DNA, 544 bp, Homo sapiens
  misc_feature: GYAE6OF01CNQ97.37.77.G11.1.454.CMB.1.raw
  modified_base (314)..(314): a, c, t, g, unknown or other
  misc_feature (314)..(314): n is a, c, g, or t
  modified_base (374)..(374): a, c, t, g, unknown or other
  misc_feature (374)..(374): n is a, c, g, or t
  modified_base (507)..(507): a, c, t, g, unknown or other
  misc_feature (507)..(507): n is a, c, g, or t
  modified_base (513)..(544): a, c, t, g, unknown or other
  misc_feature (513)..(544): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggtccttatattactgtgtagaagggacctctacgtccccttatacgcgaggcggctggtccttggtactttgacgacgtcggggccacgggaccgtggtccaccgtctcctcacncccaccaccgacggcccagtccgtccctccccgtggccgtcccgtcgcctccgaggaccnccacccgtacgacgacgccacgacggcccggtcccgtcgggactcggccgtcgggtaccaacggtaccttacccttcgtaacttcctaaccacttacgtcgcggccgggtacgtcgggacgaacgggcccganagtagnnnnnnnnnnnnnnnnnnnnnnnnnnnnnnnn

SEQ ID NO: 294566 - DNA, 549 bp, Homo sapiens
  misc_feature: GYAE6OF01BGTTP.37.77.G11.1.454.CMB.1.raw
  modified_base (383)..(383): a, c, t, g, unknown or other
  misc_feature (383)..(383): n is a, c, g, or t
  modified_base (528)..(549): a, c, t, g, unknown or other
  misc_feature (528)..(549): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgtccccttaatagccagcggcttcggtcctggtactttgacgtacgtgggggccgagggaaccctggtcgacccgtctccctcacgccctccgacccaacgggccccatcccggttcccttcccccgtcggcccgcccctcgcctcgacggacnccaccgtccggagacgcgacgacggcccggtcccgtcgggcctcggtccgttcgggtactaaaccggtaccttaccttacccgtacttacctaaccgaccttacggttgacgggtccgggctacgggcaacgggcactaagtgcnnnnnnnnnnnnnnnnnnnnnn

SEQ ID NO: 294567 - DNA, 616 bp, Homo sapiens
  misc_feature: GYAE6OF01DKIUK.37.77.G11.1.454.CMB.1.raw
  modified_base (211)..(211): a, c, t, g, unknown or other
  misc_feature (211)..(211): n is a, c, g, or t
  modified_base (543)..(543): a, c, t, g, unknown or other
  misc_feature (543)..(543): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (572)..(572): a, c, t, g, unknown or other
  misc_feature (572)..(572): n is a, c, g, or t
  modified_base (576)..(576): a, c, t, g, unknown or other
  misc_feature (576)..(576): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattacngtacgaaaatggcctacggatatgactactattgggactggtacttcgatcgtcgtggggccgtggccacccgttggtcacgtcgtctcctcagtcctccaaccgaacggcccagttccggtcctttcccccgtgggccgcccctgcctccgaggacgccaccgtccgaagacgaccgacgtacggccggcccgtggggtcccttggccccgttacgggtacaaaccgggtacccttaccgtttacccacgttaccttaaccgtaaccgttacgttgggaacgggtccggggtcgttacggggaccgaaacggggtccgaccgtagtacggnacgtcgctncgngtcgtctacgtcgtacngtcncgcgcgcgcgacacgctcgtcacgtacacagctgtcgtcg

SEQ ID NO: 294568 - DNA, 480 bp, Homo sapiens
  misc_feature: GYAE6OF01ASFC0.37.77.G11.1.454.CMB.1.raw
  modified_base (349)..(349): a, c, t, g, unknown or other
  misc_feature (349)..(349): n is a, c, g, or t
  modified_base (459)..(459): a, c, t, g, unknown or other
  misc_feature (459)..(459): n is a, c, g, or t
  modified_base (465)..(480): a, c, t, g, unknown or other
  misc_feature (465)..(480): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttgacgacgtggggccgagggaaccctggtcaccgtctccctcacgccctccaaccgacgggcccacgtccggttccttcccccgtggccncccctcgcctccgaggacgcacccgtccgagacgcacgacgccggcccgtggctgccgtggtacaggacttacctccatccacactacgtgcgtcggctcggagacggcncgatgnnnnnnnnnnnnnnnn

SEQ ID NO: 294569 - DNA, 635 bp, Homo sapiens
  misc_feature: GYAE6OF01COCMC.37.77.G11.1.454.CMB.1.raw
  modified_base (349)..(349): a, c, t, g, unknown or other
  misc_feature (349)..(349): n is a, c, g, or t
  modified_base (434)..(434): a, c, t, g, unknown or other
  misc_feature (434)..(434): n is a, c, g, or t
  modified_base (609)..(635): a, c, t, g, unknown or other
  misc_feature (609)..(635): n is a, c, g, or t
tcagtagtgtagatcacgaccggtgctcgatttagctagtcactcaagggaaaggggctggagtgggtctcagctattaatgggaatggtgataccacatactacgcagactccgtgaacggggccggttcaccatctccgagggacaattacaagaacacactgtctcgtgacaaatggaacagcctggagagtacggaggacgaccggtccttaattattacgtgtgtagaacgggtacctctaccgtcccttagtagcgacgcggtcgtcggttccgttggtactttcggacgtacggtcggggaccgaacgggtaacccgtcggtccgtaccgtccttaccgtcnccgtccctaccgaaccgaacgggccctacgttcccggttccccttcccccggcggcccgtcccctcggtccctccggacggaccnccgtaccgttcgggaccggggccaaccggcggtcccgggcccggttccgggcttaccgggtcccgttacggggaaccgtaacgggttaccttaccgtttaccctacttaccgtaacccttaccgtacgttacgggcggtccggtcggtccggaacgggtacgcgtaacagtacgnnnnnnnnnnnnnnnnnnnnnnnnnnn

SEQ ID NO: 294570 - DNA, 559 bp, Homo sapiens
  misc_feature: GYAE6OF01BS5JG.37.77.G11.1.454.CMB.1.raw
  modified_base (520)..(520): a, c, t, g, unknown or other
  misc_feature (520)..(520): n is a, c, g, or t
  modified_base (524)..(524): a, c, t, g, unknown or other
  misc_feature (524)..(524): n is a, c, g, or t
  modified_base (529)..(529): a, c, t, g, unknown or other
  misc_feature (529)..(529): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
  modified_base (538)..(559): a, c, t, g, unknown or other
  misc_feature (538)..(559): n is a, c, g, or t
tcagtagtgtagatcacgaccggtgctcgatttagctagtcactcaagggaaggggctggagtgggtctcagctattaattggaatggtgataccacatactacgcagactccgtgaagggccggttcaccatctccagggacaattccaagaacacactgtctctgcaaatgaacagcctgagagtcgaggacacggccttatattactgtgtgaagggacctctacgtccccttatagcaggcggctggtcctggtctttgacgacgtggggccagggacccgtggtaccaccgtctcctcacgcctccaccgaaggccccatccggtccttccccctgggccctcccctgcctaccgacggacgccaccgtccgagacgcaccgtacgcccggtcccgtgggcctacgccgtcggtacaaaccgggtaccttaccgtttcctaacgttaccgtaacctaccgttacctggaccgggtaccgggcttacggggacgaacgggtccacgtaacgtacgntcanagtcngnangatcnnnnnnnnnnnnnnnnnnnnnn

SEQ ID NO: 294571 - DNA, 533 bp, Homo sapiens
  misc_feature: GYAE6OF01EDXH7.37.77.G11.1.454.CMB.1.raw
  modified_base (415)..(415): a, c, t, g, unknown or other
  misc_feature (415)..(415): n is a, c, g, or t
  modified_base (461)..(461): a, c, t, g, unknown or other
  misc_feature (461)..(461): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (509)..(533): a, c, t, g, unknown or other
  misc_feature (509)..(533): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaatgaacagcctgagagtcgaggacacggccttaatattacgtgtggtagaacgggacctctacggcccctttatagcagcggctggtccttggttactttagacgtacggtcggggaccgagggtaacccctggtccaccgttcctcctcacgccctaccgaaccgaacggggtcccacgttcccggtacccttcccccggtcggcccgtcccgtcggcctccgagacgcctacccgtcgacgcncgagacggccggccgtcgggctcgcgtcgtacaacggtctactccncgtactacactacgngaccggngggcgtcgggacgacggactcagagnnnnnnnnnnnnnnnnnnnnnnnnn

SEQ ID NO: 294572 - DNA, 543 bp, Homo sapiens
  misc_feature: GYAE6OF01AHWA0.37.77.G11.1.454.CMB.1.raw
  modified_base (508)..(508): a, c, t, g, unknown or other
  misc_feature (508)..(508): n is a, c, g, or t
  modified_base (511)..(511): a, c, t, g, unknown or other
  misc_feature (511)..(511): n is a, c, g, or t
  modified_base (515)..(543): a, c, t, g, unknown or other
  misc_feature (515)..(543): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctacgccccttatacgcagcggctggtcctggttacttgacgacgtggggccagggaacctggtccaccgtctcctcacgccctccaccgaacgggcccagtccggttccttcccccgtggcccgtccccgtcgcctaccgacggacgaccgaccgtccgagacgcacacggccggccgtcgggacctcggcctcggtaccaacgggtacctaccttccgtactcctaacaccgttacgtggtaacgggcggcgtacggaccgaaagggtccacgtagacgtncancgtnnnnnnnnnnnnnnnnnnnnnnnnnnnnn

SEQ ID NO: 294573 - DNA, 475 bp, Homo sapiens
  misc_feature: GYAE6OF01E3502.37.77.G11.1.454.CMB.1.raw
  modified_base (298)..(298): a, c, t, g, unknown or other
  misc_feature (298)..(298): n is a, c, g, or t
  modified_base (441)..(441): a, c, t, g, unknown or other
  misc_feature (441)..(441): n is a, c, g, or t
  modified_base (443)..(445): a, c, t, g, unknown or other
  misc_feature (443)..(445): n is a, c, g, or t
  modified_base (447)..(448): a, c, t, g, unknown or other
  misc_feature (447)..(448): n is a, c, g, or t
  modified_base (450)..(451): a, c, t, g, unknown or other
  misc_feature (450)..(451): n is a, c, g, or t
  modified_base (455)..(475): a, c, t, g, unknown or other
  misc_feature (455)..(475): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccctttatagcagcggctggtcctggtacttttgacgactgggggccagggaaccctggtcaccgtntcctcagcctccaccaagggcccatcggtcttccccctggcgcccctgctccaggagcacctccgagagcacagcggccctgggctgcctggtcaaggactacttccatctacactactgagcgggctggcaaggcgcatagncnnnanntnntcannnnnnnnnnnnnnnnnnnnn

SEQ ID NO: 294574 - DNA, 485 bp, Homo sapiens
  misc_feature: GYAE6OF01A7O69.37.77.G11.1.454.CMB.1.raw
  modified_base (468)..(485): a, c, t, g, unknown or other
  misc_feature (468)..(485): n is a, c, g, or t
tcagtagtgtagatcacgaccggtgctcgatttagctagtcactcaagggaaaggggctggagtgggtctcagctattaatgggaatggtgataccacatactacgcagactccgtgaatggccggttcaccatctccagggacaattccaagaacacactgtctctgcaaatgaacagcctgagagtcgaggacacggccttatattactgtgtgaagggcctctagccccttatagcagcggctggtcctggtactttgacgactggggccagggaaccctggtcaccgtctcctcacgcctccaccacgggcccatccggtccttccccctggccgccctgctccaggcgccaccgtccgagagaccaccagccgggcccgtggggcctggccgtgggtaccaacgggtaccttaccttccgactcctaccactactgacggcgggctgggcaaggcgacagtgnnnnnnnnnnnnnnnnnn

SEQ ID NO: 294575 - DNA, 552 bp, Homo sapiens
  misc_feature: GYAE6OF01DQ55P.37.77.G11.1.454.CMB.1.raw
  modified_base (514)..(514): a, c, t, g, unknown or other
  misc_feature (514)..(514): n is a, c, g, or t
  modified_base (524)..(552): a, c, t, g, unknown or other
  misc_feature (524)..(552): n is a, c, g, or t
tcagtagtgtagatcacgaccggtgctcgatttagctagtcactcaagggaaagggggctgggagtgggtctcagctattaatgggaatggtgataccacatactacgcagactccgtgaagggccggttcaccatctccaggggacaattccaagaacacactgtctctgcaaatgaacagcctgagagtcgaggacacggccttatattactgtgtggaagggacctctagccccttatagcagcggctggtcctggttactttgacgacgtggggccacgggtaaccctgggtccaccggtctcctccacgcctccaccgaagggccctagtccggtccttcccccgtggccgcccctgcctaccgacggacgtaccaccgtccgagacgcacgacgccggtcccgtggcctcggccccgttagggtaccaaacgggacctttaccgtacctaactacccgttaacctaccttacgtacggacgggaccggggtctcgggaccgaaggccnggaactggcnnnnnnnnnnnnnnnnnnnnnnnnnnnnn

SEQ ID NO: 294576 - DNA, 623 bp, Homo sapiens
  misc_feature: GYAE6OF01B96SG.37.77.G11.1.454.CMB.1.raw
  modified_base (343)..(343): a, c, t, g, unknown or other
  misc_feature (343)..(343): n is a, c, g, or t
  modified_base (543)..(543): a, c, t, g, unknown or other
  misc_feature (543)..(543): n is a, c, g, or t
  modified_base (548)..(548): a, c, t, g, unknown or other
  misc_feature (548)..(548): n is a, c, g, or t
  modified_base (570)..(570): a, c, t, g, unknown or other
  misc_feature (570)..(570): n is a, c, g, or t
  modified_base (577)..(577): a, c, t, g, unknown or other
  misc_feature (577)..(577): n is a, c, g, or t
  modified_base (615)..(615): a, c, t, g, unknown or other
  misc_feature (615)..(615): n is a, c, g, or t
tcagtagtgtagatcacgaccggtgctcgatttagctagtcactcaagggaaaggggctggagtgggtctcagctattaatgggaatggtgataccacatactacgcagactccgtgaaggccggttcaccatctccagggacaattccaagaacacactgtctctgcaaatgaacagcctgagagtcgaggacacggccttatatactgtgtgaacggactctacgccccttatagcagcgctggtcctggtactttcgacgtacgtgggcacgggaacctggtctaccgtctcctcacgcctccaccgaacggcccagtccgtctccccgtgccgtcctcncctcgagacgcacctcgagacgcgactacgccggacccgttggacccgttcgacccgttcggtacgtaacggtaaccgttaacgttaccccgtaacgttaccgtaacccttaacgttaccggttacggaaccgggtcccggggttaccgttaggggaacccgaaagggttcccggaaccgttagaaccgtgtaacgccgngactncgactacgactcgtacgcgcgngtcgacncgtacgtcgtagcgtacgtacgtacgtactacgtaganctgcgtcg

SEQ ID NO: 294577 - DNA, 534 bp, Homo sapiens
  misc_feature: GYAE6OF01A435B.37.77.G11.1.454.CMB.1.raw
  modified_base (509)..(534): a, c, t, g, unknown or other
  misc_feature (509)..(534): n is a, c, g, or t
tcagtagtgtagatcacgaccggtgctcgatttagctagtcactcgaagggaaaggggctggagtgggtctcagctattaagtgggaatggtgataccacatactacgcagactccgtgaagggccggttcaccatctccagggacaattccaagaacacactgtctctgcaaatgaacagcctgagagtccggagacgacggccttatattacgtgtggtagaagggacctcgtacgtccccttaatagacgaggcgtcgtcggtccgtggttactttggacggtacgtcggggaccgtacgggaacctcgggtctaccgtctcctcgaccggccctccaaccgacgggcccacgttccggtccttcccccgtcggccgcccctgcctccgagcgcctaccgcgagcgcacgacgccgtccgcggctacgctcggtcaacgggcttaccgtctataccgtacacgttagcggacggtcgggcctacggacgaacggctacagtagcannnnnnnnnnnnnnnnnnnnnnnnnn

SEQ ID NO: 294578 - DNA, 635 bp, Homo sapiens
  misc_feature: GYAE6OF01EYUYZ.37.77.G11.1.454.CMB.1.raw
  modified_base (182)..(182): a, c, t, g, unknown or other
  misc_feature (182)..(182): n is a, c, g, or t
  modified_base (190)..(190): a, c, t, g, unknown or other
  misc_feature (190)..(190): n is a, c, g, or t
  modified_base (207)..(207): a, c, t, g, unknown or other
  misc_feature (207)..(207): n is a, c, g, or t
  modified_base (597)..(598): a, c, t, g, unknown or other
  misc_feature (597)..(598): n is a, c, g, or t
  modified_base (601)..(602): a, c, t, g, unknown or other
  misc_feature (601)..(602): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(635): a, c, t, g, unknown or other
  misc_feature (609)..(635): n is a, c, g, or t
tcagtagtgtagatcacgaccggtgctcgattttagctagtcactcaagggaaagggggctggagtgggtctcagctattaatgggaatggtgataccacatactacgcagactccgtgaagggccggttcaccatctccagggacaattcccaagaacacactgtcctctgcaaatgaacngcctgagngtcgagcaccggccctntattctgtgcgagagatcaggacgggatagtagcaggcacgctctcggacgtacgtcgggaccgaaccggtaccgtcggtacctaccgtcctcccgtacaccgcccttacccgaaccggaccgggtaccctaccgttcccggtttaccccgtttccccccgtcgggtacccctacccccgtcccctaaccgtaaaccgtaccggacccgtacccgtaccggggtccggggaccgtaacggtacccgggcccgggtcccggttcgggtcccggtaccggtcccgtttacgggtaccgtaaacggttccttaccctaccgtacttaccgtaacctaccgttacgcgggacggtccgggtacgtacggaccggaaaccggtcgtaacaggtcnnctnntcngnannnnnnnnnnnnnnnnnnnnnnnnnnn

SEQ ID NO: 294579 - DNA, 589 bp, Homo sapiens
  misc_feature: GYAE6OF01B6PD6.37.77.G11.1.454.CMB.1.raw
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (395)..(395): a, c, t, g, unknown or other
  misc_feature (395)..(395): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(589): a, c, t, g, unknown or other
  misc_feature (565)..(589): n is a, c, g, or t
tcagtagtgtagatcacgaccggtgctcgatttagctagtcactcaaggggaaaggggctggagtgggtctcagctattaatgggaatggtgatacccacatactacgcagactccgtgaagggccggttcaccatctccagggacaattccaagaacacactgtctctgcaaatgaacagcctgagagtcgaggacacggtccttatattactgtgtggaagggcctctagtccccttatagcagcggcgtggtcctggtacttgacgacgtcgggccacgggaaccctgggtccaccggtctcctcgaccgccctaccaccgaacgggccctacgtcccggttccttcccccgnggcccncccgtcgcctccgaggcgcccacctccgagacncgaccgacggtcccggcccgtggggccgtcgtcccgtaggtacctaacgggacctttaccttcccgaacttacccttaaccgaccgttacggtacgggtaaccgggccggggtacgttaccggggacccgggaacgggtacccgaacgttaaacggaggctacgcngncnnnnnnnnnnnnnnnnnnnnnnnnn

SEQ ID NO: 294580 - DNA, 546 bp, Homo sapiens
  misc_feature: GYAE6OF01DK1NM.37.77.G11.1.454.CMB.1.raw
  modified_base (519)..(546): a, c, t, g, unknown or other
  misc_feature (519)..(546): n is a, c, g, or t
tcagtagtgtagatcacgaccggtgctcgatttagctagtcactcaagggaaagggggctggagtgggtctcagctattaatgggaatggtgataccacatactacgcagactccgtgaaggggccggttcaccatctccagggacaattccaaagaacacactgtctctgcaaatgaacagcctgagagtcgaggacacggcttatattactgtgtagaagggacctctacgccccttatagcagcggctggtccttggtactttgacgacgtggggaccagggaaccctggtccaccgtcctcctcgacgccctacccgaacccgaacgggccccagtccggttcccttcccccgtcggccgcccctgcctcccgaggacgccacctccgaagcgaccacgacgggcccggcccgcggggctcggccgttacggtacgaacgtacctacttcctaacgtccctaactaccttacgtcggacggcgggtccgtaggacgaacgggtcgccagtagcgnnnnnnnnnnnnnnnnnnnnnnnnnnnn

SEQ ID NO: 294581 - DNA, 538 bp, Homo sapiens
  misc_feature: GYAE6OF01EURK5.37.77.G11.1.454.CMB.1.raw
  modified_base (519)..(538): a, c, t, g, unknown or other
  misc_feature (519)..(538): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaccctggtcaccgtctcctcagccctccaccgaacgggccccagtccggtcctttccccccgtgggcccgcccctcggcctcccgacgggacgcccaccctcccgagacgccaccacggcccgggcccgtcggggctcggccccgttgggtcaaacgggtaccttaccttcccattccctaacctacttaccgtgaacgggcggggtacgtcgggaccgaacgggccgacgtaacgtaggnnnnnnnnnnnnnnnnnnnn

SEQ ID NO: 294582 - DNA, 488 bp, Homo sapiens
  misc_feature: GYAE6OF01AQTH0.37.77.G11.1.454.CMB.1.raw
  modified_base (446)..(446): a, c, t, g, unknown or other
  misc_feature (446)..(446): n is a, c, g, or t
  modified_base (475)..(488): a, c, t, g, unknown or other
  misc_feature (475)..(488): n is a, c, g, or t
tcagtagtgtagatcacgaccggtgctcgatttagctagtcactcaagggaaaggggctggagtgggtctcagctattaatgggaatggtgataccacatactacgcagactccgtgaacgggccggttcaccatctcccagggacaattccaagaacacactgtctctgcaaatgaacagcctgagagtcgaggacacggccttatattactgtgtgaagggacctctacgccccttatagcagcggctggtcctggtacttgacgacgtggggccagggaccctggtcaccgtctcctcacgccctccaccgaagggccccagtccggtccttcccccgtcggcccgtcccctcggccctccgacgggacgccaccgtccgagacgcacgacgccggccgtcgggctcgccgtggtacacggtactactccatcctacactacnggacgcggacgtggacacggcgcagtgcnnnnnnnnnnnnnn

SEQ ID NO: 294583 - DNA, 741 bp, Homo sapiens
  misc_feature: GYAE6OF01DRGYR.37.77.G11.1.454.CMB.1.raw
  modified_base (642)..(642): a, c, t, g, unknown or other
  misc_feature (642)..(642): n is a, c, g, or t
  modified_base (648)..(648): a, c, t, g, unknown or other
  misc_feature (648)..(648): n is a, c, g, or t
tcagtagtgtagatcacgaccggtgctcgatttagctagtcactcaagggaaagggctggagtgggtctcagctattaatgggaatggtgataccacatactacgcagactccgtgaagggccggttcacatctccagggacaattccaagaacacacttgtctcgtgacaaatgaacagcctgacgagtcggagacacggtccttaatattacgtgtgtagaacggtcctacgtacgtcccttatacgcacgacggctacggtcgtggttacttgacgtacggtcgggaccacgggtaaccctggtcctaccgttcctaccgtacaccgtcccgtaccaccgacgggaccctagttcccggttcccttccccgtggtacccgtcccgtcgtccgtacccgaggtccgtacccgaccggtacgacggcgaaccgtaaccgccggtcccggtacccggtacgggttcgtacccgggtaccggttacgggtaaaccgtaacccggtttacccgtttaacccgttacccgtaacccgttaaccccgttaaaccgttaccggttaaacccggttcggggaaccggttccgggtacgttaaacgggaccgtaagggtacccgtacgtagtaccggtacagtagtacncgaacncgtgtcagtgcgtaccgtggaatcgtcgacttaacggcaagggtctcggttcaaacggtcttaaacgtacgaaaccgggttctcgtaacgtcg

SEQ ID NO: 294584 - DNA, 599 bp, Homo sapiens
  misc_feature: GYAE6OF01B9HL6.37.77.G11.1.454.CMB.1.raw
  modified_base (226)..(226): a, c, t, g, unknown or other
  misc_feature (226)..(226): n is a, c, g, or t
  modified_base (572)..(599): a, c, t, g, unknown or other
  misc_feature (572)..(599): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgagacacggtccttatattactgtgtgaacgggcctntacgcccttatagcaggcgtctggtcctggtacttgacgtacgtcggggaccacggggtaacccttcgggtacctacccggttctcccgttcgtaaccggccccttaccccgaaccgttacgggccccctaagttccccggttcccttcccccggttcggcctccccgtcgtccctccggaagtaccgcccttacccgacccgaaggacgtaccgaccgacgggcccgaccggttcggcgttccgccgttacgggaaccgtaacggacctttacctaccaactttaccgacctaacgtacgtaggtaacgccggggactggaaccgaacgggcctagaagtggacnnnnnnnnnnnnnnnnnnnnnnnnnnnn

SEQ ID NO: 294585 - DNA, 671 bp, Homo sapiens
  misc_feature: GYAE6OF01CZDC6.37.77.G11.1.454.CMB.1.raw
  modified_base (210)..(210): a, c, t, g, unknown or other
  misc_feature (210)..(210): n is a, c, g, or t
  modified_base (253)..(253): a, c, t, g, unknown or other
  misc_feature (253)..(253): n is a, c, g, or t
tcagtagtgtagatcacgaccggtgctcgatttagctagtcactcaagggaaagggggctggagtgggtctcaggtattactggtagtggtaataccgcatactacgcagactccgtgacgggccggttcaccgtctccagagacaattccaagaatacggtctatctggaaatgaacagcctgagagccgaggacacggcctctatacngtgcgagagatcgagacgagtatagcagcagctctgactacgngggccacggaacctgtcaccgtctcctcagcctccaccaacggccaagtccggtaccttccccgtaggccacccctaccgtaccgaacggtacgccgtaaccgtcggtacgggggtcacgtacggtccggaccctaggggcctcggtcctgggttacgaacggtaccttacgttacctaacgttccgtaaccgactttaccgtacggtacggtacccggggtaccggttacggacccgtaaacggggtccgtaacggtaacttaaacgggctaacgtacgtaaccggacgtacgtacgtagacgtacgtacgtacgtacgtacgtacgtacgtacgtacgtacgtacgtacgacgtacgtacgtcgtcgtacgtacgtcgtacgtacgtacgtacgtacgtagtacgtgtacgtaccg

SEQ ID NO: 294586 - DNA, 737 bp, Homo sapiens
  misc_feature: GYAE6OF01B2X9K.37.77.G11.1.454.CMB.1.raw
  modified_base (671)..(671): a, c, t, g, unknown or other
  misc_feature (671)..(671): n is a, c, g, or t
  modified_base (688)..(688): a, c, t, g, unknown or other
  misc_feature (688)..(688): n is a, c, g, or t
  modified_base (714)..(714): a, c, t, g, unknown or other
  misc_feature (714)..(714): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgagacgacggccttatattactgtgtgaagggacctactacgaccccttaagacgcagccggcgtcggtccgtcggttacttcggtacgacgtcggggaccgaacgggaacccgttggtaccaccggtactaccctcgaccgtccctacccgaacccgtaacgggacccctaacgtcccggttcccgttaccccccgtgggacccctaccccgtcccctaccctaaacggacgacccgtacccgtcgtaccggggaccgacgacgggtcccggtacccgtcggggacctcggtacccgtacgggtaccgtaaacgggtaacccgttaaccctttcctaacgttacccttaaccgtaaacgttaccgtacggaacggggtcccggggtaccgtacgggaacccgtaacggggacccgtaacgtaacggttacgggacaccgttagacccaaggtcgaccaggaacgtacgtagtacgtagacncgacgacgtcgtacgtnacgtacggacctactaccgtaccganacgtacgacgtacgngngtcgag

SEQ ID NO: 294587 - DNA, 760 bp, Homo sapiens
  misc_feature: GYAE6OF01AO2DU.37.77.G11.1.454.CMB.1.raw
  modified_base (688)..(688): a, c, t, g, unknown or other
  misc_feature (688)..(688): n is a, c, g, or t
  modified_base (693)..(693): a, c, t, g, unknown or other
  misc_feature (693)..(693): n is a, c, g, or t
  modified_base (699)..(699): a, c, t, g, unknown or other
  misc_feature (699)..(699): n is a, c, g, or t
  modified_base (719)..(719): a, c, t, g, unknown or other
  misc_feature (719)..(719): n is a, c, g, or t
  modified_base (725)..(725): a, c, t, g, unknown or other
  misc_feature (725)..(725): n is a, c, g, or t
  modified_base (733)..(733): a, c, t, g, unknown or other
  misc_feature (733)..(733): n is a, c, g, or t
  modified_base (741)..(741): a, c, t, g, unknown or other
  misc_feature (741)..(741): n is a, c, g, or t
  modified_base (748)..(748): a, c, t, g, unknown or other
  misc_feature (748)..(748): n is a, c, g, or t
  modified_base (752)..(752): a, c, t, g, unknown or other
  misc_feature (752)..(752): n is a, c, g, or t
  modified_base (756)..(756): a, c, t, g, unknown or other
  misc_feature (756)..(756): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcacatctccagggacaattccaaagaacacactgtctctgcaaatgaacacgcctagaggacgtcggacggaccgacggtccttaatacttacgtggtgtaggaacgggtaccttacgtacgtccccttaatcgaccgacggcggtacgtcgggttcccttagggttaccttcggaaccggtacggttcggggggaccctaacgggggtaaaccccgttcgggtaccctaacccgggttccttaccccgtacgtaccgtccccttaccccggaaacccggtaacggggtacccctaacggtttccccgggttccctttcccccggtcgggtcccgtccccgttcggtcccgtaccggtaacgggaccgccctaccggtaccggaggaaccgtacgaaccggcgggtcccgggtccggtacgggtcccgtacggtcccgtttacggaccgtaacgggttaccttacccttacgtactttaaccgtaccgaaccgttcggtccggtacggggtaccggtcggtacgggaccggtaacgggtccgaaccgtagtacgacgtcncgtanacgtgnttagctggtcatggacctgnggtacnctgacgtnacgcgacncacgtcncgtntctngtcg

SEQ ID NO: 294588 - DNA, 762 bp, Homo sapiens
  misc_feature: GYAE6OF01D3G7U.37.77.G11.1.454.CMB.1.raw
  modified_base (715)..(715): a, c, t, g, unknown or other
  misc_feature (715)..(715): n is a, c, g, or t
  modified_base (722)..(722): a, c, t, g, unknown or other
  misc_feature (722)..(722): n is a, c, g, or t
  modified_base (724)..(724): a, c, t, g, unknown or other
  misc_feature (724)..(724): n is a, c, g, or t
  modified_base (727)..(727): a, c, t, g, unknown or other
  misc_feature (727)..(727): n is a, c, g, or t
  modified_base (729)..(729): a, c, t, g, unknown or other
  misc_feature (729)..(729): n is a, c, g, or t
  modified_base (731)..(731): a, c, t, g, unknown or other
  misc_feature (731)..(731): n is a, c, g, or t
  modified_base (733)..(734): a, c, t, g, unknown or other
  misc_feature (733)..(734): n is a, c, g, or t
  modified_base (736)..(737): a, c, t, g, unknown or other
  misc_feature (736)..(737): n is a, c, g, or t
  modified_base (739)..(739): a, c, t, g, unknown or other
  misc_feature (739)..(739): n is a, c, g, or t
  modified_base (742)..(742): a, c, t, g, unknown or other
  misc_feature (742)..(742): n is a, c, g, or t
  modified_base (745)..(746): a, c, t, g, unknown or other
  misc_feature (745)..(746): n is a, c, g, or t
  modified_base (748)..(753): a, c, t, g, unknown or other
  misc_feature (748)..(753): n is a, c, g, or t
  modified_base (755)..(758): a, c, t, g, unknown or other
  misc_feature (755)..(758): n is a, c, g, or t
  modified_base (760)..(762): a, c, t, g, unknown or other
  misc_feature (760)..(762): n is a, c, g, or t
tcagtagtgtagatcacgaccggtgctcgatttagctagtcactcaaagggaaaggggctggagtgggtctcagctattaatgggaatggtgataccacatactacgcagactccgtgaacgggccggttcaccatctccgagggacaattccaagaacacactgtctctgacaaatgaaacagcctgagagtgacggacacggctttatattacgtgtggtaggaaacgggtcctcgtacgtccccttaagtacgacgaggccggtcgttcgggttaccgttcggttacttttacggaccggtaacggttccgggggaacccgaacggggtaaccccgttgggtacccgacccgttaccttcccgtaccgaccggtcccctaaccccggaaccggtaaaccggggccccctaacggtttccccgggttaccccctttcccccgggtcgggtccccgtccccgttcggaccccgttccgaacggggtaccacccgtaacccgtaccggaacgaccgaacgaccggaccgggtcccgggtacccggttcgggtaccgccggttaccggttaccgggtaaccggtaaaccgggttaaccctttaccccgttttaccgtttaaaccgtttacccgttaaacccgttaccgggtacgggtacccgggtcgggggttaacccacggggtaacccggaacgggtccgaacgttagaccggnagtcagngntgngngngnngnngncgncgnncnnnnnncnnnncnnn

SEQ ID NO: 294589 - DNA, 582 bp, Homo sapiens
  misc_feature: GYAE6OF01BJFX0.37.77.G11.1.454.CMB.1.raw
  modified_base (339)..(339): a, c, t, g, unknown or other
  misc_feature (339)..(339): n is a, c, g, or t
  modified_base (540)..(540): a, c, t, g, unknown or other
  misc_feature (540)..(540): n is a, c, g, or t
  modified_base (544)..(546): a, c, t, g, unknown or other
  misc_feature (544)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (556)..(557): a, c, t, g, unknown or other
  misc_feature (556)..(557): n is a, c, g, or t
  modified_base (559)..(582): a, c, t, g, unknown or other
  misc_feature (559)..(582): n is a, c, g, or t
tcagtagtgtagatcacgaccggtgctcgatttagctagtcactcaaagggaaaggggctggagtgggtctcagctattaatgggaatggtgataccacatactacgcagactccgtgaagggccggttcaccatctccgagggacaattccaagaacacactgtctctgacaaatgaacagcctgaagagtcgagaccgacgtccttagtattacgtgtgtaggaacggaccttctaccgtccccttagtacgcgacggcggtcgttcggtccgttggttacgttcggacggtacgggtccgggaccggaaccgggtaccgtccgtcctcctcctccnccgccgtccctaccgaccggaccgtcctcgtcccgttccctcccgccgtccctaccctaccgaccgacgccgtaccgtccggtcgggaccggacaccgccgggcccggtccggtcgccgtcgtcggtacgtaacgtacgtaccttaccgtactactactacgtacgtaggcggtacgggcgacgtacggacgtacgtacgntagnnngntncangtnncnnnnnnnnnnnnnnnnnnnnnnnn

SEQ ID NO: 294590 - DNA, 561 bp, Homo sapiens
  misc_feature: GYAE6OF01B0ZXQ.37.77.G11.1.454.CMB.1.raw
  modified_base (238)..(238): a, c, t, g, unknown or other
  misc_feature (238)..(238): n is a, c, g, or t
  modified_base (528)..(528): a, c, t, g, unknown or other
  misc_feature (528)..(528): n is a, c, g, or t
  modified_base (535)..(561): a, c, t, g, unknown or other
  misc_feature (535)..(561): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctagccccttatancagcggtctggtcctggttactttgacgacgtggggccagggaaccctggtccaccgtctcctcacggccctaccaccgaacgggtcccacttccggtcctttccccccgtgggcccgccccgttagcctccgaggcggaccacccgtcgagacgcactagcccggcccgtaggggtcctcggtcccgtaggtaccgaaacgggacctttaccgtttacccattcctaaccaaccgttacctgggaacggccgggacgtagggacccgggaaggcccggtaacataacgncagacgnnnnnnnnnnnnnnnnnnnnnnnnnnn

SEQ ID NO: 294591 - DNA, 742 bp, Homo sapiens
  misc_feature: GYAE6OF01BIVQP.37.77.G11.1.454.CMB.1.raw
  modified_base (239)..(239): a, c, t, g, unknown or other
  misc_feature (239)..(239): n is a, c, g, or t
  modified_base (656)..(656): a, c, t, g, unknown or other
  misc_feature (656)..(656): n is a, c, g, or t
  modified_base (672)..(672): a, c, t, g, unknown or other
  misc_feature (672)..(672): n is a, c, g, or t
  modified_base (729)..(729): a, c, t, g, unknown or other
  misc_feature (729)..(729): n is a, c, g, or t
  modified_base (734)..(734): a, c, t, g, unknown or other
  misc_feature (734)..(734): n is a, c, g, or t
tcagtagtgtagatcacgaccggtgctcgatttagctagtcactcaagggaagggctggagtgggtctcagctattaatgggaatggtgataccacatactacgcagactccgtgaaggccggttcaccatctcgagggacaattccaagaacacactgtctctgacaaatgacagcctgagagtcgagacacggtccttatattactgtagtgaacggacctcgtacgtcccctttanagcgtagcgtacgtcggtccgtggttaacctttcggaacggtaccgttcgggggacccctaacggggtaacccctttgggtaccctacccgttcgttccccttccggaaccgtccccttaccggaaaaccggaaagggtcccccctaacggtttcccgggtttaccccttttccccccggacgggtcccgtccccccgtaggaacccttaccccggaaggggaacctccgtaacccgtaccggaaggacccgacccaaacggaccgggtccccggtacccggttcggggtcccttccggtccgttacgggttaaccaaacgggtaccttaacccgtttccgattacccgttaaccgacgttacccggtagaacgggtcccgggtacgtcgggaccgaacggtaccgacttacgaggnacgagtcactcgtcgngtcgtacgcgcgacgacgtcgcgacgacgtagagagtacgtacgtacgacacgtacncagcncgtgtacg

SEQ ID NO: 294592 - DNA, 545 bp, Homo sapiens
  misc_feature: GYAE6OF01ET9DJ.37.77.G11.1.454.CMB.1.raw
  modified_base (308)..(308): a, c, t, g, unknown or other
  misc_feature (308)..(308): n is a, c, g, or t
  modified_base (517)..(545): a, c, t, g, unknown or other
  misc_feature (517)..(545): n is a, c, g, or t
tcagtagtgtagatcacgaccggtgctcgatttagctagtcactcaagggaaaggggctggagtgggtctcagctattaatgggaatggtgataccacattactacgcagactccgtgaaggggccggttcaccatctccagggacaattccaagaacacactgtctctgacaaatgaacagcctgagagtcgaggacacggccttaatattatgtgtagaacgggacctctacgccccttatagcagcggcgtggtccttggtactttgacgacgtcggggccagggaaccctggtcaccgtctccnacgccctccaccgaacggccctagtccgttcccttccccgtcggcccgccctcgcctccgacggacgccaccgtccgagacgccacgacggcccggcccgtcggctccgccgtcggtacaacgggaccttaccgttcctacttaccgtaactacctacggtacggacgggccggtacgtcgggacgtaacgggccgacgtagtgctagnnnnnnnnnnnnnnnnnnnnnnnnnnnnn

SEQ ID NO: 294593 - DNA, 523 bp, Homo sapiens
  misc_feature: GYAE6OF01CLP2N.37.77.G11.1.454.CMB.1.raw
  modified_base (365)..(365): a, c, t, g, unknown or other
  misc_feature (365)..(365): n is a, c, g, or t
  modified_base (495)..(495): a, c, t, g, unknown or other
  misc_feature (495)..(495): n is a, c, g, or t
  modified_base (497)..(523): a, c, t, g, unknown or other
  misc_feature (497)..(523): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaaacagcctggagagtcgaggacacggccttatattactgtgtgaagggacctctagtccccttatagcagcggctggtcctggtactttgacgagtggggccagggaaccctggtccaccgtctccgtcacgcctccaccgacggccctagtccgtccttcccccgtggccgcccctcgcctccgaggcncaccctcgacgagccacacggccggcccggtggccgtcgtccgtggtacaacgggtaccttcgttacccagttacctaccgtacgtacttggacggtcgggccgtcgggacgaacgggccgacgagagtncnnnnnnnnnnnnnnnnnnnnnnnnnnn

SEQ ID NO: 294594 - DNA, 647 bp, Homo sapiens
  misc_feature: GYAE6OF01BIG7I.37.77.G11.1.454.CMB.1.raw
  modified_base (138)..(138): a, c, t, g, unknown or other
  misc_feature (138)..(138): n is a, c, g, or t
  modified_base (280)..(280): a, c, t, g, unknown or other
  misc_feature (280)..(280): n is a, c, g, or t
  modified_base (590)..(590): a, c, t, g, unknown or other
  misc_feature (590)..(590): n is a, c, g, or t
  modified_base (595)..(595): a, c, t, g, unknown or other
  misc_feature (595)..(595): n is a, c, g, or t
  modified_base (599)..(599): a, c, t, g, unknown or other
  misc_feature (599)..(599): n is a, c, g, or t
  modified_base (604)..(604): a, c, t, g, unknown or other
  misc_feature (604)..(604): n is a, c, g, or t
  modified_base (607)..(607): a, c, t, g, unknown or other
  misc_feature (607)..(607): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(626): a, c, t, g, unknown or other
  misc_feature (622)..(626): n is a, c, g, or t
  modified_base (628)..(632): a, c, t, g, unknown or other
  misc_feature (628)..(632): n is a, c, g, or t
  modified_base (635)..(639): a, c, t, g, unknown or other
  misc_feature (635)..(639): n is a, c, g, or t
  modified_base (642)..(644): a, c, t, g, unknown or other
  misc_feature (642)..(644): n is a, c, g, or t
tcagtagtgtagatcacgaccggtgctcgattttagctagtcactcaagggaaagggggctggagtgggtctcaggtattactggtagtggtaaataccgcatactacgcagactccgtgacgggccgttcaccgtcnccagagacattccaagaatcggtctatctaggaaatgaacagcctgagtagccgaagggaccaccggccctacgtaatttaccgtggtcggacggaaggtacgacttacgaagggaccgggtaagttagtacgacgacgacncggtcctccgtaggaccttaccgggtcggggaccctaaccggtaacccgttcgtacccgaccgttcctacctccgacgcccctaccgaaccggaaccggtcccgtaacgttcccggttcccctacccccggcggtaccctaccctcccgtaagaaccgtaccgcgaacccggttcggacgggacaaccgtccgggaccgtccggtaggtcccttggacccggttaggaacgtaacggtaaccttccgactacgtaccctacgacgttacgcggtacggccgacggtcgacggaacggtcaacgtacgagntaccngctnagtgnacntacagananancncnnnnngnnnnncgnnnnncannngcg

SEQ ID NO: 294595 - DNA, 730 bp, Homo sapiens
  misc_feature: GYAE6OF01DWFFN.37.77.G11.1.454.CMB.1.raw
  modified_base (680)..(680): a, c, t, g, unknown or other
  misc_feature (680)..(680): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (690)..(691): a, c, t, g, unknown or other
  misc_feature (690)..(691): n is a, c, g, or t
  modified_base (694)..(694): a, c, t, g, unknown or other
  misc_feature (694)..(694): n is a, c, g, or t
  modified_base (699)..(699): a, c, t, g, unknown or other
  misc_feature (699)..(699): n is a, c, g, or t
  modified_base (702)..(703): a, c, t, g, unknown or other
  misc_feature (702)..(703): n is a, c, g, or t
  modified_base (707)..(708): a, c, t, g, unknown or other
  misc_feature (707)..(708): n is a, c, g, or t
  modified_base (710)..(710): a, c, t, g, unknown or other
  misc_feature (710)..(710): n is a, c, g, or t
  modified_base (714)..(716): a, c, t, g, unknown or other
  misc_feature (714)..(716): n is a, c, g, or t
  modified_base (718)..(719): a, c, t, g, unknown or other
  misc_feature (718)..(719): n is a, c, g, or t
  modified_base (724)..(726): a, c, t, g, unknown or other
  misc_feature (724)..(726): n is a, c, g, or t
  modified_base (728)..(728): a, c, t, g, unknown or other
  misc_feature (728)..(728): n is a, c, g, or t
tcagtagtgtagatcacgaccggtgctcgatttagctagtcactcaaagggaaaggggctggagtgggtctcagctattaatgggaatggtgataccacatactacgcagactccgtgaagggccggttcaccatctccagggacaattccaaagaacacactgtctctgcaaatgaacagcctgagagtcgaggacacggtccttaatattactgtgtggaacggacctctacgtcccttagtagcgacgcggtcgttcggtccttacggttacgttttacggaaccgtaccggtcgggggacccgtaacggggtaaccccttgggtacctacccggttcctcccgtcgaccgtacccctaccccgaaccggaaccggggcccctacggttcccgggttaccccctttcccccggtcgggtcccccgtccccgttcgggtacccctacccggaacgggtacccgacccgtaaccccggtaccggaacggaccgtacccaacggccgggtcccgggtcccggtcgggtcctccggtccccggttaagggtaacccgtaaaaccgggtccccttttaaccttacccgtaactttaaccccgttaacctaaccgttacgggtacgggacgggttccgggtccgttacgggaaccggaaacggttccgtaacgtagttacggnacgtgngngnngcngcgcngcnngagnngngtgnnngnncgcannngngc

SEQ ID NO: 294596 - DNA, 551 bp, Homo sapiens
  misc_feature: GYAE6OF01CHM0Z.37.77.G11.1.454.CMB.1.raw
  modified_base (206)..(206): a, c, t, g, unknown or other
  misc_feature (206)..(206): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (524)..(551): a, c, t, g, unknown or other
  misc_feature (524)..(551): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatnttactgtgtggaagggacctctacgccccttatacgcagcggctggtcctggtactttgacgactggggccagggaccctggccaccgtctcctcacgcctccaccgacgggcccagttccggtcccttcccctggcccgcccctcgcctcccagggcnccaccgtccgagcgccacncggccggccccgtggcctcgtcccggtggtacccgtaagggtaccttacccgttaccctacgtacccttaaccaaccgttaccgtcggaacgggccggggtaccgtcgggaccgtaagggccaccgtaagtgacngnncnnnnnnnnnnnnnnnnnnnnnnnnnnnn

SEQ ID NO: 294597 - DNA, 754 bp, Homo sapiens
  misc_feature: GYAE6OF01EVA6S.37.77.G11.1.454.CMB.1.raw
  modified_base (701)..(701): a, c, t, g, unknown or other
  misc_feature (701)..(701): n is a, c, g, or t
  modified_base (704)..(704): a, c, t, g, unknown or other
  misc_feature (704)..(704): n is a, c, g, or t
  modified_base (706)..(706): a, c, t, g, unknown or other
  misc_feature (706)..(706): n is a, c, g, or t
  modified_base (708)..(708): a, c, t, g, unknown or other
  misc_feature (708)..(708): n is a, c, g, or t
  modified_base (710)..(710): a, c, t, g, unknown or other
  misc_feature (710)..(710): n is a, c, g, or t
  modified_base (714)..(714): a, c, t, g, unknown or other
  misc_feature (714)..(714): n is a, c, g, or t
  modified_base (716)..(716): a, c, t, g, unknown or other
  misc_feature (716)..(716): n is a, c, g, or t
  modified_base (720)..(720): a, c, t, g, unknown or other
  misc_feature (720)..(720): n is a, c, g, or t
  modified_base (723)..(724): a, c, t, g, unknown or other
  misc_feature (723)..(724): n is a, c, g, or t
  modified_base (726)..(726): a, c, t, g, unknown or other
  misc_feature (726)..(726): n is a, c, g, or t
  modified_base (728)..(729): a, c, t, g, unknown or other
  misc_feature (728)..(729): n is a, c, g, or t
  modified_base (731)..(735): a, c, t, g, unknown or other
  misc_feature (731)..(735): n is a, c, g, or t
  modified_base (739)..(741): a, c, t, g, unknown or other
  misc_feature (739)..(741): n is a, c, g, or t
  modified_base (743)..(746): a, c, t, g, unknown or other
  misc_feature (743)..(746): n is a, c, g, or t
  modified_base (748)..(748): a, c, t, g, unknown or other
  misc_feature (748)..(748): n is a, c, g, or t
  modified_base (750)..(750): a, c, t, g, unknown or other
  misc_feature (750)..(750): n is a, c, g, or t
  modified_base (752)..(754): a, c, t, g, unknown or other
  misc_feature (752)..(754): n is a, c, g, or t
tcagtagtgtagatcacgaccggtgctcgatttagctagtcactcaagggaaaggggctggagtgggtctcagctattaatgggaatggtgataccacatactacgcagactccgtgagggccggttcaccatctccagggacaattccaacagcacgctgtatttgcacatgaacagcctgagagccgaggacacggccatatattattgtagacgtaaacctttccttttagtaccttaggtttactttacttaccccctagtacgtacccgacgttcggggggtccgaaccggggaacccccgttggtacccgtaccccggttcccttacccctaccgtaaccggtacccccttaccccgaaccccgaaaaccgggggtccccctaacgttcccggggtttacccccttttccccccccggttaccgggaccccttaccccccccgttacccgttaccccgtaaaacggaacccgaccccgtaccccggttacggttaccggggggaccaacccggaccggcccgggtccccggttcgggggtaccttccggacccgtttagggtaacccggtaaagggtaaccctttacccgttacccctaacgttacccgtaaacctaaccgtttaacccgtgggaaccgggtacccgggtcgtaccggggaccggaaacggggtacccgtaacgaagttaacggngangnananagcngnacangannananncnnnnnagcnnnannnnananannn

SEQ ID NO: 294598 - DNA, 658 bp, Homo sapiens
  misc_feature: GYAE6OF01CFA2W.37.77.G11.1.454.CMB.1.raw
  modified_base (401)..(401): a, c, t, g, unknown or other
  misc_feature (401)..(401): n is a, c, g, or t
  modified_base (629)..(629): a, c, t, g, unknown or other
  misc_feature (629)..(629): n is a, c, g, or t
  modified_base (631)..(634): a, c, t, g, unknown or other
  misc_feature (631)..(634): n is a, c, g, or t
  modified_base (636)..(658): a, c, t, g, unknown or other
  misc_feature (636)..(658): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatagaacacgccgtagagaggtccggaaggaccgtaccgggtacctttaagttatttacctggttagtacggaaacggggtaccttcgttaaccgtccccgtttaagtaacgccgacggtccggccggtttcggtaccgttacggttactttttacgggaaccggtaaccggttcggggggacccgaacggggaaccccttgggtaccgtcccggttcctcccgttacncgtcccctaaccgaccggaacggcccgtaccgttccggtcccctttccccgtcgggccccgtcccgttcgccccgtacgacggtacgaccccaccgtacccggagacccgtacaaccgccggcccgtccgggtcggtacctccggacgttcggaaccgtaggaccctttacgtccaacgttcacgtaacgtcgtaagcgggcccgttagcggacgcgtacgcgatcgnannnncnnnnnnnnnnnnnnnnnnnnnnn

SEQ ID NO: 294599 - DNA, 629 bp, Homo sapiens
  misc_feature: GYAE6OF01BZBYB.37.77.G11.1.454.CMB.1.raw
  modified_base (593)..(593): a, c, t, g, unknown or other
  misc_feature (593)..(593): n is a, c, g, or t
  modified_base (596)..(597): a, c, t, g, unknown or other
  misc_feature (596)..(597): n is a, c, g, or t
  modified_base (602)..(602): a, c, t, g, unknown or other
  misc_feature (602)..(602): n is a, c, g, or t
  modified_base (607)..(629): a, c, t, g, unknown or other
  misc_feature (607)..(629): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcacatctccgagggacaattccaagaacacactgtctctgacaaatgaacagccgtagagaggtcgacggacgaccggtccttattattacgtgtgtaggaacggaccttcgtacgtcccttatacgacgtacgcggtcgttacggtcctaggttacgttcggacgtacggtcggggaccgtaacgggaacccgtcggtccgacccgtcctccgtacgaccgtaccctacccgaaccggaaccgggtaccctaccggttacccgttccccttcccccggtcggtccccgtccccgtacgtccctacccggacggtaccgtacccaccgtaccggagaccgcctaacggccgtcccggacccgtcgggtacctcggtaccgtggtaaccgaaccggtaccttaccgttacctactaccgtaaccacgtacgcgcggtccggtacgacggacgacgtacgacagtgncgnntgacngcatnnnnnnnnnnnnnnnnnnnnnnn

SEQ ID NO: 294600 - DNA, 620 bp, Homo sapiens
  misc_feature: GYAE6OF01AQLBN.37.77.G11.1.454.CMB.1.raw
  modified_base (291)..(291): a, c, t, g, unknown or other
  misc_feature (291)..(291): n is a, c, g, or t
  modified_base (295)..(295): a, c, t, g, unknown or other
  misc_feature (295)..(295): n is a, c, g, or t
  modified_base (326)..(326): a, c, t, g, unknown or other
  misc_feature (326)..(326): n is a, c, g, or t
  modified_base (546)..(546): a, c, t, g, unknown or other
  misc_feature (546)..(546): n is a, c, g, or t
  modified_base (562)..(562): a, c, t, g, unknown or other
  misc_feature (562)..(562): n is a, c, g, or t
  modified_base (592)..(592): a, c, t, g, unknown or other
  misc_feature (592)..(592): n is a, c, g, or t
  modified_base (612)..(612): a, c, t, g, unknown or other
  misc_feature (612)..(612): n is a, c, g, or t
  modified_base (617)..(617): a, c, t, g, unknown or other
  misc_feature (617)..(617): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgagacacggccttatattactgtgtgaagggacctctagcccttatacgcagcgctggtcctgtacttgacgacgtgggccaggacctggtccacgtctccncganccctccaccgacggccactcggtcctcccgngaccgcctcgacctccgaaggtccacctaccgtaccgacgacgacaaccgtacggcccggacccgtcgggaccctcggtcccgtacggttacggaaacgggttaaccgttaaccctttaccgaacttaccttaacgtaacccgttacgttaacgggaccggtaccgggaccttaggggaccctaaaaccgggcgtacccgtaacgtaaggtccaagtccncgacgtagacgacgtntagcacacacacgatacgacgctacacacncgacgtcgtacgtacgacancgtancgc

SEQ ID NO: 294601 - DNA, 528 bp, Homo sapiens
  misc_feature: GYAE6OF01BJFJK.37.77.G11.1.454.CMB.1.raw
  modified_base (495)..(496): a, c, t, g, unknown or other
  misc_feature (495)..(496): n is a, c, g, or t
  modified_base (499)..(499): a, c, t, g, unknown or other
  misc_feature (499)..(499): n is a, c, g, or t
  modified_base (501)..(528): a, c, t, g, unknown or other
  misc_feature (501)..(528): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtgggccagggaaccctggtcaccgtactcctcacgcctccaaccgaacgggcccaagtccggttcctttccccccgtaggcccgcccctgcctacccgaaggacgccaacccgttccgaggtaacggcaacgacggcccggcccgtagggcctcgccgtcggtacaaaggtactaccttacactctaacactactgacgcgggactggacgaggtcgacgtatacgnncgnannnnnnnnnnnnnnnnnnnnnnnnnnnn

SEQ ID NO: 294602 - DNA, 689 bp, Homo sapiens
  misc_feature: GYAE6OF01C5K6W.37.77.G11.1.454.CMB.1.raw
  modified_base (242)..(242): a, c, t, g, unknown or other
  misc_feature (242)..(242): n is a, c, g, or t
  modified_base (583)..(583): a, c, t, g, unknown or other
  misc_feature (583)..(583): n is a, c, g, or t
  modified_base (593)..(593): a, c, t, g, unknown or other
  misc_feature (593)..(593): n is a, c, g, or t
  modified_base (611)..(611): a, c, t, g, unknown or other
  misc_feature (611)..(611): n is a, c, g, or t
  modified_base (638)..(638): a, c, t, g, unknown or other
  misc_feature (638)..(638): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggaccttatattactgtgtgaagggacctctacgtcccctttanagcagcggctggtctggtacttgacgacgtcgggaccgaggtaacccgtggtcctaccgtctcctacagccctaccaccgaacgggccccagtccggtccttcccccgtaggcccgtcccgtcgacctccgaaggacgcctaaccctcggacgacgcctaacgacggtccgggtccccgtgggtccctcggtccgttacggggtaaccctaaagggtacctttacccggttaccctaacgttcccgtaaaaccttccctaaacggtgggtaccgggtaacggggtcccggttaacgggccgggtaaaacggtccccgggtaacctaaacgggtttaaccgngactacgtanacgtacgtcgagtcgacncgtacgacgacgtactacgtacgtacncgtacgtagtacgtccgtaccgtagacgtacgacgtacgtacgtagtcacg

SEQ ID NO: 294603 - DNA, 531 bp, Homo sapiens
  misc_feature: GYAE6OF01ANRI4.37.77.G11.1.454.CMB.1.raw
  modified_base (312)..(312): a, c, t, g, unknown or other
  misc_feature (312)..(312): n is a, c, g, or t
  modified_base (367)..(367): a, c, t, g, unknown or other
  misc_feature (367)..(367): n is a, c, g, or t
  modified_base (494)..(494): a, c, t, g, unknown or other
  misc_feature (494)..(494): n is a, c, g, or t
  modified_base (498)..(499): a, c, t, g, unknown or other
  misc_feature (498)..(499): n is a, c, g, or t
  modified_base (502)..(508): a, c, t, g, unknown or other
  misc_feature (502)..(508): n is a, c, g, or t
  modified_base (510)..(517): a, c, t, g, unknown or other
  misc_feature (510)..(517): n is a, c, g, or t
  modified_base (519)..(531): a, c, t, g, unknown or other
  misc_feature (519)..(531): n is a, c, g, or t
tcagtagtgtagatcacgaccggtgctcgatttagctagtcactcaagggaaagggggctggagtgggtctcagctattaatggggaatggtgataccacatactacgcagactccgtgaagggccggttcaccatctccagggacaattccaagaacacactgtctctgcaaatgaacagcctgagagtcgaggacacggccttatattactgtgtgaagggacctcgtacgccccttatagcaggcggctggtcctggttactttgacgacgtcggggccacgggaaccctggtccaccgtctcctcacnccctccaccgaacggcccacgtcgtcctccccgtggccgtccctgctccacggcnccaccgtccgagacgcacgacgccggcccgtgggcctcgtccgtggtaccgaaacggtaccttaccttccgattaccctacctaacgtacctggaaggccgggtcgtacgggcacggccgagtaacncganntgnnnnnnncnnnnnnnncnnnnnnnnnnnnn

SEQ ID NO: 294604 - DNA, 544 bp, Homo sapiens
  misc_feature: GYAE6OF01D4YMN.37.77.G11.1.454.CMB.1.raw
  modified_base (506)..(506): a, c, t, g, unknown or other
  misc_feature (506)..(506): n is a, c, g, or t
  modified_base (516)..(544): a, c, t, g, unknown or other
  misc_feature (516)..(544): n is a, c, g, or t
tcagtagtgtagatcacgaccggtgctcgatttagctagtcactcaagggaaaggggctgggagtgggtctcagctattaatgggaatggtgataccacatactacgcagactccgtgaagggcccggttcaccatctccagggacaattccaagaacacactgtctctgcaaatgaacagcctgagagtcgaggacacggccttatattactgtgtggaagggacctcctacgccccttatagcgagcggctggtcctggtactttgacgacgtggggccaggggaaccctggtccaccgtcctcctcacgccctccaccgaacgggccccagtccggtcccttcccccgcggtccgccccgtgccctcccgaggacgccaccctccggagacgcacaccggccggcccgtgggcctcgcctcggaccgaaacgggtaccttacgttccgacttaccgtaacctaccgttacgtgacggcgggtcgtcgggaccgaagggccganagtagcatgnnnnnnnnnnnnnnnnnnnnnnnnnnnnn

SEQ ID NO: 294605 - DNA, 622 bp, Homo sapiens
  misc_feature: GYAE6OF01CNJRF.37.77.G11.1.454.CMB.1.raw
  modified_base (582)..(582): a, c, t, g, unknown or other
  misc_feature (582)..(582): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (598)..(622): a, c, t, g, unknown or other
  misc_feature (598)..(622): n is a, c, g, or t
tcagtagtgtagatcacgaccggtgctcgatttagctagtcactcaaggggaaagggggctggagtgggtctcagctattaatgggaatggtgataccacatactacgcagactccgtgaagggccggttcaccatctccagggacaattccaaagaacacactgtcctctgacaaatgaacagcctgagagtcggaggacacggtccttatatactgtgtgacggacctctacgtcccttatacgcaggcggcgtcggtcgttggttactttcggacgtacggtcggggaccgtaacggggaaccccgttgggtccgacccgttcgtccccgtactaccggacccctacccgaaccggtaaaccgggtccctaacgttccccggttccccgttaccccgtcggccccggttcccgttccgccctaccggacggaccgacctaacccgtacggaccgacgtacccgacgacgggccccggtccggtcgggtccttccggcgtacggtaccgaacgtacctaccgttccacttaccttaaccgacgttacggtagggcggacgggcgtaggaccgggtaggcngaactgatgnttnatnnnnnnnnnnnnnnnnnnnnnnnnn

SEQ ID NO: 294606 - DNA, 671 bp, Homo sapiens
  misc_feature: GYAE6OF01B7XBO.37.77.G11.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
  modified_base (365)..(365): a, c, t, g, unknown or other
  misc_feature (365)..(365): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggtcttatattactgtgtgaaggcctctacgcccttanagcagcgntggtctgtacttgacgcgtgggccagggaacctggtacaccgtctcctcacgccctaccaaccgaacgggcccagtccgtcccgttcccccgtaggcccgtcccgtcgcctaccgaggacnccgtacccgtccggaagacgccaacgacggccggtcccgtagggtcctacggcccttagggtaccaaaacgggtaccctttaacctttacccaacgttacccttaacctaaccgttacgttagggaaccgggtaccggggtacccgttaggggaaccccgtaacggggtaccccgaacggtaaactttaaggccggtaacacgtacgtacgtacgtacgtacgtacgtacgacgtacgtactagtagtcgtacgtagtacgactacgacgtacgacgacgtacgacgtactactacacgtagtacg

SEQ ID NO: 294607 - DNA, 509 bp, Homo sapiens
  misc_feature: GYAE6OF01A9EAY.37.77.G11.1.454.CMB.1.raw
  modified_base (476)..(478): a, c, t, g, unknown or other
  misc_feature (476)..(478): n is a, c, g, or t
  modified_base (480)..(483): a, c, t, g, unknown or other
  misc_feature (480)..(483): n is a, c, g, or t
  modified_base (485)..(509): a, c, t, g, unknown or other
  misc_feature (485)..(509): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacaccctgtctctgcaaatgaacacctgagagccgaggacacggccctatattactgtacgaaaatggcctacggatatgactactattgggactggtacttcgatctcgtggggccgtggcaccctggtcactgtctcctcagcctccaccaagggcccatccggtccttcccccgtggccgcccctggcctcccgacggacgcctacctccgagacgcacacggcggccctggggcctgcccgtggtacaaaggtcttaccttccaacgtcctaacacctacgtgacggccggggctcgggacaagggccgacagtacgnnncnnnncnnnnnnnnnnnnnnnnnnnnnnnnn

SEQ ID NO: 294608 - DNA, 599 bp, Homo sapiens
  misc_feature: GYAE6OF01EG83B.37.77.G11.1.454.CMB.1.raw
  modified_base (136)..(136): a, c, t, g, unknown or other
  misc_feature (136)..(136): n is a, c, g, or t
  modified_base (216)..(216): a, c, t, g, unknown or other
  misc_feature (216)..(216): n is a, c, g, or t
  modified_base (557)..(558): a, c, t, g, unknown or other
  misc_feature (557)..(558): n is a, c, g, or t
  modified_base (561)..(561): a, c, t, g, unknown or other
  misc_feature (561)..(561): n is a, c, g, or t
  modified_base (565)..(567): a, c, t, g, unknown or other
  misc_feature (565)..(567): n is a, c, g, or t
  modified_base (569)..(572): a, c, t, g, unknown or other
  misc_feature (569)..(572): n is a, c, g, or t
  modified_base (574)..(599): a, c, t, g, unknown or other
  misc_feature (574)..(599): n is a, c, g, or t
tcagtagtgtagatcacgaccggtgctcgatttagctagtcactcaagggaaaggggctggagtgggtctcagctattaatgggaatggtgataccacatactacgcagacctccgtgaagggccgttcaccatcnccagggacaattccaacagcacgctgtatttgcacatgaacagcctagagagccgaggacacggccaattatattagttntgactaaaccttttctttagacttggtttacttactccccgtagtagacctacggtggggccgaacgggaaccctcgggtaccacccggtcctaccctccacgccctccaacccgaacggccctacgtccggtcccttcccccgtcggccctacccctccgccgaacgacgccaccgttcggtcgggggaccacgcggacccggcccgtcggggtctcggtcccgtagggttaaccgaacggtaaccttaccctacccgtaactacccttaaacctaacccgttaccgtacgggtacggccggggtacgttacgggaaccgtaacgggccgtacagtaagnncgncgannngnnnngnnnnnnnnnnnnnnnnnnnnnnnnnn

SEQ ID NO: 294609 - DNA, 577 bp, Homo sapiens
  misc_feature: GYAE6OF01D4OQC.37.77.G11.1.454.CMB.1.raw
  modified_base (295)..(295): a, c, t, g, unknown or other
  misc_feature (295)..(295): n is a, c, g, or t
  modified_base (546)..(549): a, c, t, g, unknown or other
  misc_feature (546)..(549): n is a, c, g, or t
  modified_base (551)..(577): a, c, t, g, unknown or other
  misc_feature (551)..(577): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacgccttatattactgtgtagaacgggacctctacgtccccttatagcagcggcgtggtcctggtacttgacgcggtcgggaccgacggacctggtccnccgtcctcctcaccgtcccaccgaaccggaccggccctacgttcccggttccccgttccccgtccggcccgtcccgtcgccgtaccgacggacgacccgaccgcgagacgacgacgacggcccggtccggtcggtccgtccgtccgtacggtaccgtaacgtaccttacccttaccctaactaccctaacctaaccgttacgtacggaccggtcgggtacgtaccgggaccgaacggccgtactagtacgnnnngnnnnnnnnnnnnnnnnnnnnnnnnnnn

SEQ ID NO: 294610 - DNA, 634 bp, Homo sapiens
  misc_feature: GYAE6OF01CK2VO.37.77.G11.1.454.CMB.1.raw
  modified_base (184)..(184): a, c, t, g, unknown or other
  misc_feature (184)..(184): n is a, c, g, or t
  modified_base (442)..(442): a, c, t, g, unknown or other
  misc_feature (442)..(442): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
  modified_base (609)..(609): a, c, t, g, unknown or other
  misc_feature (609)..(609): n is a, c, g, or t
  modified_base (615)..(634): a, c, t, g, unknown or other
  misc_feature (615)..(634): n is a, c, g, or t
tcagtagtgtagatcacgaccggtgctcgatttagctagtcactcaagggaaaggggctggagttggtctcagctaataatgggaatggtgataccacatactacgcagactccgtggaagggccggttcaccatctccagggacaattccaagaacacactgtctctgacaatgaacagtccngagagtcgagacacggtccttatacttatggtgtaggaacgggtacctcgtaccgtacccctttaagacggcgtacggcggtcgttggtcccgttagggttacttacggacggaaccgggttcgggggaccggaaccggggtaaacccgttcgggaccgtcccgtactcccttaccgacgttccccgacccgaaccggaacccgggcccgtaaccgttcccgggtccccctttccccggacgccccggaccccgttcncccgtaccggacggaccgacccgaccgtacccgaagacgaccgaacggtacggccccgggtcccgtgggacctacggccgttacggtaaccaaacggtactccgtaccctagtaccacgtaacctcggtagaccggtcggaccgtaggactaacgggnacganagcnagttcnnnnnnnnnnnnnnnnnnnn

SEQ ID NO: 294611 - DNA, 602 bp, Homo sapiens
  misc_feature: GYAE6OF01C9Y93.37.77.G11.1.454.CMB.1.raw
  modified_base (327)..(327): a, c, t, g, unknown or other
  misc_feature (327)..(327): n is a, c, g, or t
  modified_base (570)..(570): a, c, t, g, unknown or other
  misc_feature (570)..(570): n is a, c, g, or t
  modified_base (573)..(602): a, c, t, g, unknown or other
  misc_feature (573)..(602): n is a, c, g, or t
tcagtagtgtagatcacgaccggtgctcgatttagctagtcactcaaagggaaaggggctggagtgggtctcagctattaatgggaatggtgataccacatactacgcagactccgtgaagggccggttcaccatctccagggacattccaagaacacactgtctctgcaaatgaacagcctgagagtcgagacacggccttatattactgtgtggaacgggacctctacgccccttatacgcaggccggtcgtcggtccgttggtactttggacgacgtcggggtaccgacgggaaccccgttggcctaccggtcctcctccgacncccgtcccaaccgaacgggcccctacgtcccggttccttcccccggtcggccctcccgtcgccgtaccgacggacgtcccaccgtacccggaagccgacacgtacggcccggtcccggtgggtccgtccgcggttcggtaccgaaacgggttcccttactaccgtacctaccttaactaacctacggacggtacgggtccgggacggtcggtaacccgggaacgggtcgaccgaacggttggnacnnnnnnnnnnnnnnnnnnnnnnnnnnnnnn

SEQ ID NO: 294612 - DNA, 878 bp, Homo sapiens
  misc_feature: GYAE6OF01AIWPY.37.77.G11.1.454.CMB.1.raw
  modified_base (819)..(819): a, c, t, g, unknown or other
  misc_feature (819)..(819): n is a, c, g, or t
  modified_base (825)..(825): a, c, t, g, unknown or other
  misc_feature (825)..(825): n is a, c, g, or t
  modified_base (830)..(830): a, c, t, g, unknown or other
  misc_feature (830)..(830): n is a, c, g, or t
  modified_base (837)..(838): a, c, t, g, unknown or other
  misc_feature (837)..(838): n is a, c, g, or t
  modified_base (840)..(841): a, c, t, g, unknown or other
  misc_feature (840)..(841): n is a, c, g, or t
  modified_base (843)..(843): a, c, t, g, unknown or other
  misc_feature (843)..(843): n is a, c, g, or t
  modified_base (850)..(850): a, c, t, g, unknown or other
  misc_feature (850)..(850): n is a, c, g, or t
  modified_base (861)..(861): a, c, t, g, unknown or other
  misc_feature (861)..(861): n is a, c, g, or t
  modified_base (863)..(864): a, c, t, g, unknown or other
  misc_feature (863)..(864): n is a, c, g, or t
  modified_base (871)..(871): a, c, t, g, unknown or other
  misc_feature (871)..(871): n is a, c, g, or t
  modified_base (874)..(874): a, c, t, g, unknown or other
  misc_feature (874)..(874): n is a, c, g, or t
  modified_base (876)..(876): a, c, t, g, unknown or other
  misc_feature (876)..(876): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaaagaacacactgtctctgcaaatgaaacagcctagagagtcgacggacgacggtcctttaatacttaacgtagtaaaccgtaaaaagtcggtaccgtaaacggtattaagtacgtaacgttaacttaaggtttcggggtaacgttacgggtttacctttacgtaacgttccgttaccggtcgggggtccggttcggccgtaacccccggttgggtaccctaacgtttccgttacccgttcccctcgtaacccgccccgttaccccgtaaaacccggtacccggggtacccctaaccggtttcccccgggttttcccccgtttcccccccggtaacggggtccccccgtaccccggtttcccgggtacccccgttaaccggggaaccgggttaaccccggtcccctaacccccggtttaaccggaaccggggaccgaacccgaacccggaacccggggtcccggtcccccgggtaacgggggtcctaccccgggttccggggtttaaccggtaccggaaaacccgggtttacccgtttaccctttaccccggttaaacttaccccggttaacctaaacccgtttaaccgggttccgggaacccggggttccggggtcggttaacccggggaaccgtaacgggggtacccctaaaggttccggaaggtcnccgtancgtcngaacgcnncnncngagcgcncgcgcgtgcgncnncgcgtcngcngngc

SEQ ID NO: 294613 - DNA, 542 bp, Homo sapiens
  misc_feature: GYAE6OF01A0SI3.37.77.G11.1.454.CMB.1.raw
  modified_base (515)..(542): a, c, t, g, unknown or other
  misc_feature (515)..(542): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaaccctgggtcaccgtctccctcacgccctccgaccgaacgggccccagttccggtccctttcccccgtgggcccgcccctgccttcccgaggcgccaccgtcccgagacgccacgacggccgggcccctggggcctcgcccgttagggtcaaagggtcccttaaccgtttcccacttcctaaccgaccttacgtcggaacggcggggtctcgggacgaacgggcgacaagtacgnnnnnnnnnnnnnnnnnnnnnnnnnnnn

SEQ ID NO: 294614 - DNA, 680 bp, Homo sapiens
  misc_feature: GYAE6OF01DS3FE.37.77.G11.1.454.CMB.1.raw
  modified_base (183)..(183): a, c, t, g, unknown or other
  misc_feature (183)..(183): n is a, c, g, or t
  modified_base (641)..(641): a, c, t, g, unknown or other
  misc_feature (641)..(641): n is a, c, g, or t
  modified_base (650)..(651): a, c, t, g, unknown or other
  misc_feature (650)..(651): n is a, c, g, or t
  modified_base (654)..(680): a, c, t, g, unknown or other
  misc_feature (654)..(680): n is a, c, g, or t
tcagtagtgtagatcacgaccggtgctcgatttagctagtcactcgaagggaaaggggctggagtgggtctcagctattaagtgggaatggtgataccacatactacgcagactccgtagaagggccggttcaccatctccagggacaattccaagaacacactgtctctgacaaatgaacanctgagaggtcggaggaccacggtcctttatagttacgtggttgtagggaacgggtaccctcgtaccgtcccctttagtacgacgtacggccgggttcgttccgggttaccgttacgggttacttttacgggaacccggtaccgggttccgggggaaccccgaacgggggttaacccccgtttggggtaccctacccggttccttccctacccggtaaccgtcccctaacccgaaccccgggacgggtaccccttacggttcccgggttcccctttaccccgcgggaccctccccgttgccccgttaccggaaggaccgtccctaccggtacgaaggtaccgacctacgaccgggtcccggtcccggtcggcctacgtcgggtacgttacgaacggttccttactcgaaccttcaactacgtaggtacggcgtcgggaactggacgtacgggctactanagtccacgnngannnnnnnnnnnnnnnnnnnnnnnnnnn

SEQ ID NO: 294615 - DNA, 662 bp, Homo sapiens
  misc_feature: GYAE6OF01EZYZY.37.77.G11.1.454.CMB.1.raw
  modified_base (179)..(179): a, c, t, g, unknown or other
  misc_feature (179)..(179): n is a, c, g, or t
  modified_base (620)..(620): a, c, t, g, unknown or other
  misc_feature (620)..(620): n is a, c, g, or t
  modified_base (625)..(625): a, c, t, g, unknown or other
  misc_feature (625)..(625): n is a, c, g, or t
  modified_base (628)..(628): a, c, t, g, unknown or other
  misc_feature (628)..(628): n is a, c, g, or t
  modified_base (639)..(659): a, c, t, g, unknown or other
  misc_feature (639)..(659): n is a, c, g, or t
  modified_base (661)..(662): a, c, t, g, unknown or other
  misc_feature (661)..(662): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaaacngcctgagagtcggaggacacggccttatattactgtgtgaacgggcctctacgtccccttatagcagcggctcggtccgtgttacgtttcgacggtacgtcggggccgacggggtaaccccgtacggtcgacccgtccttccctccaacgcccctccctaaccgaaccgggtccccaacgttccgggttccctttccccccgtaccgggtcccggtcccccgttccggccgttcccgaacggtaccgtaccgtaccctacccgtacgtaccgaccgaccgaacggtcccggcccccggttggggtccgtacggcccgttacgggtaccgtaaaccgggtaaccgtttacctttaaccccgattaccctaaccgtaccgttaacccgtcggaccgggcggggtaccggtcggaaccggttagggacccgactaagttacggntcggnacnaggctgactannnnnnnnnnnnnnnnnnnnngnn

SEQ ID NO: 294616 - DNA, 626 bp, Homo sapiens
  misc_feature: GYAE6OF01D9R7X.37.77.G11.1.454.CMB.1.raw
  modified_base (246)..(246): a, c, t, g, unknown or other
  misc_feature (246)..(246): n is a, c, g, or t
  modified_base (592)..(592): a, c, t, g, unknown or other
  misc_feature (592)..(592): n is a, c, g, or t
  modified_base (596)..(597): a, c, t, g, unknown or other
  misc_feature (596)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(615): a, c, t, g, unknown or other
  misc_feature (603)..(615): n is a, c, g, or t
  modified_base (617)..(626): a, c, t, g, unknown or other
  misc_feature (617)..(626): n is a, c, g, or t
tcagtagtgtagatcacgaccggtgctcgatttagctagtcactcaagggaaaggggctggagtgggtctcagctattaatgggaatggtgataccacatactacgcagactccgtgaagggcctgttcaccatctccagggacaattccaagaacacactgtctctgacaaatgaacagcctgagagtcgaggacacggtccttatattactgtgtaggaacgggtacctctaccgtccccttanacgcagcggcgtggtcctggttacttgaccgacggtcggggccgaacgggtaccctggtccaccgtcctccgtccacgccctaccgaccgaacgggccctacgttcccggtccctttcccccggcggcccgaccccgttgcccgtaccggaggaccgcctaacccgtccgaaggacgacccgaacgaccgggtcccggtacccggttcggggaccctcggtacccggttgggtaaccgtaaacgggtaccttttacccgttcccaacttttaccgtaaacctaccgttacgtcgggaaccgggtccggggacgtaccgggacggaacccggccgtactaagtagcncagnncngncnnnnnnnnnnnnncnnnnnnnnnn

SEQ ID NO: 294617 - DNA, 499 bp, Homo sapiens
  misc_feature: GYAE6OF01D6W3O.37.77.G11.1.454.CMB.1.raw
  modified_base (470)..(499): a, c, t, g, unknown or other
  misc_feature (470)..(499): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctcccagggacaattccaagaacacactgtctctgcaaaatgaacagcctgagagtcgaggacacgggccttaatattactgtgcgaaggaagggtctagcagtgcctggtactcccactactatatggacgtctggggcaaaggaatcgcgtcaccgtctcctcagcctccaccgaagggcccatcggtccttcccccgtggccacccctcctccaagacgccaacctcgtcgggggcacgacggcggcccgttcgggctcgccctggtacgaacggtactaccttccgactcctacaactactgacggcggactgggcctaagggcgcagtcgnnnnnnnnnnnnnnnnnnnnnnnnnnnnnn

SEQ ID NO: 294618 - DNA, 666 bp, Homo sapiens
  misc_feature: GYAE6OF01CROMB.37.77.G11.1.454.CMB.1.raw
  modified_base (442)..(442): a, c, t, g, unknown or other
  misc_feature (442)..(442): n is a, c, g, or t
  modified_base (640)..(640): a, c, t, g, unknown or other
  misc_feature (640)..(640): n is a, c, g, or t
  modified_base (643)..(643): a, c, t, g, unknown or other
  misc_feature (643)..(643): n is a, c, g, or t
  modified_base (647)..(647): a, c, t, g, unknown or other
  misc_feature (647)..(647): n is a, c, g, or t
  modified_base (651)..(666): a, c, t, g, unknown or other
  misc_feature (651)..(666): n is a, c, g, or t
tcagtagtgtagatcacgaccggtgctcgatttagctagtcactcgaagggaaaggggctggagtgggtctcagctattaatgggaatggtgataccacatactacgcagtactccgtaggaacggggtccggttacaccgatccgtacccgaggggaactaaacttcccaaaggaaccaacacttgtcctctcgacaaatgaacagccgtagacgagtcggaggtaccgacgtccttaatattacgtggtggtacggaacgggtcctctaccgtcccttagtacgcgacggcggtcgtcggttcttacgggttacgtttacggaccggtacgggtcggggacccgaacgggacccgttggtacccgtcccgttacttcccgcgaaccgtcccctaacccgaccgaacgggccctacggttcccgtccccgtttaccccggnggaccccgtccgttcgacccgtcggacggaccgcctacccggcgaacgcaaccgccgtacggcccggtccggtcggtcctccggtacggtaacggttaccgaaacggtccttaaccgttacccacttacccgtaactcggtaacggtacggcgggtccgggtagaccggacgtaacgggcctaagacagtccaggacngantcangctnnnnnnnnnnnnnnnn

SEQ ID NO: 294619 - DNA, 648 bp, Homo sapiens
  misc_feature: GYAE6OF01BZBXO.37.77.G11.1.454.CMB.1.raw
  modified_base (555)..(555): a, c, t, g, unknown or other
  misc_feature (555)..(555): n is a, c, g, or t
  modified_base (588)..(588): a, c, t, g, unknown or other
  misc_feature (588)..(588): n is a, c, g, or t
  modified_base (596)..(596): a, c, t, g, unknown or other
  misc_feature (596)..(596): n is a, c, g, or t
  modified_base (617)..(617): a, c, t, g, unknown or other
  misc_feature (617)..(617): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
tcagtagtgtagatcacgaccggtgctcgatttagctagtcactcaagggaagggctggagtggtctcagctattaatgggaatggtgataccacatactacgcagactccgtgagggccggttcaccatctcagggacaattccaagacacactgtctctgcacttacagcctgagagcgacgacaccggtctatattactgtgacgaggaaggtctagctagtcgtacctggtacctccacgttactagtacttggacgttcgtggggacaagacgttcgcggtacctaccgtctaccgtcacgccctacctaccgaacgggtcccacttccggtccttaccccgtacggcctaacccctccgtaccaacgacgtcccgttaaccgcggtacggggcctaacggacggtcccggtacccggtcgggtacctcgacccgtttacgggcttaacggggacccttaacgttcccaacgttacgtacctaaccggttaacgtaagggttaccgcgggtaaccgttagggacgtaacgggtacacgtacgtaaaggtnaacgttcacgtgtagcgccagtaccctggtaanacgtcacncgagcgacaccgcgtactacncgtagagtagacgtctacgancncgacgacg

SEQ ID NO: 294620 - DNA, 551 bp, Homo sapiens
  misc_feature: GYAE6OF01AFC61.37.77.G11.1.454.CMB.1.raw
  modified_base (530)..(551): a, c, t, g, unknown or other
  misc_feature (530)..(551): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaaacagcctgagagtcgaggacacggtccttattattactgtgtaggaacgggacctctacgtaccccttatagcaggcggctcggtccgtgttacttgacgacgtgggccgaggaaccctggtccaccgtctcctcacgccctccgaaccgaacggccctacgttccggtcccttccccgtcggcctccccgtcgtcctccgacggtacgccctaccgtaccgagcgaccacgacggcccggcccggtggtccgtcgcccgttacggtacgtaacgtaccttaccttaccgtactacctaactaccgtacggtaggcgggtccgggctacgggaactaccgggctacgatagcnnnnnnnnnnnnnnnnnnnnnn

SEQ ID NO: 294621 - DNA, 606 bp, Homo sapiens
  misc_feature: GYAE6OF01AW9G9.37.77.G11.1.454.CMB.1.raw
  modified_base (258)..(258): a, c, t, g, unknown or other
  misc_feature (258)..(258): n is a, c, g, or t
  modified_base (517)..(517): a, c, t, g, unknown or other
  misc_feature (517)..(517): n is a, c, g, or t
  modified_base (562)..(562): a, c, t, g, unknown or other
  misc_feature (562)..(562): n is a, c, g, or t
  modified_base (574)..(574): a, c, t, g, unknown or other
  misc_feature (574)..(574): n is a, c, g, or t
  modified_base (578)..(597): a, c, t, g, unknown or other
  misc_feature (578)..(597): n is a, c, g, or t
  modified_base (599)..(599): a, c, t, g, unknown or other
  misc_feature (599)..(599): n is a, c, g, or t
  modified_base (601)..(601): a, c, t, g, unknown or other
  misc_feature (601)..(601): n is a, c, g, or t
  modified_base (603)..(604): a, c, t, g, unknown or other
  misc_feature (603)..(604): n is a, c, g, or t
  modified_base (606)..(606): a, c, t, g, unknown or other
  misc_feature (606)..(606): n is a, c, g, or t
tcagtagtgtagatcacgaccggtgctcgatttagctagtcactcaaggggaaaggggctggagtgggtctcagctattaatgggaatggtgataccacatactacgcagactccgtgaagggccggttcaccatctccagggacaattccaaagaaactacaacctgtctctgcctaaagtgaacagcctagacgaggtacgaggaccgacggccttatattactggtgtgtaagggacctcgtacgcccctttaanactcgagcggtccttggtccgtggttacgttggaacgacgtcggggaccgaacgggtaaccctggtaccaccggttctacctccgacgttacccaccgaccgaacggtacccagttacccggttcccttcccccgtaggtccccgtaccccgttcgacccgttacggacggaaccgacccgttaccgaccggacgacggaccaacgtcggaacccgccgtcgggactcgaccgttggacaacgggtactaccgtactancccgtaaaccgttacgtgacggtcggagtcgacgtaacgcacttnaacgtgcatgcngacnnnnnnnnnnnnnnnnnnnncnancnngn

SEQ ID NO: 294622 - DNA, 620 bp, Homo sapiens
  misc_feature: GYAE6OF01AP1YR.37.77.G11.1.454.CMB.1.raw
  modified_base (537)..(537): a, c, t, g, unknown or other
  misc_feature (537)..(537): n is a, c, g, or t
  modified_base (585)..(585): a, c, t, g, unknown or other
  misc_feature (585)..(585): n is a, c, g, or t
  modified_base (589)..(589): a, c, t, g, unknown or other
  misc_feature (589)..(589): n is a, c, g, or t
  modified_base (594)..(595): a, c, t, g, unknown or other
  misc_feature (594)..(595): n is a, c, g, or t
  modified_base (597)..(610): a, c, t, g, unknown or other
  misc_feature (597)..(610): n is a, c, g, or t
  modified_base (612)..(617): a, c, t, g, unknown or other
  misc_feature (612)..(617): n is a, c, g, or t
  modified_base (619)..(620): a, c, t, g, unknown or other
  misc_feature (619)..(620): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgacaaatgaacagcctgagagtcgacggacaccggccttatattactgtgtgaacgggcctctacgccccttatagcgagcggtctcggtccttggttacttggacgtacgtcggggaccacgggtaaccctggtccacccggttctccctacacgtcccctaccgaacccggaacggggcccctaacgttcccggttcccctttaccccccgtcgggtccccgtacccccgttcggcccttacccggacgggtaaccgccgtacccgtccggagaccgacccgacacgggcccggtcccggtggtccctcggcccgtggtacctaaacggtcccttaccttaccgtactaccgtaacctaccgttaccgnggaacggtcgggtcgttacgggacgttaaacggccgaagtacgtgacngtcngctgnncnnnnnnnnnnnnnncnnnnnncnn

SEQ ID NO: 294623 - DNA, 440 bp, Homo sapiens
  misc_feature: GYAE6OF02H5XSF.37.77.G11.1.454.CMB.1.raw
  modified_base (435)..(440): a, c, t, g, unknown or other
  misc_feature (435)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaggactacttccatctacactactgagcgggctggcaaggcgcatagnnnnnn

SEQ ID NO: 294624 - DNA, 442 bp, Homo sapiens; identical to SEQ ID NO: 294323
  misc_feature: GYAE6OF02IV412.37.77.G11.1.454.CMB.1.raw
  modified_base (436)..(442): a, c, t, g, unknown or other
  misc_feature (436)..(442): n is a, c, g, or t

SEQ ID NO: 294625 - DNA, 442 bp, Homo sapiens
  misc_feature: GYAE6OF02I9RGR.37.77.G11.1.454.CMB.1.raw
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtctcccctggcgccctgctccaggagcacctccgagagcacagcggccctgggctgcctggtcaaggactacttccatctacactactgagcgggctgggcaaggcgcatagnnnnnnn

SEQ ID NO: 294626 - DNA, 440 bp, Homo sapiens
  misc_feature: GYAE6OF02HQMK6.37.77.G11.1.454.CMB.1.raw
  modified_base (435)..(440): a, c, t, g, unknown or other
  misc_feature (435)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnn

SEQ ID NO: 294627 - DNA, 439 bp, Homo sapiens
  misc_feature: GYAE6OF02IF682.37.77.G11.1.454.CMB.1.raw
  modified_base (434)..(439): a, c, t, g, unknown or other
  misc_feature (434)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggcctgggctgcctggtcaaggctacttccatctacactactgagcgggctggcaaggcgcatagnnnnnn

SEQ ID NO: 294628 - DNA, 442 bp, Homo sapiens
  misc_feature: GYAE6OF02IZ1LD.37.77.G11.1.454.CMB.1.raw
  modified_base (438)..(442): a, c, t, g, unknown or other
  misc_feature (438)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtcttccccctggcgccctgctccaggagcacctccgagagcacagcggccctgggctgcctggtcaagggactacttccatctacactactgagcgggctggcaaggcgcatagnnnnn

SEQ ID NO: 294629 - DNA, 441 bp, Homo sapiens; identical to SEQ ID NO: 294306
  misc_feature: GYAE6OF02I56IP.37.77.G11.1.454.CMB.1.raw
  modified_base (436)..(441): a, c, t, g, unknown or other
  misc_feature (436)..(441): n is a, c, g, or t

SEQ ID NO: 294630 - DNA, 437 bp, Homo sapiens
  misc_feature: GYAE6OF02JA1AI.37.77.G11.1.454.CMB.1.raw
  modified_base (424)..(437): a, c, t, g, unknown or other
  misc_feature (424)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctcccctggcacctcctccaagagcacctctggggcacagcgcctggctgcctgtcaaggctactccatctacactactgagcggctggcaaggcgcatagnnnnnnnnnnnnnn

SEQ ID NO: 294631 - DNA, 582 bp, Homo sapiens
  misc_feature: GYAE6OF02I7LTL.37.77.G11.1.454.CMB.1.raw
  modified_base (525)..(525): a, c, t, g, unknown or other
  misc_feature (525)..(525): n is a, c, g, or t
  modified_base (531)..(532): a, c, t, g, unknown or other
  misc_feature (531)..(532): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (564)..(564): a, c, t, g, unknown or other
  misc_feature (564)..(564): n is a, c, g, or t
  modified_base (568)..(569): a, c, t, g, unknown or other
  misc_feature (568)..(569): n is a, c, g, or t
  modified_base (571)..(571): a, c, t, g, unknown or other
  misc_feature (571)..(571): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (579)..(581): a, c, t, g, unknown or other
  misc_feature (579)..(581): n is a, c, g, or t
tcagtagtgtagatcacgaccggtgctcgatttagctagtcactcaagggaagggctggaggggtgggtctcgaggctattaatgggaatgggtgatacccaccatacgtaccgcgagactccgtgaacgggccggttcaccactctccagggacaagttccaagaacacacctggtctctgcaaatcgaacagcctgacgagtccgaggacacgggcccgttatacttacgtgtgttggaagggaacctctaggcccccttatacgcaggaccggctggtcctggtactttgacgactggggtccaagggtaaccctggtccaccggtcctacctcacgccctccgaccaaagggccccaagtcggtcttacccctggcgccctgctccaggacgccgaccgtcccgagacgccacacgtcggcccgtgggcctagccctgggtcaaacgggaccgtaccttcccgaatcctacctacttacgtcggacgtccgggctggcaaagggcgtaccgaagtacggcnagtctnntntntntntntctntgtgcgcgngngcnctcngtcnncncgcncncnnnc

SEQ ID NO: 294632 - DNA, 439 bp, Homo sapiens
  misc_feature: GYAE6OF02JCGMC.37.77.G11.1.454.CMB.1.raw
  modified_base (434)..(439): a, c, t, g, unknown or other
  misc_feature (434)..(439): n is a, c, g, or t
tcagtagtgtagatcacgaccggtgctcgatttagctagtcactcaagggaaagggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcggccctgggctgcctggtcaagggctacttccatctacactactgagcgggctggcaaggcgcatagnnnnnn

SEQ ID NO: 294633 - DNA, 444 bp, Homo sapiens
  misc_feature: GYAE6OF02IWFZM.37.77.G11.1.454.CMB.1.raw
  modified_base (437)..(444): a, c, t, g, unknown or other
  misc_feature (437)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnn

SEQ ID NO: 294634 - DNA, 439 bp, Homo sapiens
  misc_feature: GYAE6OF02FFY88.37.77.G11.1.454.CMB.1.raw
  modified_base (436)..(439): a, c, t, g, unknown or other
  misc_feature (436)..(439): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnn

SEQ ID NO: 294635 - DNA, 438 bp, Homo sapiens
  misc_feature: GYAE6OF02HEOT9.37.77.G11.1.454.CMB.1.raw
  modified_base (434)..(438): a, c, t, g, unknown or other
  misc_feature (434)..(438): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctcctccaagagcacctctggggcacagcggccctgggctgcctggtcaaggctacttccatctacactactgagcgggctggcaaggcgcatagnnnnn

SEQ ID NO: 294636 - DNA, 479 bp, Homo sapiens
  misc_feature: GYAE6OF02GMXB6.37.77.G11.1.454.CMB.1.raw
  modified_base (357)..(357): a, c, t, g, unknown or other
  misc_feature (357)..(357): n is a, c, g, or t
  modified_base (444)..(447): a, c, t, g, unknown or other
  misc_feature (444)..(447): n is a, c, g, or t
  modified_base (450)..(450): a, c, t, g, unknown or other
  misc_feature (450)..(450): n is a, c, g, or t
  modified_base (452)..(462): a, c, t, g, unknown or other
  misc_feature (452)..(462): n is a, c, g, or t
  modified_base (464)..(464): a, c, t, g, unknown or other
  misc_feature (464)..(464): n is a, c, g, or t
  modified_base (466)..(479): a, c, t, g, unknown or other
  misc_feature (466)..(479): n is a, c, g, or t
tcagtagtgtagatcacgaccggtgctcgatttagctagtcactcaagggaaaggggcgtggagtgggtctcagctattaatgggaatggtgataccacatactacgcagactccgtgaagggccggttcaccatctccagggtacaattccaagaactacactgtctctgcaaatgaacagcctgagagtcgaggacacggccttatattactgtgtgaaggggacctctagccccttatagcagcggctggtcctgggtactttgacgactggggccagggaaccctggtcaccgtctcctcagccctccaccaaggggcccatcggtcttccccctggcgccctgctccaggancacctccgagacgcacagcggcctgggctgcctggtcaaggctacgttccatctacactactgagcgggctggacaaggcgcatagnnnncgntnnnnnnnnnnngngnnnnnnnnnnnnnn

SEQ ID NO: 294637 - DNA, 436 bp, Homo sapiens
  misc_feature: GYAE6OF02IBF6S.37.77.G11.1.454.CMB.1.raw
  modified_base (433)..(436): a, c, t, g, unknown or other
  misc_feature (433)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggagcacctccgagagcacagcgccctgggctgcctggtcaaggctacttccatctacactactgagcgggctggcaaggcgcatagnnnn

SEQ ID NO: 294638 - DNA, 445 bp, Homo sapiens
  misc_feature: GYAE6OF02FGR0F.37.77.G11.1.454.CMB.1.raw
  modified_base (440)..(445): a, c, t, g, unknown or other
  misc_feature (440)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatcggtcttccccctggccgccctgctccaggagcacctccgagacgcacagcggccctgggctgccctggtcaaggactacttccatctacactactgagcgggctggcaaggcgcatagnnnnnn

SEQ ID NO: 294639 - DNA, 435 bp, Homo sapiens
  misc_feature: GYAE6OF02H85ZY.37.77.G11.1.454.CMB.1.raw
  modified_base (434)..(435): a, c, t, g, unknown or other
  misc_feature (434)..(435): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggcctgggctgcctggtcaggactacttccatctacactactgagcgggctggcaaggcgcatagnn

SEQ ID NO: 294640 - DNA, 542 bp, Homo sapiens
  misc_feature: GYAE6OF02HLUJR.37.77.G11.1.454.CMB.1.raw
  modified_base (479)..(479): a, c, t, g, unknown or other
  misc_feature (479)..(479): n is a, c, g, or t
  modified_base (482)..(482): a, c, t, g, unknown or other
  misc_feature (482)..(482): n is a, c, g, or t
  modified_base (484)..(484): a, c, t, g, unknown or other
  misc_feature (484)..(484): n is a, c, g, or t
  modified_base (486)..(486): a, c, t, g, unknown or other
  misc_feature (486)..(486): n is a, c, g, or t
  modified_base (510)..(510): a, c, t, g, unknown or other
  misc_feature (510)..(510): n is a, c, g, or t
  modified_base (513)..(514): a, c, t, g, unknown or other
  misc_feature (513)..(514): n is a, c, g, or t
  modified_base (516)..(517): a, c, t, g, unknown or other
  misc_feature (516)..(517): n is a, c, g, or t
  modified_base (520)..(520): a, c, t, g, unknown or other
  misc_feature (520)..(520): n is a, c, g, or t
  modified_base (522)..(523): a, c, t, g, unknown or other
  misc_feature (522)..(523): n is a, c, g, or t
  modified_base (525)..(525): a, c, t, g, unknown or other
  misc_feature (525)..(525): n is a, c, g, or t
  modified_base (527)..(527): a, c, t, g, unknown or other
  misc_feature (527)..(527): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
tcagtagtgtagatcacgaccggtgctcgatttagctagtcactcaaggggaaagggactggaagtgggtcgtctaggtattgggtcggcgagttggtgtagaccacatactacgcgagactccgtgaagggccggttcgaccatctcagacgacaattccaagaacaccctgtctctgcaaatggaacaacctggacgagccgaggaacacggccctaatacttactcgtgcgtagtagatcagacggaagtaataagacagtcagtctactgactactggggacccacgggaaccctggtccaccgtactcctcagccttccaccgaagggcccatccgggtcttcccccgtcggccaacccctcctccaagacgccacctcgtgggggcacaagcggtccctgggctcgcctggtcaaaggactacttccatctacactaacgtgaggcgggctggtactaagggcgcaagtacgnatnancnctcactcgcagacgagagagacanacnngnngcncnntntntcncnctcncncntc

SEQ ID NO: 294641 - DNA, 440 bp, Homo sapiens
  misc_feature: GYAE6OF02IIW50.37.77.G11.1.454.CMB.1.raw
  modified_base (437)..(440): a, c, t, g, unknown or other
  misc_feature (437)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggagcacctccgagagcacagcggccctgggctgcctggtcaaggctacttccatctacactactgagcgggctgggcaaggcgcatagnnnn

SEQ ID NO: 294642 - DNA, 532 bp, Homo sapiens
  misc_feature: GYAE6OF02GOO4F.37.77.G11.1.454.CMB.1.raw
  modified_base (489)..(494): a, c, t, g, unknown or other
  misc_feature (489)..(494): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (504)..(504): a, c, t, g, unknown or other
  misc_feature (504)..(504): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (519)..(523): a, c, t, g, unknown or other
  misc_feature (519)..(523): n is a, c, g, or t
  modified_base (525)..(532): a, c, t, g, unknown or other
  misc_feature (525)..(532): n is a, c, g, or t
tcagtagtgtagatcacgaccggtgctcgatttagctagtcactcaaggggaaaggggactggagtgggtcttcgacgctagttaaactgggaagtaggtcgataccacatacttacgctacgacctccgtgaagggccggttcgaccactctccacgggaccaagttccaagaacacactgtctctgcaaactgaaccacgcctgagagtcgaggacgaacgggccttatacttactcgtgtgaaggggacctctagccccttatagtcagcggctggtcctcggtacttttcgacgactgggggacccaggggaacccctgggtcacccgtcgtcctcctagccttccaccaaggggcccatcggtacttcccccctggacggcccctggctcctaggacgcacctccggtagagcacagcggccctgggctgcctgtcaggactactccatctacactactgagcgggctggcaagtcgcattagnnnnnngnagacngcngacntncgngnacgnnnnnannnnnnnn

SEQ ID NO: 294643 - DNA, 424 bp, Homo sapiens
  misc_feature: GYAE6OF02H2I6P.37.77.G11.1.454.CMB.1.raw
  modified_base (413)..(413): a, c, t, g, unknown or other
  misc_feature (413)..(413): n is a, c, g, or t
  modified_base (418)..(424): a, c, t, g, unknown or other
  misc_feature (418)..(424): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccgtctccagagacaattccaagaatacggtctatctggaaatgaacagcctgagagccgaggacacggcctctattactgtgcgagagatcagacggagtatagcagcagctctgactactgggggccacggaaccctggtcaccgtctcctcagcctccaccaagggcccatcggtcttccccctggcaccctcctccaagagcacctctggggcacagcggccctgggctgcctggtcaagctacttccatctacactactgagcgggctggcaaggcgnatagnnnnnnn

SEQ ID NO: 294644 - DNA, 414 bp, Homo sapiens
  misc_feature: GYAE6OF02FYVCB.37.77.G11.1.454.CMB.1.raw
  modified_base (408)..(414): a, c, t, g, unknown or other
  misc_feature (408)..(414): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacacgctctatctgcaaatgaacagcctgagagccgaagacacggccgtatattactgtgtgaaaggctggggatggggggactactggggccagggaaccctggtcaccgtctcctcagcctccaccaagggcccatcggtcttccccctggcaccctcctccaagagcacctctgggggcacagcggccctgggctgcctggtcaaggctacttccatctacactactgagcgggctggcaaggcgcatagnnnnnnn

SEQ ID NO: 294645 - DNA, 441 bp, Homo sapiens
  misc_feature: GYAE6OF02ITXK2.37.77.G11.1.454.CMB.1.raw
  modified_base (407)..(407): a, c, t, g, unknown or other
  misc_feature (407)..(407): n is a, c, g, or t
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggagcacctccgagagcacagcggccctgggctgcctggtcaaggctacttccatctacnctactgagcgggctggcaaggcgcatagnnnnnn

SEQ ID NO: 294646 - DNA, 450 bp, Homo sapiens
  misc_feature: GYAE6OF02JZC8O.37.77.G11.1.454.CMB.1.raw
  modified_base (441)..(441): a, c, t, g, unknown or other
  misc_feature (441)..(441): n is a, c, g, or t
  modified_base (445)..(450): a, c, t, g, unknown or other
  misc_feature (445)..(450): n is a, c, g, or t
tcagtagtgtagatcacgaccggtgctcgatttagctagtcactcaagggaaagggcgtggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccggtctcctcagcctccaccaagggccccatccggtcttccccctggccgccctcctccaacgacgccacctctcggggcacagccggccctgggctgacctgtcaaggctacgttccatcctacactactggacgcgggctggcaggcnatgnnnnnn

SEQ ID NO: 294647 - DNA, 442 bp, Homo sapiens
  misc_feature: GYAE6OF02IN13O.37.77.G11.1.454.CMB.1.raw
  modified_base (427)..(427): a, c, t, g, unknown or other
  misc_feature (427)..(427): n is a, c, g, or t
  modified_base (433)..(442): a, c, t, g, unknown or other
  misc_feature (433)..(442): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggctgtgtattattgtgcgagagatttagactacaaagtttcgagtgactggtatgatgcttatgatacctggggccaagggaccatggtcaccgtctcttcagcctccaccaagggcccatcggtcttcccctggcgccctgctccaggacgcacctccgagagcacagcggccctgggctgcctggtcaaggctactccatctacactactgagcggctggcaaggcncatagnnnnnnnnnn

SEQ ID NO: 294648 - DNA, 475 bp, Homo sapiens
  misc_feature: GYAE6OF02J2FKY.37.77.G11.1.454.CMB.1.raw
  modified_base (169)..(169): a, c, t, g, unknown or other
  misc_feature (169)..(169): n is a, c, g, or t
  modified_base (414)..(414): a, c, t, g, unknown or other
  misc_feature (414)..(414): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (444)..(444): a, c, t, g, unknown or other
  misc_feature (444)..(444): n is a, c, g, or t
  modified_base (447)..(447): a, c, t, g, unknown or other
  misc_feature (447)..(447): n is a, c, g, or t
  modified_base (449)..(468): a, c, t, g, unknown or other
  misc_feature (449)..(468): n is a, c, g, or t
  modified_base (470)..(475): a, c, t, g, unknown or other
  misc_feature (470)..(475): n is a, c, g, or t
tcagtagtgtagatcacgaccggtgctcgatttagctagtcactcaagggaaaggggctggagtgggtctcagctagttaactgggaatggtgataccgacatactacgcagactcccgtgaagggccggttcaccatctccagggacaattccaagaacacactgtcnctgcaaatgaacagcctgagagtcgaggacacggccttatattactgtgtgaagggacctctagccccttatagcagcggactggtcctggtactttgacgactggggccagggaaccctggtcaccgtctcctcagcctccacctaaggcccatcggtcttccccctggccgccctgctccaggagcactccgagagcacagcgcctgggctgcctggtcaggctactccgatctacgactacngagcggtctggccaaggcgacatagngntngcngnnnnnnnnnnnnnnnnnnnncnnnnnn

SEQ ID NO: 294649 - DNA, 449 bp, Homo sapiens
  misc_feature: GYAE6OF02JY0FA.37.77.G11.1.454.CMB.1.raw
  modified_base (442)..(449): a, c, t, g, unknown or other
  misc_feature (442)..(449): n is a, c, g, or t
tcagtagtgtagatcacgaccggtgctcgatttagctagtcactcgaagggaaaggggctggagtgggtctcagctattaatgggaatggtgataccacatactacgcacgactccgtgaagggccggttcaccatctccagggacaagttccaagaacacaccgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtccttcccctggcgccctgctccaggagcacctccgagacgcacacgcgaccctgggctgcctggtcaaggctacttccatctacactactgagcgggctggcaaggcgcatagcnnnnnnnn

SEQ ID NO: 294650 - DNA, 424 bp, Homo sapiens
  misc_feature: GYAE6OF02JE3JE.37.77.G11.1.454.CMB.1.raw
  modified_base (419)..(424): a, c, t, g, unknown or other
  misc_feature (419)..(424): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttcccctggcaccctcctccaagagcacctctggggcacagcggcctgggctgcctggtcaaggactacgttccatctacactactgagcgggctggcaaggcgcatagnnnnnn

SEQ ID NO: 294651 - DNA, 470 bp, Homo sapiens
  misc_feature: GYAE6OF02H7E9Z.37.77.G11.1.454.CMB.1.raw
  modified_base (443)..(470): a, c, t, g, unknown or other
  misc_feature (443)..(470): n is a, c, g, or t
tcagtagtgtagatcacgaccggtgctcgatttagctagtcactcaaggggaaaggggctggagtagggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggcgccctgctccaggacgcacctccgagagcacagcggccctgggctgcctggtccaagggactacttccactctacactactgagcgggctggcaaggcgcatagnnnnnnnnnnnnnnnnnnnnnnnnnnnn

SEQ ID NO: 294652 - DNA, 445 bp, Homo sapiens
  misc_feature: GYAE6OF02GUKYR.37.77.G11.1.454.CMB.1.raw
  modified_base (437)..(445): a, c, t, g, unknown or other
  misc_feature (437)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggcctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnnn

SEQ ID NO: 294653 - DNA, 442 bp, Homo sapiens
  misc_feature: GYAE6OF02GGTUJ.37.77.G11.1.454.CMB.1.raw
  modified_base (435)..(442): a, c, t, g, unknown or other
  misc_feature (435)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccatcaagggcccatcggtcttccccctggcgccctgctccaggagcacctccgagagcacagcggccctgggctgcctggtcaaggctacttccatctacactactgagcgggctggcaaggcgcatagnnnnnnnn

SEQ ID NO: 294654 - DNA, 763 bp, Homo sapiens
  misc_feature: GYAE6OF02HIMYK.37.77.G11.1.454.CMB.1.raw
  modified_base (733)..(733): a, c, t, g, unknown or other
  misc_feature (733)..(733): n is a, c, g, or t
tcagtagtgtagatcacgaccggtgctcgatttagctagtcactcaagggaaaggggctggagtttggtcttcagctattaatggtaatggtgataccacagtactacgcagaactccgtgaagggccgggttcaccatctcccagggacgaattccaagaacgacactgtctctgcaaatcgaacacgcctgtacgaggtcgaggaccgaccggcccttaatacttactgtgtagaagggacctctagccccttatacgcagcggactggtcctggtactttgtacgacttgggggacccaggggaacccctggtaccacccgtcgtccctcgacgccctacccaccgaacgggcccccaagtccggttcctttaccccccgttgggtcccgtaccccgtcgggcccttccccggacgggtacgccctacccgttcccggaaggtacggccaacgtacgggcccggtccccgtaggggccctacggacccgtttacggggtttaccccgaaaaacggggttaacccttaaaacccgttttccccgaaaacgtttacccgttaaaaccgtaacccggtttaaaccggttcgggtaaacggggcccgggggttacctttacgggggtacccggttaaaacggggtcccgtaccgtaaacgtttaagggcacgacgctacgaactacctccgtacgtacgtcgaccggaggacgaaggtgacacgtacgaaacgngtcgtcgtcgcgcgacactcgtcgtctctc

SEQ ID NO: 294655 - DNA, 441 bp, Homo sapiens
  misc_feature: GYAE6OF02FM45L.37.77.G11.1.454.CMB.1.raw
  modified_base (437)..(441): a, c, t, g, unknown or other
  misc_feature (437)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgccctggtcaagggctacttccatctacactactgagcgggctggcaaggcgcatagnnnnn

SEQ ID NO: 294656 - DNA, 440 bp, Homo sapiens
  misc_feature: GYAE6OF02I60S6.37.77.G11.1.454.CMB.1.raw
  modified_base (435)..(440): a, c, t, g, unknown or other
  misc_feature (435)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttcccctggcgccctgctccaggacgcacctccgagagcacagcggccctgggctgcctggtcaaggctacttccatctacactactgagcgggctggcaaggcgcatagnnnnnn

SEQ ID NO: 294657 - DNA, 441 bp, Homo sapiens
  misc_feature: GYAE6OF02INUA2.37.77.G11.1.454.CMB.1.raw
  modified_base (434)..(441): a, c, t, g, unknown or other
  misc_feature (434)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtttcctcagcctccaccaagggcccatcggtcttcccctggccgccctgctccaggacgcacctccgagagcacagcggccctgggctgcctggtcaaggctactcatctacactactgagcgggctggcaaggcgcatagnnnnnnnn

SEQ ID NO: 294658 - DNA, 486 bp, Homo sapiens
  misc_feature: GYAE6OF02F5DJF.37.77.G11.1.454.CMB.1.raw
  modified_base (120)..(120): a, c, t, g, unknown or other
  misc_feature (120)..(120): n is a, c, g, or t
  modified_base (450)..(453): a, c, t, g, unknown or other
  misc_feature (450)..(453): n is a, c, g, or t
  modified_base (455)..(471): a, c, t, g, unknown or other
  misc_feature (455)..(471): n is a, c, g, or t
  modified_base (473)..(486): a, c, t, g, unknown or other
  misc_feature (473)..(486): n is a, c, g, or t
tcagtagtgtagatcacgaccggtgctcgatttagctagtcactcaagggggaaaggggctggagtgggtctcagctattaatgggaatggtgataccacatacgtacgcagactccgtnaagggccggttcaccatctccaggggacaattccaagaacacactgtctctgcaaatgaacagccctgagagtcgaggacacgggccttaatattaactgtgcgagagatcagacgggagtatagcaggcaggctctgactactggggccacgggaacccctggtcaaccgtctcctcagcctccacccaagggccccaatcggtcttccccctggccaccctcctccaacgacgcaccgttctgggggccactagccggcccgtgggctgcctggtcaaggactacttccatctacactactgacgcgggctgggcaaggcgcgatagnnnngnnnnnnnnnnnnnnnnngnnnnnnnnnnnnnn

SEQ ID NO: 294659 - DNA, 441 bp, Homo sapiens
  misc_feature: GYAE6OF02I1BT3.37.77.G11.1.454.CMB.1.raw
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggagcacctccgagagcacagcggccctgggctgcctggtcaggactacttccatctacactactgagcgggctggcaaggcgcatagnnnnnn

SEQ ID NO: 294660 - DNA, 452 bp, Homo sapiens
  misc_feature: GYAE6OF02J1WFQ.37.77.G11.1.454.CMB.1.raw
  modified_base (431)..(431): a, c, t, g, unknown or other
  misc_feature (431)..(431): n is a, c, g, or t
  modified_base (438)..(452): a, c, t, g, unknown or other
  misc_feature (438)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggccccatcggtctccccctggcgccctgctccaggagcacctccgagagcatagcggccctgggctgcctggtcaagggctacgtccatctacactactgagcgggctggcaaggcncatagcnnnnnnnnnnnnnnn

SEQ ID NO: 294661 - DNA, 441 bp, Homo sapiens
  misc_feature: GYAE6OF02HR1RQ.37.77.G11.1.454.CMB.1.raw
  modified_base (436)..(441): a, c, t, g, unknown or other
  misc_feature (436)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggcgccctgctccaggacgcacctccgagagcacagcggccctgggctgcctggtcaaggactactccatctacctactgagcgggctggcaaggcgcatagnnnnnn

SEQ ID NO: 294662 - DNA, 452 bp, Homo sapiens
  misc_feature: GYAE6OF02IK7JY.37.77.G11.1.454.CMB.1.raw
  modified_base (438)..(452): a, c, t, g, unknown or other
  misc_feature (438)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctgggtcctggtactttgacgactggggccagggaacccctggtcaccgtctcctcagcctccaccaagggcccatcggtcttccccctggcgccctgctccaggagcacctccgagagcacagcggcctgggctgcctggtcaaggactacttccatctacactactgagcgggctggcaaggcgcatagnnnnnnnnnnnnnnn

SEQ ID NO: 294663 - DNA, 442 bp, Homo sapiens; identical to SEQ ID NO: 294323
  misc_feature: GYAE6OF02G2LPM.37.77.G11.1.454.CMB.1.raw
  modified_base (436)..(442): a, c, t, g, unknown or other
  misc_feature (436)..(442): n is a, c, g, or t

SEQ ID NO: 294664 - DNA, 448 bp, Homo sapiens
  misc_feature: GYAE6OF02JR5D6.37.77.G11.1.454.CMB.1.raw
  modified_base (406)..(406): a, c, t, g, unknown or other
  misc_feature (406)..(406): n is a, c, g, or t
  modified_base (426)..(426): a, c, t, g, unknown or other
  misc_feature (426)..(426): n is a, c, g, or t
  modified_base (433)..(448): a, c, t, g, unknown or other
  misc_feature (433)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccaggaaccctggtcaccgtctcctcagcctcaccaaggcccatcggtctccccctggcgccctgctccaggagcacctccgagagcacagcggccctgggctgcctggtcaaggctactccatctacactacngagcgggctggccaagggcncactagnnnnnnnnnnnnnnnn

SEQ ID NO: 294665 - DNA, 455 bp, Homo sapiens
  misc_feature: GYAE6OF02IL8TS.37.77.G11.1.454.CMB.1.raw
  modified_base (445)..(455): a, c, t, g, unknown or other
  misc_feature (445)..(455): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccaggggaacccctggtcaccgtctcctcagcctccaccaaggggcccatcggtcttccccctggcgcccctgctccaggacgcacctccgagagcacagcggccctgggctgcctggtcaacggactacttccatcctacactactgagcgggctgggcaaggcgcatagnnnnnnnnnnn

SEQ ID NO: 294666 - DNA, 509 bp, Homo sapiens
  misc_feature: GYAE6OF02GQDZA.37.77.G11.1.454.CMB.1.raw
  modified_base (379)..(379): a, c, t, g, unknown or other
  misc_feature (379)..(379): n is a, c, g, or t
  modified_base (445)..(445): a, c, t, g, unknown or other
  misc_feature (445)..(445): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
  modified_base (473)..(474): a, c, t, g, unknown or other
  misc_feature (473)..(474): n is a, c, g, or t
  modified_base (476)..(477): a, c, t, g, unknown or other
  misc_feature (476)..(477): n is a, c, g, or t
  modified_base (479)..(479): a, c, t, g, unknown or other
  misc_feature (479)..(479): n is a, c, g, or t
  modified_base (481)..(491): a, c, t, g, unknown or other
  misc_feature (481)..(491): n is a, c, g, or t
  modified_base (493)..(493): a, c, t, g, unknown or other
  misc_feature (493)..(493): n is a, c, g, or t
  modified_base (495)..(503): a, c, t, g, unknown or other
  misc_feature (495)..(503): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
tcagtagtgtagatcacgaccggtgctcgatttagctagtcactcaaggggtaaagggggcctaggagtcgggtcttcgagctacttaatgggaatggtgactaccacatactacgcgagactccgtgaagggccggtttcaccgatctccagggacaattccaagaacacactgtctctgcaaatggaacagcctgagagtcgaggacacggcccttagtacttactgtagtgaagggacctctaaggccccctttataggtccagtccggactggtcctggtacttttgacgactggggccagggaacccctggtcacggtctctcagcctcgacaagggcccatcggtctcccccgtggcgccctgccttccaggngcacctcgagagcacagacggcctgggctgcctggtcaaggactactccgaatctacactacgtgngcgggntcggacaaggtcgcatgatngnngnngngnnnnnnnnnnngngnnnnnnnnncncnnc

SEQ ID NO: 294667 - DNA, 430 bp, Homo sapiens
  misc_feature: GYAE6OF02JSUMP.37.77.G11.1.454.CMB.1.raw
  modified_base (398)..(398): a, c, t, g, unknown or other
  misc_feature (398)..(398): n is a, c, g, or t
  modified_base (424)..(430): a, c, t, g, unknown or other
  misc_feature (424)..(430): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccctatagcagcggctggtcctggtactttgacgactggggccagggaaccctggtcaccgtctcctcagcctccaccaagggcccatcggtctccccctggcgccctgctccaggagcacctccgagagcacagcgcctggctgcctggtcaggctactccatcacnctactgagcggctggcaggcgcatgnnnnnnn

SEQ ID NO: 294668 - DNA, 448 bp, Homo sapiens
  misc_feature: GYAE6OF02G5JKR.37.77.G11.1.454.CMB.1.raw
  modified_base (440)..(448): a, c, t, g, unknown or other
  misc_feature (440)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatccggtccttccccctggccgccctgcctccaggacgcacctccgagagcacagcggccctgggctgcctggtcaaggactacttccatctacactactgagcggctggcaggcgcatagnnnnnnnnn

SEQ ID NO: 294669 - DNA, 492 bp, Homo sapiens
  misc_feature: GYAE6OF02JKE9X.37.77.G11.1.454.CMB.1.raw
  modified_base (457)..(457): a, c, t, g, unknown or other
  misc_feature (457)..(457): n is a, c, g, or t
  modified_base (460)..(477): a, c, t, g, unknown or other
  misc_feature (460)..(477): n is a, c, g, or t
  modified_base (479)..(492): a, c, t, g, unknown or other
  misc_feature (479)..(492): n is a, c, g, or t
tcagtagtgtagatcacgaccggtgctcgatttagctagtcactcgaagggaaagggggctggagtgggtctcagctattaaagggaatggtgataccacatactacgcagactccgtgaagggccggttcaccatctccagggacaattccaagtaacacactgtctctgcaaatgaacagcctgagagtcgaggacacggccgttatattactgtgtggaagggacctctagccccttatagcagcggctggtcctggtactttgacgactggggccagggaaccctggtacaccggtctcctcagccctccaccgaagggccccagtccggtccttccccctggtcgccccttgcctccagggtacgccacctccgagacgcacagccgccctgggctgctggcaaggctactccatctacactactgagcgggctcggcaaggcgacagtagnagnnnnnnnnnnnnnnnnnngnnnnnnnnnnnnnn

SEQ ID NO: 294670 - DNA, 454 bp, Homo sapiens
  misc_feature: GYAE6OF02IA5IX.37.77.G11.1.454.CMB.1.raw
  modified_base (352)..(352): a, c, t, g, unknown or other
  misc_feature (352)..(352): n is a, c, g, or t
  modified_base (444)..(454): a, c, t, g, unknown or other
  misc_feature (444)..(454): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaccctggtcaccgtctcctcagcctccaccaagggcccatcggtccttccccctggccgccctgcctccaggngcacctccgagagcacacgcggccctgggctgccctggtcaagggtactacgttccatctacactactgagcgggctggcaaggcgcatagnnnnnnnnnnn

SEQ ID NO: 294671 - DNA, 675 bp, Homo sapiens
  misc_feature: GYAE6OF02GW2GS.37.77.G11.1.454.CMB.1.raw
  modified_base (604)..(604): a, c, t, g, unknown or other
  misc_feature (604)..(604): n is a, c, g, or t
  modified_base (637)..(637): a, c, t, g, unknown or other
  misc_feature (637)..(637): n is a, c, g, or t
  modified_base (643)..(645): a, c, t, g, unknown or other
  misc_feature (643)..(645): n is a, c, g, or t
  modified_base (647)..(675): a, c, t, g, unknown or other
  misc_feature (647)..(675): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccaggggacaattccaagaacacacttgtctctcgaactaagtacgaaacgacgtccgtaggaaggtacggtacgggaacggaaccggacccggttacctttaatttaactttacgttggttggtaagggaaccgggtacccttacgtacccgttacccctttaagtacgacgacgggccggtcggttccggttccgttacggtttacgtttacggaaccgtacggggtcgggggaccggaaccgggtaacccgttggtaccgtacccgttccttcctacgaccgtccctacccaaccggaccgggacctacggtccggtttccccttccccggtgggccccgtccgtcgtccctaccggagggcacctaccgtacggaggacgaccacgacgggccccgtccggtcgggtctcgccggttcggtacggaacggtaccttacctacctacttaccaacctacgtacgnggacgggccgggtcgtcgggacgtacgggccanagtagnnncnnnnnnnnnnnnnnnnnnnnnnnnnnnnn

SEQ ID NO: 294672 - DNA, 447 bp, Homo sapiens
  misc_feature: GYAE6OF02I36JQ.37.77.G11.1.454.CMB.1.raw
  modified_base (437)..(447): a, c, t, g, unknown or other
  misc_feature (437)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgccctggtcaaggactacttccatctacactactgagcgggctggcaaggcgcatagnnnnnnnnnnn

SEQ ID NO: 294673 - DNA, 448 bp, Homo sapiens
  misc_feature: GYAE6OF02F7DDW.37.77.G11.1.454.CMB.1.raw
  modified_base (440)..(448): a, c, t, g, unknown or other
  misc_feature (440)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatccggtcttccccctggccgccctgcctccaggagcacctccgagagcacagcggccctgggctgcctggtcaagggactacttccatctacactactgagcgggctggcaggcgcatagnnnnnnnnn

SEQ ID NO: 294674 - DNA, 440 bp, Homo sapiens
  misc_feature: GYAE6OF02GSWNK.37.77.G11.1.454.CMB.1.raw
  modified_base (436)..(440): a, c, t, g, unknown or other
  misc_feature (436)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnn

SEQ ID NO: 294675 - DNA, 476 bp, Homo sapiens
  misc_feature: GYAE6OF02HBLZO.37.77.G11.1.454.CMB.1.raw
  modified_base (344)..(344): a, c, t, g, unknown or other
  misc_feature (344)..(344): n is a, c, g, or t
  modified_base (443)..(476): a, c, t, g, unknown or other
  misc_feature (443)..(476): n is a, c, g, or t
tcagtagtgtagatcacgaccggtgctcgattttagctagtcactcgaagggaaagggggctggagtgggtctcagctattaaagggaatggtgataccacatactacgcagactccgtgaagggccggttcaccatctccagggacaattccaaggtaacacactgtcttctgcaaatgaacagcctgagagtcgaggacacggccgttatattactgtgtggaagggactctagccccttatagcagcggctggtcctggtacttgacgactggggccagggaaccctggtcaccggtctcctcagcctccaccgagggcccatcggtcttccccctggtcnccctgctccaggagcacctccgagagcacagcggccctgggctgcctggcaggactactccatctacactactgacgcgggctcggcaaggcgcatagnnnnnnnnnnnnnnnnnnnnnnnnnnnnnnnnnn

SEQ ID NO: 294676 - DNA, 442 bp, Homo sapiens
  misc_feature: GYAE6OF02FIT75.37.77.G11.1.454.CMB.1.raw
  modified_base (437)..(442): a, c, t, g, unknown or other
  misc_feature (437)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggccgccctgctccaggagcacctccgagagcacagcggccctgggctgcctggtcaaggctacttccatctacactactgagcgggctggcaaggcgcatagnnnnnn

SEQ ID NO: 294677 - DNA, 446 bp, Homo sapiens
  misc_feature: GYAE6OF02I1WW6.37.77.G11.1.454.CMB.1.raw
  modified_base (437)..(446): a, c, t, g, unknown or other
  misc_feature (437)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcgccctggctgcctggtcaagggactacttccatctacactactgacgcgggctggcaaggcgcatagcnnnnnnnnnn

SEQ ID NO: 294678 - DNA, 440 bp, Homo sapiens
  misc_feature: GYAE6OF02FG120.37.77.G11.1.454.CMB.1.raw
  modified_base (436)..(440): a, c, t, g, unknown or other
  misc_feature (436)..(440): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnn

SEQ ID NO: 294679 - DNA, 452 bp, Homo sapiens
  misc_feature: GYAE6OF02GYTIW.37.77.G11.1.454.CMB.1.raw
  modified_base (439)..(452): a, c, t, g, unknown or other
  misc_feature (439)..(452): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggccccatcggtcttccccctggccgccctgctccaggagcacctccgagagcacagcggccctgggctgcctggtcaaggactacttccatctacactactgagcgggctggcaaggcgcatagnnnnnnnnnnnnnn

SEQ ID NO: 294680 - DNA, 447 bp, Homo sapiens
  misc_feature: GYAE6OF02G4YCM.37.77.G11.1.454.CMB.1.raw
  modified_base (440)..(447): a, c, t, g, unknown or other
  misc_feature (440)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccgccctgctccaggacgcacctccgagacgcacagcggccctgggctgcctggtcaaggactacttccatctacactactgagcgggctggcaagggcgcatgnnnnnnnn

SEQ ID NO: 294681 - DNA, 455 bp, Homo sapiens
  misc_feature: GYAE6OF02JBJDC.37.77.G11.1.454.CMB.1.raw
  modified_base (442)..(455): a, c, t, g, unknown or other
  misc_feature (442)..(455): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaaggcccatccggtcttccccctggccgccctgcctccaggacgcacctccgagacgcacagcggccctgggctgcctggtcaaggctactccatctacactactgacgcgggctggcaaggcgacagtagnnnnnnnnnnnnnn

SEQ ID NO: 294682 - DNA, 446 bp, Homo sapiens
  misc_feature: GYAE6OF02FWCZB.37.77.G11.1.454.CMB.1.raw
  modified_base (350)..(350): a, c, t, g, unknown or other
  misc_feature (350)..(350): n is a, c, g, or t
  modified_base (436)..(446): a, c, t, g, unknown or other
  misc_feature (436)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggancacctccgagagcacagcggccctgggctgcctggtcaaggctacttccatctacactactgagcgggctggcaaggcgcagtagnnnnnnnnnnn

SEQ ID NO: 294683 - DNA, 448 bp, Homo sapiens
  misc_feature: GYAE6OF02HQ0WI.37.77.G11.1.454.CMB.1.raw
  modified_base (439)..(448): a, c, t, g, unknown or other
  misc_feature (439)..(448): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacacgcggccctgggctgcctggtcaaggactacttccatctacactactgacgcgggctggcaaggcgcatagnnnnnnnnnn

SEQ ID NO: 294684 - DNA, 443 bp, Homo sapiens
  misc_feature: GYAE6OF02HQSDN.37.77.G11.1.454.CMB.1.raw
  modified_base (436)..(443): a, c, t, g, unknown or other
  misc_feature (436)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcatagnnnnnnnn

SEQ ID NO: 294685 - DNA, 412 bp, Homo sapiens
  misc_feature: GYAE6OF02I09EA.37.77.G11.1.454.CMB.1.raw
  modified_base (371)..(371): a, c, t, g, unknown or other
  misc_feature (371)..(371): n is a, c, g, or t
  modified_base (404)..(412): a, c, t, g, unknown or other
  misc_feature (404)..(412): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacacgctctatctgcaaatgaacagcctgagagccgaagacacggccgtatattactgtgtgaaaggctggggatggggggactactggggccagggaacccctggtcaccgtctcctcagcctccaccaagggcccatcggtcttcccctggcaccctcctccagagcacctctggggcacagcggcctgggctgcctggtcaaggactacttccntctacactactgagcggctggcaaggcgcatgnnnnnnnnn

SEQ ID NO: 294686 - DNA, 442 bp, Homo sapiens
  misc_feature: GYAE6OF02JAIXQ.37.77.G11.1.454.CMB.1.raw
  modified_base (433)..(433): a, c, t, g, unknown or other
  misc_feature (433)..(433): n is a, c, g, or t
  modified_base (438)..(442): a, c, t, g, unknown or other
  misc_feature (438)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtccttccccctggccgccctcgctccaggagcacctccgagagcacagcggccctgggctgcctggtcaggactacttccatcctacactactgagcgggctggcaaggcncatgnnnnn

SEQ ID NO: 294687 - DNA, 439 bp, Homo sapiens
  misc_feature: GYAE6OF02F94QD.37.77.G11.1.454.CMB.1.raw
  modified_base (435)..(439): a, c, t, g, unknown or other
  misc_feature (435)..(439): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctccccctggcgccctgctccaggagcacctccgagagcacagcggccctgggctgcctggtcaaggactacttccatctacactactgagcgggctggcaaggcgcatagnnnnn

SEQ ID NO: 294688 - DNA, 541 bp, Homo sapiens
  misc_feature: GYAE6OF02J27OJ.37.77.G11.1.454.CMB.1.raw
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
  modified_base (510)..(541): a, c, t, g, unknown or other
  misc_feature (510)..(541): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctcccagggacaattccaagaacacactgtctctgacaaatgaacagcctgagagtcgaggacacggccttatattactgtgtgaacgggacctctacgcccccttatacgcagcggtctcggtcctggtactttgacgacgtggggccagggtacccctggtccaccgtctcctcgagtccctccgaccgacgggcccctagtccggtacccttccccgnggcccgccctgcctccgaggacnccaacctccgagacgccacgacggcccggtcccgtgggcctcgcccgtaggtaccgaacggtcctaccttccatacctacctacgttacgtggaacgtccggggtactacggacgaacggctacgaatcgnnnnnnnnnnnnnnnnnnnnnnnnnnnnnnnn

SEQ ID NO: 294689 - DNA, 445 bp, Homo sapiens
  misc_feature: GYAE6OF02GDR8B.37.77.G11.1.454.CMB.1.raw
  modified_base (430)..(430): a, c, t, g, unknown or other
  misc_feature (430)..(430): n is a, c, g, or t
  modified_base (436)..(445): a, c, t, g, unknown or other
  misc_feature (436)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtcttccccctggcgccctgctccaggagcacctccgagagcacagcggccctgggctgcctggtcaaggactactccatctacactactgagcgggctggcaaggcncatagnnnnnnnnnn

SEQ ID NO: 294690 - DNA, 441 bp, Homo sapiens
  misc_feature: GYAE6OF02F1CID.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtctccccctggcgccctgctccaggagcacctccgagagcacagcgccctgggctgcctggtcaaggactacttccatctacactactgagcgggctggcaaggcgcatagnnnnnnn

SEQ ID NO: 294691 - DNA, 458 bp, Homo sapiens
  misc_feature: GYAE6OF02FZNIO.37.77.G11.1.454.CMB.1.raw
  modified_base (352)..(352): a, c, t, g, unknown or other
  misc_feature (352)..(352): n is a, c, g, or t
  modified_base (363)..(363): a, c, t, g, unknown or other
  misc_feature (363)..(363): n is a, c, g, or t
  modified_base (419)..(419): a, c, t, g, unknown or other
  misc_feature (419)..(419): n is a, c, g, or t
  modified_base (443)..(458): a, c, t, g, unknown or other
  misc_feature (443)..(458): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggcgccctgcctccaggancacctccgagngcacagcggccctgggctgcctggtcaaggctacgtcctactactacactactcgngcggcgtggcgagacggcactagnnnnnnnnnnnnnnnn

SEQ ID NO: 294692 - DNA, 446 bp, Homo sapiens
  misc_feature: GYAE6OF02F9D0R.37.77.G11.1.454.CMB.1.raw
  modified_base (437)..(446): a, c, t, g, unknown or other
  misc_feature (437)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtctcccctggccgccctgctccaggagcacctccgagacgcacagcggccctgggctgcctggtcagggactacttccatctacactactgagcgggctggcaaggcgcagtgnnnnnnnnnn

SEQ ID NO: 294693 - DNA, 446 bp, Homo sapiens
  misc_feature: GYAE6OF02F8SU8.37.77.G11.1.454.CMB.1.raw
  modified_base (437)..(446): a, c, t, g, unknown or other
  misc_feature (437)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccaggggaacccctggtcaccgtctcctcagcctccaccagggcccatcggtcttccccctggcgccctgctccaggacgcacctccgagagcacagcggcctgggctgcctggtcaggactacttccatctacactactgagcgggctggcaaggcgcatagnnnnnnnnnn

SEQ ID NO: 294694 - DNA, 442 bp, Homo sapiens
  misc_feature: GYAE6OF02ITZCA.37.77.G11.1.454.CMB.1.raw
  modified_base (430)..(430): a, c, t, g, unknown or other
  misc_feature (430)..(430): n is a, c, g, or t
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcagcctccaccaagggcccatcggtctcccctggcgccctgctccaggagcacctccgagagcacagcggccctgggctgcctggtcaaggactacttccatctacactactgagcgggctggcaaggcncatagnnnnnnn

SEQ ID NO: 294695 - DNA, 450 bp, Homo sapiens
  misc_feature: GYAE6OF02JP7T5.37.77.G11.1.454.CMB.1.raw
  modified_base (440)..(450): a, c, t, g, unknown or other
  misc_feature (440)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttccccctggccgccctgcccccaggacgcacctccgagagcacagcggccctgggctgcctggtcaaggctacttccatctacactactgagcggctggcaaggcgcatacgnnnnnnnnnnn

SEQ ID NO: 294696 - DNA, 436 bp, Homo sapiens
  misc_feature: GYAE6OF02HSEXF.37.77.G11.1.454.CMB.1.raw
  modified_base (431)..(436): a, c, t, g, unknown or other
  misc_feature (431)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggcctgggctgcctggtcaaggctactcatctacactactgagcggctggcaaggcgcatagnnnnnn

SEQ ID NO: 294697 - DNA, 445 bp, Homo sapiens
  misc_feature: GYAE6OF02G46I2.37.77.G11.1.454.CMB.1.raw
  modified_base (433)..(433): a, c, t, g, unknown or other
  misc_feature (433)..(433): n is a, c, g, or t
  modified_base (439)..(445): a, c, t, g, unknown or other
  misc_feature (439)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctcgctccaggagcacctccgagacgcacagcggccctgggctgcctggtcaaggactacttccatcctacactactgagcgggctggcaaggcncatagnnnnnnn

SEQ ID NO: 294698 - DNA, 511 bp, Homo sapiens
  misc_feature: GYAE6OF02FVDV8.37.77.G11.1.454.CMB.1.raw
  modified_base (470)..(470): a, c, t, g, unknown or other
  misc_feature (470)..(470): n is a, c, g, or t
  modified_base (478)..(478): a, c, t, g, unknown or other
  misc_feature (478)..(478): n is a, c, g, or t
  modified_base (480)..(482): a, c, t, g, unknown or other
  misc_feature (480)..(482): n is a, c, g, or t
  modified_base (485)..(488): a, c, t, g, unknown or other
  misc_feature (485)..(488): n is a, c, g, or t
  modified_base (490)..(497): a, c, t, g, unknown or other
  misc_feature (490)..(497): n is a, c, g, or t
  modified_base (499)..(511): a, c, t, g, unknown or other
  misc_feature (499)..(511): n is a, c, g, or t
tcagtagtgtagatcacgaccggtgctcgattttagctagtcactcgtaaggggaaaggggctggagtgggtctcagctattaatgggaatggtgataccacgactactacgcagactccggtgaacgggccggttcaccatcgtccaggggacaaattccaagaaactacactgtctcctgcaaatcgaacagccctgacgagttcgaggacacggccttatattactgtgtgaagggacctctagccccttatagcagcggctggtcctggtactttgacgactggggtaccagggaacccctggtcaccgtctacctcacgcctcccaaccaagggccccagtcggttccttcccccgtggccgcccctagccttccgaggagcgaccctccgagacgcacgagcggcctgggctgccgtggtacaaggctacttccatctacactactgacgcgggctggcaggcnctatacgncnnncannnntnnnnnnnngnnnnnnnnnnnnn

SEQ ID NO: 294699 - DNA, 447 bp, Homo sapiens
  misc_feature: GYAE6OF02F5L4L.37.77.G11.1.454.CMB.1.raw
  modified_base (431)..(431): a, c, t, g, unknown or other
  misc_feature (431)..(431): n is a, c, g, or t
  modified_base (436)..(447): a, c, t, g, unknown or other
  misc_feature (436)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtctccccctggcgccctgcctccaggagcacctccgagagcacagcggccctgggcctgcctggtcaaggactactccatctacactactgagcgggctggcaaggcgnatagnnnnnnnnnnnn

SEQ ID NO: 294700 - DNA, 445 bp, Homo sapiens
  misc_feature: GYAE6OF02JAZK2.37.77.G11.1.454.CMB.1.raw
  modified_base (437)..(445): a, c, t, g, unknown or other
  misc_feature (437)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaacccctggtcaccgtctcctcagcctccaccaagggcccatcggtcttccccctggccgccctgcctccaggagcacctccgagacgcacagcggccctgggctgcctggcaaggctactccatctacactactgagcgggctggcaggcgcatagnnnnnnnnn

SEQ ID NO: 294701 - DNA, 443 bp, Homo sapiens
  misc_feature: GYAE6OF02F1X30.37.77.G11.1.454.CMB.1.raw
  modified_base (350)..(350): a, c, t, g, unknown or other
  misc_feature (350)..(350): n is a, c, g, or t
  modified_base (407)..(407): a, c, t, g, unknown or other
  misc_feature (407)..(407): n is a, c, g, or t
  modified_base (436)..(443): a, c, t, g, unknown or other
  misc_feature (436)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggancacctcgagagcacagcggccctgggctgcctggtcaagggactacttccatctacnctactgagcgggctggcaaggcgcatagnnnnnnnn

SEQ ID NO: 294702 - DNA, 441 bp, Homo sapiens
  misc_feature: GYAE6OF02IIHUF.37.77.G11.1.454.CMB.1.raw
  modified_base (428)..(428): a, c, t, g, unknown or other
  misc_feature (428)..(428): n is a, c, g, or t
  modified_base (434)..(441): a, c, t, g, unknown or other
  misc_feature (434)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtctccccctggcgccctgctccaggagcacctccgagagcacagcggccctggctgcctggtcaagggactacttccatctacactactgagcgggctggcaaggcncatagnnnnnnnn

SEQ ID NO: 294703 - DNA, 443 bp, Homo sapiens
  misc_feature: GYAE6OF02GPHVT.37.77.G11.1.454.CMB.1.raw
  modified_base (436)..(443): a, c, t, g, unknown or other
  misc_feature (436)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatcggtcttccccctggcgccctgctccaggagcacctccgagagcacagcggccctgggctgcctggtcaggactacttccatctacactactgagcgggctggcaaggcgcatagnnnnnnnn

SEQ ID NO: 294704 - DNA, 468 bp, Homo sapiens
  misc_feature: GYAE6OF02GUP7Y.37.77.G11.1.454.CMB.1.raw
  modified_base (330)..(330): a, c, t, g, unknown or other
  misc_feature (330)..(330): n is a, c, g, or t
  modified_base (347)..(347): a, c, t, g, unknown or other
  misc_feature (347)..(347): n is a, c, g, or t
  modified_base (394)..(394): a, c, t, g, unknown or other
  misc_feature (394)..(394): n is a, c, g, or t
  modified_base (399)..(399): a, c, t, g, unknown or other
  misc_feature (399)..(399): n is a, c, g, or t
  modified_base (419)..(423): a, c, t, g, unknown or other
  misc_feature (419)..(423): n is a, c, g, or t
  modified_base (425)..(425): a, c, t, g, unknown or other
  misc_feature (425)..(425): n is a, c, g, or t
  modified_base (427)..(428): a, c, t, g, unknown or other
  misc_feature (427)..(428): n is a, c, g, or t
  modified_base (432)..(433): a, c, t, g, unknown or other
  misc_feature (432)..(433): n is a, c, g, or t
  modified_base (436)..(436): a, c, t, g, unknown or other
  misc_feature (436)..(436): n is a, c, g, or t
  modified_base (438)..(438): a, c, t, g, unknown or other
  misc_feature (438)..(438): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (445)..(445): a, c, t, g, unknown or other
  misc_feature (445)..(445): n is a, c, g, or t
  modified_base (447)..(448): a, c, t, g, unknown or other
  misc_feature (447)..(448): n is a, c, g, or t
  modified_base (450)..(450): a, c, t, g, unknown or other
  misc_feature (450)..(450): n is a, c, g, or t
  modified_base (452)..(453): a, c, t, g, unknown or other
  misc_feature (452)..(453): n is a, c, g, or t
  modified_base (456)..(457): a, c, t, g, unknown or other
  misc_feature (456)..(457): n is a, c, g, or t
  modified_base (459)..(460): a, c, t, g, unknown or other
  misc_feature (459)..(460): n is a, c, g, or t
  modified_base (463)..(463): a, c, t, g, unknown or other
  misc_feature (463)..(463): n is a, c, g, or t
tcagtagtgtagatcacgaccggtgctcgatttagctagtcactcaagggaaagggctggagtgggtctcagctattaatgggaatggtgataccacatactacgcagactccgtgaagggccggttcaccatctccagggacaattccaagacacactgtctctgcaaatgaacagcctgagagtcgaggacacggccttagtattactgtgtgaagggacctctagccccttatacgcagcggctggtcctggtactttgacgactggggccagggaaccctggtcaccgtctcctcagcctccacacggcccagtcggtcttccccnggccgcctgctccaggnccactccgagcgcacagcgcctggctgcctgtacagctctcatcacnctacngagcggctggcagcgcagtnnnnntnanncgtnncgncngncgncntnncngnngcnncnnctngtacg

SEQ ID NO: 294705 - DNA, 447 bp, Homo sapiens
  misc_feature: GYAE6OF02I9XCS.37.77.G11.1.454.CMB.1.raw
  modified_base (434)..(447): a, c, t, g, unknown or other
  misc_feature (434)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtctccccctggcgccctgcctccaggagcacctccgagagcacagcggccctgggctgcctggtcaaggctactccatctacactactgagcgggctggcaggcgcatagnnnnnnnnnnnnnn

SEQ ID NO: 294706 - DNA, 444 bp, Homo sapiens
  misc_feature: GYAE6OF02JDMCU.37.77.G11.1.454.CMB.1.raw
  modified_base (431)..(444): a, c, t, g, unknown or other
  misc_feature (431)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccagggcccatcggtcttcccctggcgccctgcctccaggagcacctccgagacgcacagcggccctgggctgcctggtcaggctactcatctacactactgagcggctggcaaggcgcatagnnnnnnnnnnnnnn

SEQ ID NO: 294707 - DNA, 444 bp, Homo sapiens
  misc_feature: GYAE6OF02GPNL2.37.77.G11.1.454.CMB.1.raw
  modified_base (428)..(428): a, c, t, g, unknown or other
  misc_feature (428)..(428): n is a, c, g, or t
  modified_base (434)..(444): a, c, t, g, unknown or other
  misc_feature (434)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctcaccaagggcccatcggtctccccctggcgccctgctccaggacgcacctccgagagcacagcggccctgggctgcctggtcaaggctacttccatctacactactgagcgggctggcaaggcncatagnnnnnnnnnnn

SEQ ID NO: 294708 - DNA, 448 bp, Homo sapiens
  misc_feature: GYAE6OF02FSVKA.37.77.G11.1.454.CMB.1.raw
  modified_base (411)..(411): a, c, t, g, unknown or other
  misc_feature (411)..(411): n is a, c, g, or t
  modified_base (434)..(434): a, c, t, g, unknown or other
  misc_feature (434)..(434): n is a, c, g, or t
  modified_base (440)..(448): a, c, t, g, unknown or other
  misc_feature (440)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatccggtcttccccctggccgccctgcctccaggagcacctccgagagcacagcggccctgggctgcctggtcaaggactacttccatctacnctactgagcgggctggcaaggcncatagnnnnnnnnn

SEQ ID NO: 294709 - DNA, 429 bp, Homo sapiens
  misc_feature: GYAE6OF02HSURG.37.77.G11.1.454.CMB.1.raw
  modified_base (421)..(429): a, c, t, g, unknown or other
  misc_feature (421)..(429): n is a, c, g, or t
tcagtagtgtagatcacgaccggtgctcgatttagctagtcactcaagggaaggggctggagtgggtctcagctattaatgggaatggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaaggcccatccggtcttccccctggccaccctcctccaagacgcacctctggggcacagcggcctgggctgcctggtcaaggactactccatctacactactgagcgggctgggcaaggcgcagtagnnnnnnnnn

SEQ ID NO: 294710 - DNA, 455 bp, Homo sapiens
  misc_feature: GYAE6OF02HUOW3.37.77.G11.1.454.CMB.1.raw
  modified_base (443)..(455): a, c, t, g, unknown or other
  misc_feature (443)..(455): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccggtctcctcagccctccaccaagggcccatcggtccttccccctggccgccctcgctccaggacgcacctccgagacgcacagccggccctgggctgcctggtcaaggctactccactctacactactgagcgggctggcaaggcgcatagnnnnnnnnnnnnn

SEQ ID NO: 294711 - DNA, 435 bp, Homo sapiens
  misc_feature: GYAE6OF02INVHZ.37.77.G11.1.454.CMB.1.raw
  modified_base (327)..(327): a, c, t, g, unknown or other
  misc_feature (327)..(327): n is a, c, g, or t
  modified_base (330)..(330): a, c, t, g, unknown or other
  misc_feature (330)..(330): n is a, c, g, or t
  modified_base (342)..(342): a, c, t, g, unknown or other
  misc_feature (342)..(342): n is a, c, g, or t
  modified_base (427)..(435): a, c, t, g, unknown or other
  misc_feature (427)..(435): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctcaaccaggccatcggtctccccngcncctgctccaggncactccgagacgcacagcggccctgggctgcctggtcaaggctacttccatctacactactgagcgggctggcaaggcgcatagnnnnnnnnn

SEQ ID NO: 294712 - DNA, 456 bp, Homo sapiens
  misc_feature: GYAE6OF02HGRQO.37.77.G11.1.454.CMB.1.raw
  modified_base (442)..(456): a, c, t, g, unknown or other
  misc_feature (442)..(456): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatccggtcttccccctggccgcccctgctccaggacgccacctccgagacgcacagcggcctgggctgcctggtcaaggctacgttccatctacactactgagcgggctggcaaggcgcatagnnnnnnnnnnnnnnn

SEQ ID NO: 294713 - DNA, 434 bp, Homo sapiens
  misc_feature: GYAE6OF02GUS1P.37.77.G11.1.454.CMB.1.raw
  modified_base (425)..(434): a, c, t, g, unknown or other
  misc_feature (425)..(434): n is a, c, g, or t
tcagtagtgtagatcacgaccggtgctcgatttagctagtcactcaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcagcctccaccaagggcccatcggtcttcccccgtggccaccctcctccaagacgcacctctgggggcacagcggccctgggctgcctggtcaaggactacttccatctacactactgagcgggctggcaaggcgcatagnnnnnnnnnn

SEQ ID NO: 294714 - DNA, 446 bp, Homo sapiens
  misc_feature: GYAE6OF02JZCUU.37.77.G11.1.454.CMB.1.raw
  modified_base (350)..(350): a, c, t, g, unknown or other
  misc_feature (350)..(350): n is a, c, g, or t
  modified_base (432)..(432): a, c, t, g, unknown or other
  misc_feature (432)..(432): n is a, c, g, or t
  modified_base (438)..(446): a, c, t, g, unknown or other
  misc_feature (438)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggcccatcggtcttcccctggccgccctgctccaggacncacctccgagacgcacagcggccctgggctgcctggtccaaggactacttccatctacactactgagcggctggacaaggcncatagnnnnnnnnn

SEQ ID NO: 294715 - DNA, 445 bp, Homo sapiens
  misc_feature: GYAE6OF02GAXZ7.37.77.G11.1.454.CMB.1.raw
  modified_base (350)..(350): a, c, t, g, unknown or other
  misc_feature (350)..(350): n is a, c, g, or t
  modified_base (433)..(433): a, c, t, g, unknown or other
  misc_feature (433)..(433): n is a, c, g, or t
  modified_base (439)..(445): a, c, t, g, unknown or other
  misc_feature (439)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttcccctggcgccctgctccaggancacctccgagagcacagcggcccgtgggctgccctgggtcaaggactacttccatctacactactgagcgggctggcaaggcncatagnnnnnnn

SEQ ID NO: 294716 - DNA, 459 bp, Homo sapiens
  misc_feature: GYAE6OF02I287R.37.77.G11.1.454.CMB.1.raw
  modified_base (355)..(355): a, c, t, g, unknown or other
  misc_feature (355)..(355): n is a, c, g, or t
  modified_base (447)..(459): a, c, t, g, unknown or other
  misc_feature (447)..(459): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcacccgtctcctcacgcctccaccaagggccccatccggtcttccccctggccgccctgctccaggngcacctccgagacgcacagccggccctgggctgcctggtcaaggactacttccatctacactactgagcgggctgggcaagggcgacatagnnnnnnnnnnnnn

SEQ ID NO: 294717 - DNA, 464 bp, Homo sapiens
  misc_feature: GYAE6OF02H95ON.37.77.G11.1.454.CMB.1.raw
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (436)..(436): a, c, t, g, unknown or other
  misc_feature (436)..(436): n is a, c, g, or t
  modified_base (447)..(447): a, c, t, g, unknown or other
  misc_feature (447)..(447): n is a, c, g, or t
  modified_base (454)..(464): a, c, t, g, unknown or other
  misc_feature (454)..(464): n is a, c, g, or t
tcagtagtgtagatcacgaccggtgctcgatttagctagtcactcaagggaaaggggctggagtgggtcgtcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcgctggtcctggtactttgacgactggggccagggaaccctggtcaccggtctcctcagcctccaccaaggccccatcggccttccccctggccgccctgcctccaggagccacctccgagacgccacacgcggccctgggcncgccctggtccaagggactacttcccgatcctacgctacngtagccgggntcggcaaggcncatacgnnnnnnnnnnn

SEQ ID NO: 294718 - DNA, 441 bp, Homo sapiens
  misc_feature: GYAE6OF02GK7SH.37.77.G11.1.454.CMB.1.raw
  modified_base (435)..(441): a, c, t, g, unknown or other
  misc_feature (435)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagagcacagcggccctgggctgcctggtcaaggactactccatctacactactgagcgggctggcaaggcgcatagnnnnnnn

SEQ ID NO: 294719 - DNA, 451 bp, Homo sapiens
  misc_feature: GYAE6OF02IX47P.37.77.G11.1.454.CMB.1.raw
  modified_base (441)..(451): a, c, t, g, unknown or other
  misc_feature (441)..(451): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggcgcacctccgagagcacagcggccctgggctgcctggtcaacgggctacgttccatctacactactgacgcgggctggcaaggcgcatacgnnnnnnnnnnn

SEQ ID NO: 294720 - DNA, 543 bp, Homo sapiens
  misc_feature: GYAE6OF02HCC7C.37.77.G11.1.454.CMB.1.raw
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (505)..(507): a, c, t, g, unknown or other
  misc_feature (505)..(507): n is a, c, g, or t
  modified_base (509)..(509): a, c, t, g, unknown or other
  misc_feature (509)..(509): n is a, c, g, or t
  modified_base (512)..(512): a, c, t, g, unknown or other
  misc_feature (512)..(512): n is a, c, g, or t
  modified_base (514)..(514): a, c, t, g, unknown or other
  misc_feature (514)..(514): n is a, c, g, or t
  modified_base (517)..(519): a, c, t, g, unknown or other
  misc_feature (517)..(519): n is a, c, g, or t
  modified_base (521)..(523): a, c, t, g, unknown or other
  misc_feature (521)..(523): n is a, c, g, or t
  modified_base (527)..(530): a, c, t, g, unknown or other
  misc_feature (527)..(530): n is a, c, g, or t
  modified_base (532)..(532): a, c, t, g, unknown or other
  misc_feature (532)..(532): n is a, c, g, or t
  modified_base (534)..(535): a, c, t, g, unknown or other
  misc_feature (534)..(535): n is a, c, g, or t
  modified_base (538)..(541): a, c, t, g, unknown or other
  misc_feature (538)..(541): n is a, c, g, or t
  modified_base (543)..(543): a, c, t, g, unknown or other
  misc_feature (543)..(543): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttgacgacgtgggccagggtaacctggtccaccgtctcctcacgcctccaaccgaacggcccagtccggtccttccccgtggccgtcccgtgcctccgaggacgccaccgtccgagacgcacgacgccggccgtgggctcgccgtggtacgaacggtaccttaccgttaccacgttacctaaccgtaccttacgtggacggtcgggtacgtcgggacgaacgggccgacgtaacgtacgngtncgcnnngncgncngcnnncnnncgcnnnngncnncgnnnngn

SEQ ID NO: 294721 - DNA, 445 bp, Homo sapiens
  misc_feature: GYAE6OF02FZI26.37.77.G11.1.454.CMB.1.raw
  modified_base (351)..(351): a, c, t, g, unknown or other
  misc_feature (351)..(351): n is a, c, g, or t
  modified_base (431)..(431): a, c, t, g, unknown or other
  misc_feature (431)..(431): n is a, c, g, or t
  modified_base (437)..(445): a, c, t, g, unknown or other
  misc_feature (437)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtctccccctggccgccctgctccaggancacctccgagagcacagcggccctgggctgcctggtcaaggactacttccatctacactactgagcgggctggcaaggcncatagnnnnnnnnn

SEQ ID NO: 294722 - DNA, 446 bp, Homo sapiens
  misc_feature: GYAE6OF02HSLS1.37.77.G11.1.454.CMB.1.raw
  modified_base (438)..(446): a, c, t, g, unknown or other
  misc_feature (438)..(446): n is a, c, g, or t
tcagtagtgtagatcacgaccggtgctcgatttagctagtcactcaagggaaaggggctggagtgggtctcagctattaatgggaatggtgataccacatactaagcagactccgtgaagggccggttcaccatctccagggacaattccaagaacacactgtctctgcaaatgaacagcctgagagtcgaggacacggccttatattactgtgtgaaggaagggtctagcagtgcctggtactcccatactatatggacgtctggggcaaaggaatcgcggtcaccgtctcctcagcctccaccaagggcccatcggtccttcccctggccaccctcctccaacgagccacctcctgggggcacgagcggccctgggctcgcctggcaacggactacttccatctacactactgagcgggctggcaaggcgcatagnnnnnnnnn

SEQ ID NO: 294723 - DNA, 444 bp, Homo sapiens
  misc_feature: GYAE6OF02HN8PL.37.77.G11.1.454.CMB.1.raw
  modified_base (418)..(418): a, c, t, g, unknown or other
  misc_feature (418)..(418): n is a, c, g, or t
  modified_base (429)..(429): a, c, t, g, unknown or other
  misc_feature (429)..(429): n is a, c, g, or t
  modified_base (435)..(444): a, c, t, g, unknown or other
  misc_feature (435)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggaccaattccaagaacacactgtctctgcaaatgaacagcctgagagtcgaggacacggccttatattactgtgtgaagggacctctagcccccttatagcagcggctggtcctggtactttgacgactggggccagggaacccctggtcacccgtctcctcagcctccaccaagggcccatcggtcttccccctgcgccctgctccagagcacctccagacgcacagcgccctggctgcctggtcaaggctacttccatctacactactgagcggntcggcaaggcncatagnnnnnnnnnn

SEQ ID NO: 294724 - DNA, 459 bp, Homo sapiens
  misc_feature: GYAE6OF02JHBNM.37.77.G11.1.454.CMB.1.raw
  modified_base (414)..(414): a, c, t, g, unknown or other
  misc_feature (414)..(414): n is a, c, g, or t
  modified_base (442)..(459): a, c, t, g, unknown or other
  misc_feature (442)..(459): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcagcctccaccaagggcccatccggtccttcccccgtggccgccctgctccaggacgcacctccgagacgcacagccggcccgtgggctgcctggtcaaggctactccatcacnctactgagcggctggcaaggcgcatagnnnnnnnnnnnnnnnnnn

SEQ ID NO: 294725 - DNA, 478 bp, Homo sapiens
  misc_feature: GYAE6OF02IVSNR.37.77.G11.1.454.CMB.1.raw
  modified_base (458)..(458): a, c, t, g, unknown or other
  misc_feature (458)..(458): n is a, c, g, or t
  modified_base (465)..(478): a, c, t, g, unknown or other
  misc_feature (465)..(478): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcacgcctccaccaacgggcccatccgggtccttccccccgtcggccgtcccctgcctccgaggacgccaccctccgagacgcacacgccggccctgggcctgcctggtcaacggacctactccatcctaacactactggacgcgggctgggccaaggcncatacgnnnnnnnnnnnnnn

SEQ ID NO: 294726 - DNA, 467 bp, Homo sapiens
  misc_feature: GYAE6OF02HCOAC.37.77.G11.1.454.CMB.1.raw
  modified_base (439)..(439): a, c, t, g, unknown or other
  misc_feature (439)..(439): n is a, c, g, or t
  modified_base (445)..(467): a, c, t, g, unknown or other
  misc_feature (445)..(467): n is a, c, g, or t
tcagtagtgtagatcacgaccggtgctcgatttagctagtcactcaaggggaaaggggctggagtgggtctcagctattaatgggaatggtgataccacatactacgcagactcccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccaggggaacccctggtcaccgtctcctcagcctccaccaagggcccatcggtcttccccctggcgccctgcctccacggagcacctccgagagcacagcggccctgggctgcctggtcaagggactacgttccatctacactactgagcgggctggcaaggcncatagnnnnnnnnnnnnnnnnnnnnnnn

SEQ ID NO: 294727 - DNA, 444 bp, Homo sapiens
  misc_feature: GYAE6OF02FGX9C.37.77.G11.1.454.CMB.1.raw
  modified_base (435)..(444): a, c, t, g, unknown or other
  misc_feature (435)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaaggcccatcggtctccccctggcgccctgctccaggagcacctccgagagcacagcggccctgggctgcctggtcaagggctacttccatctacactactgagcgggctggcaaggcgcatagnnnnnnnnnn

SEQ ID NO: 294728 - DNA, 443 bp, Homo sapiens
  misc_feature: GYAE6OF02INYQK.37.77.G11.1.454.CMB.1.raw
  modified_base (434)..(443): a, c, t, g, unknown or other
  misc_feature (434)..(443): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatcctacactactgagcgggctggcaaggcgcatagnnnnnnnnnn

SEQ ID NO: 294729 - DNA, 442 bp, Homo sapiens
  misc_feature: GYAE6OF02F3JIU.37.77.G11.1.454.CMB.1.raw
  modified_base (413)..(413): a, c, t, g, unknown or other
  misc_feature (413)..(413): n is a, c, g, or t
  modified_base (436)..(442): a, c, t, g, unknown or other
  misc_feature (436)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccatatattattgtgcgaaacttccttttgactggttattatcccctagtgaccactggggccagggaaccctggtcaccgtctccctcacgcctccaccaacgggcccatcggtccttcccccgtggccacccctcctaccaagacgccacctcgtcgggggcacagccggcccgtgggctgcctggtcaaggactactccatctacactacngagcggctggcaaggcgcatagnnnnnnn

SEQ ID NO: 294730 - DNA, 460 bp, Homo sapiens
  misc_feature: GYAE6OF02IOBIT.37.77.G11.1.454.CMB.1.raw
  modified_base (424)..(424): a, c, t, g, unknown or other
  misc_feature (424)..(424): n is a, c, g, or t
  modified_base (449)..(460): a, c, t, g, unknown or other
  misc_feature (449)..(460): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacggggcccatccggtccttcccccgtggccgcccctgcctccaggagccacctccgagacgcacaggccggcccgtgggctcgcctggcaaggctacttccatcacactacngacgcgggctggcgaaggcgcatgnnnnnnnnnnnn

SEQ ID NO: 294731 - DNA, 470 bp, Homo sapiens
  misc_feature: GYAE6OF02I2SH4.37.77.G11.1.454.CMB.1.raw
  modified_base (440)..(440): a, c, t, g, unknown or other
  misc_feature (440)..(440): n is a, c, g, or t
  modified_base (446)..(448): a, c, t, g, unknown or other
  misc_feature (446)..(448): n is a, c, g, or t
  modified_base (450)..(470): a, c, t, g, unknown or other
  misc_feature (450)..(470): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccggtctcctcagcctccaccaagggccccatccggtccttccccctggcccgccctgcctccacggacgcaccctccgagacgcacagcggccctgggctgcctggtcaaggctacttccatcacactatgagcgggctggcgaaggcncatagnnngnnnnnnnnnnnnnnnnnnnnn

SEQ ID NO: 294732 - DNA, 445 bp, Homo sapiens
  misc_feature: GYAE6OF02JHN1K.37.77.G11.1.454.CMB.1.raw
  modified_base (435)..(445): a, c, t, g, unknown or other
  misc_feature (435)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggcgccctgccccaggacgcacctccgagagcacagcggccctgggctgcctggcaaggctactccatctacactactgagcgggctggcaaggcgcatagnnnnnnnnnnn

SEQ ID NO: 294733 - DNA, 448 bp, Homo sapiens
  misc_feature: GYAE6OF02IS0UO.37.77.G11.1.454.CMB.1.raw
  modified_base (411)..(411): a, c, t, g, unknown or other
  misc_feature (411)..(411): n is a, c, g, or t
  modified_base (441)..(448): a, c, t, g, unknown or other
  misc_feature (441)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacttctagcccccttatagcagcggctggtcctggtactttgacgactggggccagggaaccctggtcaccgtctcctcagcctccaccaacgggccactcggtcctccccctggccgccctgctccaggacgcacctccgagagcaccagcggccctgggctcgcctggtcaggctacttccatctacnctactgacgcgggctggcgaggcgcatagnnnnnnnn

SEQ ID NO: 294734 - DNA, 445 bp, Homo sapiens
  misc_feature: GYAE6OF02G9RIF.37.77.G11.1.454.CMB.1.raw
  modified_base (440)..(445): a, c, t, g, unknown or other
  misc_feature (440)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtcttccccctggccgccctgctccaggacgcacctccgagacgcacagcggccctgggctgcctggtcaagctactccatcctacactactgacgcgggctgggcaaggcgcatagnnnnnn

SEQ ID NO: 294735 - DNA, 444 bp, Homo sapiens
  misc_feature: GYAE6OF02FPD7S.37.77.G11.1.454.CMB.1.raw
  modified_base (436)..(444): a, c, t, g, unknown or other
  misc_feature (436)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctgggtactttgacgactggggccagggaaccctggtcaccgtctcctcagcctcaccaagggcccatcggtcttcccctggcgccctgctccaggacgcacctccgagagcacagcggccctgggctgcctggtcaaggctacttccatctacactactgagcgggctggcaaggcgcatagnnnnnnnnn

SEQ ID NO: 294736 - DNA, 444 bp, Homo sapiens
  misc_feature: GYAE6OF02FRLAJ.37.77.G11.1.454.CMB.1.raw
  modified_base (348)..(348): a, c, t, g, unknown or other
  misc_feature (348)..(348): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
  modified_base (432)..(444): a, c, t, g, unknown or other
  misc_feature (432)..(444): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctcaccaagggcccatcggtcttcccctggcgccctgctccaggancacctccgagngcacagcggcctgggctgcctggtcaaggctacttccatctacnctactgagcgggctggcaaggcgcatagnnnnnnnnnnnnn

SEQ ID NO: 294737 - DNA, 441 bp, Homo sapiens
  misc_feature: GYAE6OF02GTFOR.37.77.G11.1.454.CMB.1.raw
  modified_base (429)..(429): a, c, t, g, unknown or other
  misc_feature (429)..(429): n is a, c, g, or t
  modified_base (434)..(441): a, c, t, g, unknown or other
  misc_feature (434)..(441): n is a, c, g, or t
tcagtagtgtagatcacgaccggtgctcgatttagctagtcactcaagggaaggggctggagtgggtctcagatattaatgggaatggtgataccacatactacgcagactccgtgaagggccggttcaccatctccagggacaattccaagaacacactgtctctgcaaatgaacagcctgagattcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggacgcacctccgagagcacagcggccctgggctgcctggtcaggactactccatctacactactgagcgggctggcaaggcncatgnnnnnnnn

SEQ ID NO: 294738 - DNA, 576 bp, Homo sapiens
  misc_feature: GYAE6OF02JKSCQ.37.77.G11.1.454.CMB.1.raw
  modified_base (550)..(576): a, c, t, g, unknown or other
  misc_feature (550)..(576): n is a, c, g, or t
tcagtagtgtagatcacgaccggtgctcgatttagctagtcactcaagggaaaggggcgtggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcgctggtctggactttgacgactggggccaggggaaccctggtcaccgtctccgcacgcctccaccgacgggcccacgtccggtccttcccccgtggccgccccgtcggcctacccggaggaccgccaacccgtcccggagacggaccaccgaggtccggccccgttggggcccttggaccccttgggtacccgaaacggggtacctaccgtttaccccgattacccgtaactaacccgtaacgttcgaaggtccggggtcctagggcccgaaagggtcccgaacgacgttacggcatccgagctgnnnnnnnnnnnnnnnnnnnnnnnnnnn

SEQ ID NO: 294739 - DNA, 447 bp, Homo sapiens
  misc_feature: GYAE6OF02F2TFT.37.77.G11.1.454.CMB.1.raw
  modified_base (359)..(359): a, c, t, g, unknown or other
  misc_feature (359)..(359): n is a, c, g, or t
  modified_base (443)..(447): a, c, t, g, unknown or other
  misc_feature (443)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaacgcccagaactcattgtatctgcaaatgaacagactgagagccgaggacacggctgtgtattactgtgcgagagaggaggcgattagtgtaaatggctgggccttctactactactactacatggacgtctggggcaaaggggaccacggtcaccgtctcctcagcctccaccaagggcccatcggtcttccccctggcaccctcctccaagngcacctctgggggcacagcggccctgggctgcctggtcaaggctactccatctacactactgagcgggctggcaaggcgcatgnnnnn

SEQ ID NO: 294740 - DNA, 402 bp, Homo sapiens
  misc_feature: GYAE6OF02FUMWH.37.77.G11.1.454.CMB.1.raw
  modified_base (396)..(402): a, c, t, g, unknown or other
  misc_feature (396)..(402): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggctacttccatctacactactgagcgggctggcaaggcgcatagnnnnnnn

SEQ ID NO: 294741 - DNA, 516 bp, Homo sapiens
  misc_feature: GYAE6OF02JW2V9.37.77.G11.1.454.CMB.1.raw
  modified_base (493)..(494): a, c, t, g, unknown or other
  misc_feature (493)..(494): n is a, c, g, or t
  modified_base (497)..(516): a, c, t, g, unknown or other
  misc_feature (497)..(516): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatccggtccttccccctggccgcccctgcctccaggacgccacctccgagacgcacacgccggcccgtgggcctcggcccgttagggtccgaaagggacccttaaccgttcccgaatcctaaccgactaccgtgacggtccggggtctcgggccgaagggccgacgacgttaagnngcnnnnnnnnnnnnnnnnnnnn

SEQ ID NO: 294742 - DNA, 437 bp, Homo sapiens
  misc_feature: GYAE6OF02HBHF0.37.77.G11.1.454.CMB.1.raw
  modified_base (341)..(341): a, c, t, g, unknown or other
  misc_feature (341)..(341): n is a, c, g, or t
  modified_base (423)..(423): a, c, t, g, unknown or other
  misc_feature (423)..(423): n is a, c, g, or t
  modified_base (428)..(437): a, c, t, g, unknown or other
  misc_feature (428)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaccctggtcaccgtctcctcagcctccaccaaggcccatcggtctcccctgcgcctgctccnggagcacctccgagacgcacagccggcctgggctgcctggcaaggctactccatctacactactgagcgggctggcaaggcncatgnnnnnnnnnn

SEQ ID NO: 294743 - DNA, 444 bp, Homo sapiens
  misc_feature: GYAE6OF02GWL3Z.37.77.G11.1.454.CMB.1.raw
  modified_base (433)..(433): a, c, t, g, unknown or other
  misc_feature (433)..(433): n is a, c, g, or t
  modified_base (438)..(444): a, c, t, g, unknown or other
  misc_feature (438)..(444): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggacgcacctccgagacgcacagcggccctgggctgcctggtcaaggactacttccatctacactactgagcgggctggcaaggcncatgnnnnnnn

SEQ ID NO: 294744 - DNA, 618 bp, Homo sapiens
  misc_feature: GYAE6OF02JVE7J.37.77.G11.1.454.CMB.1.raw
  modified_base (210)..(210): a, c, t, g, unknown or other
  misc_feature (210)..(210): n is a, c, g, or t
  modified_base (522)..(522): a, c, t, g, unknown or other
  misc_feature (522)..(522): n is a, c, g, or t
  modified_base (605)..(605): a, c, t, g, unknown or other
  misc_feature (605)..(605): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgagacacggccttatattacngtgcgagagatcagacggagtatagcagcagctctgactactggggccacggaaccctggtcgaaccgtctcctcacgccctccaccgaacggcccaatccggtaccttccccctgggccctaccccgtccctcccaacgacgccacctcgtcggggccaacgacgcggcccgtggccgtcgccgtcggtacgaacggaccgttaccttaccgacttccgtaaccctaccgtttaaccgcgggtaacggtcccggggactttaccgggggacctaaccggggtaccgtacccggtaaacggttaacccgggngtaccgacgtacgtaccgtacgacgacgacgtcgcgacgtacgcgcgcgtacgtacgcgcgacgtcgcgcgcgcgacgacgcncgacgcgcgtgcg

SEQ ID NO: 294745 - DNA, 452 bp, Homo sapiens
  misc_feature: GYAE6OF02G9ILF.37.77.G11.1.454.CMB.1.raw
  modified_base (436)..(436): a, c, t, g, unknown or other
  misc_feature (436)..(436): n is a, c, g, or t
  modified_base (441)..(452): a, c, t, g, unknown or other
  misc_feature (441)..(452): n is a, c, g, or t
tcagtagtgtagatcacgaccggtgctcgatttagctagtcactcaagggaaggggctggagtgggtctcagctattaatgggaatggtgataccacatactacgcagactccgtgaaggggcctgttcaccatctccagggacaattccaagaacacactgtctctgcaaatgaacagcctgagagtagaggacacggccttatattactgtgtgaagggacctctagccccttatagcagcggctggtcctggtactttgacgactggggccagggaaccctggtcaccgtctcctcagccctccaccaagggccccatcggtcttccccctggccgccctgctccaggcgcacctccgagagccacagccggccctgggcctgccgtggtcaaggctacttccatctacactactgagcgggctggcaaggcncatgnnnnnnnnnnnn

SEQ ID NO: 294746 - DNA, 438 bp, Homo sapiens
  misc_feature: GYAE6OF02HSMF0.37.77.G11.1.454.CMB.1.raw
  modified_base (428)..(438): a, c, t, g, unknown or other
  misc_feature (428)..(438): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctcgtggggcacgacgcggccctggggctcgccgtggtcaaggactaccttccatcctacactactgagcgggctggcaaggcgcatagnnnnnnnnnnn

SEQ ID NO: 294747 - DNA, 481 bp, Homo sapiens
  misc_feature: GYAE6OF02IKFYT.37.77.G11.1.454.CMB.1.raw
  modified_base (464)..(481): a, c, t, g, unknown or other
  misc_feature (464)..(481): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgcctccaccaacgggcccatccggtccttccccctggccgcccctgcctccgaggacgccacctccgagacgcacgacgccggcccgtggggcctgcccgttgggtcaagggacctacttccattcctacactactgacgcgggctggacaaggcgcagtagnnnnnnnnnnnnnnnnnn

SEQ ID NO: 294748 - DNA, 437 bp, Homo sapiens
  misc_feature: GYAE6OF02FQTN7.37.77.G11.1.454.CMB.1.raw
  modified_base (430)..(437): a, c, t, g, unknown or other
  misc_feature (430)..(437): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaaggaagggtctagcagtgcctggtactcccactactatatggacgtctggggcaaaggaatcgcggtcaccgtctcctcagcctccaccaagggcccatcggtcttccccctggcaccctcctccaagagcacctctgggggcacagcggccctgggctgcctggtcaaggactacttccatctacactactgagcggctggcaggcgcatgnnnnnnnn

SEQ ID NO: 294749 - DNA, 442 bp, Homo sapiens
  misc_feature: GYAE6OF02HI2RW.37.77.G11.1.454.CMB.1.raw
  modified_base (438)..(442): a, c, t, g, unknown or other
  misc_feature (438)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagctccaccaagggcccatccggtcttccccctggcgccctgctccaggagccacctccgagagcacagcggcctgggctgcctggtcaaggacctacgttccatctacactactgagcgggctggcaaggcgcatagnnnnn

SEQ ID NO: 294750 - DNA, 460 bp, Homo sapiens
  misc_feature: GYAE6OF02G22H4.37.77.G11.1.454.CMB.1.raw
  modified_base (449)..(460): a, c, t, g, unknown or other
  misc_feature (449)..(460): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatccggtcttccccctcggccgccctgctccaggacgccaccctccgagacgcacgagccggccctgggctcgcctggtcaacggactacttccatcctacactactgacgcgggctggcaggcgcatagnnnnnnnnnnnn

SEQ ID NO: 294751 - DNA, 618 bp, Homo sapiens
  misc_feature: GYAE6OF02HBPWM.37.77.G11.1.454.CMB.1.raw
  modified_base (232)..(232): a, c, t, g, unknown or other
  misc_feature (232)..(232): n is a, c, g, or t
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (580)..(580): a, c, t, g, unknown or other
  misc_feature (580)..(580): n is a, c, g, or t
  modified_base (582)..(582): a, c, t, g, unknown or other
  misc_feature (582)..(582): n is a, c, g, or t
  modified_base (584)..(584): a, c, t, g, unknown or other
  misc_feature (584)..(584): n is a, c, g, or t
  modified_base (598)..(598): a, c, t, g, unknown or other
  misc_feature (598)..(598): n is a, c, g, or t
  modified_base (600)..(600): a, c, t, g, unknown or other
  misc_feature (600)..(600): n is a, c, g, or t
tcagtagtgtagatcacgaccggtgctcgatttagctagtcactcaaggggaaaggggcttggagtgggtactccagtcctacttaatagggaatcggtggataccacatactacgcagactccgtgaaggccggttcaccgatctcctagggacgaagttccaagaacacactgtcgtctcgcaaactggaacagcctgaggagtcgaggacacgggccttagtagttacngtagtgaaggggtacctcgtagaccccgttatacgcagcggcttggtccgtgggtacctttcgacgacgtggggccaagggaccctggtcacccgtctccgtcgacgccctccgacccgaagggacccaagtccggtccgttacccccgttgggccgtcccgtagccttccgacggtacgcctaccgtaccgtaagaacgcacacgccggaccgtgggacgtcgccgtggtccaaacggtacttaccgttccgacgtactaaccgtacctaacgtacgaacggccgggtctacggctaagggcgtacgagtagcngacntcgngagcgcgactatagtntgtgngagngngngactactacgtcgngngtgtagtcgcgcgacgcg

SEQ ID NO: 294752 - DNA, 448 bp, Homo sapiens
  misc_feature: GYAE6OF02F400E.37.77.G11.1.454.CMB.1.raw
  modified_base (439)..(448): a, c, t, g, unknown or other
  misc_feature (439)..(448): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccgtctcctcagcctccaccaacgggcccatcggtcttccccctggccgccctgctccaggagcacctcgagagcacagcggcctgggctgcctggtcaaggactacttccatctacactactgagcgggctgggcaaggcgcgatagnnnnnnnnnn

SEQ ID NO: 294753 - DNA, 454 bp, Homo sapiens
  misc_feature: GYAE6OF02IKCUX.37.77.G11.1.454.CMB.1.raw
  modified_base (436)..(454): a, c, t, g, unknown or other
  misc_feature (436)..(454): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccctatattactgtacgaaaatggcctacggatatgactactattgggactggtacttcgatctctggggccgtggcacccctggtcactgtctcctcagcctccaccaagggcccatcggtctccccctggcgccctgctccaggacgcacctccgagacgcacagcggccctggggctgcctggtcaggactacttccatcctacactactgagcggctggcaaggcgcagtagnnnnnnnnnnnnnnnnnnn

SEQ ID NO: 294754 - DNA, 448 bp, Homo sapiens
  misc_feature: GYAE6OF02HIVFM.37.77.G11.1.454.CMB.1.raw
  modified_base (435)..(448): a, c, t, g, unknown or other
  misc_feature (435)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggcgccctgctccaggagcacctccgagcgcacagcggccctgggctgcctggtcaaggactactccatctacactactgagcgggctggcaaggcgcatagnnnnnnnnnnnnnn

SEQ ID NO: 294755 - DNA, 447 bp, Homo sapiens
  misc_feature: GYAE6OF02FLF74.37.77.G11.1.454.CMB.1.raw
  modified_base (438)..(447): a, c, t, g, unknown or other
  misc_feature (438)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcagcctccaccaagggcccatcggtcttccccctggcgccctgctccaggagcacctccgagagcacagcggccctgggctgcctggtcaagggctacttccatctacactactgagcgggctggcaaggcgcatagnnnnnnnnnn

SEQ ID NO: 294756 - DNA, 448 bp, Homo sapiens
  misc_feature: GYAE6OF02FNANB.37.77.G11.1.454.CMB.1.raw
  modified_base (349)..(349): a, c, t, g, unknown or other
  misc_feature (349)..(349): n is a, c, g, or t
  modified_base (438)..(448): a, c, t, g, unknown or other
  misc_feature (438)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaggcccatccggtctccccctggccgccctgctccaggngcacctcgagagcacagcggccgtgggctcgcctggtcaaggactacttccatctacactactgacgcgggctggcgaaggcgcatagnnnnnnnnnnn

SEQ ID NO: 294757 - DNA, 458 bp, Homo sapiens
  misc_feature: GYAE6OF02HW5F4.37.77.G11.1.454.CMB.1.raw
  modified_base (445)..(458): a, c, t, g, unknown or other
  misc_feature (445)..(458): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcacccgtctcctcagcctccaccaacgggcccatcggtcctttccccctggccgccctgcctccaggagcacctccgagagcacagcggccctgggctgcctggtcaagggctacttccatctacactaactgagcgggctggcaaggcgacatacgnnnnnnnnnnnnnn

SEQ ID NO: 294758 - DNA, 628 bp, Homo sapiens
  misc_feature: GYAE6OF02JE07O.37.77.G11.1.454.CMB.1.raw
  modified_base (554)..(554): a, c, t, g, unknown or other
  misc_feature (554)..(554): n is a, c, g, or t
  modified_base (566)..(566): a, c, t, g, unknown or other
  misc_feature (566)..(566): n is a, c, g, or t
  modified_base (573)..(573): a, c, t, g, unknown or other
  misc_feature (573)..(573): n is a, c, g, or t
  modified_base (625)..(625): a, c, t, g, unknown or other
  misc_feature (625)..(625): n is a, c, g, or t
tcagtagtgtagatcacgaccggtgctcgattttagctagtcactcaaggggtaaagggggctggagtgggtctcaggcctattaatgggaatggtggataccacatactacgcagacttccgtgtaagggccggttcaccagtcgtccagggacaattccaagaacgacactgtcgtctgcaaatgaacagccgtgacgagtcgaggacacggccgtagtacttacgtgtggcgtaaggaacgggtctagcagtgcctaggtacctacccactactatatggacgtctggggcaaaggaactcgcggtcaccgtctcctcacgcctccaccaagggccctagtccggtcttcccccgtggccgaccccgtccgtaccgaagacgccaccgttccgtcgggggccaaccgacggacccggtcccgtcggggaccttcggcccgttcgggtaccgaaacgggtaccttaaccgttaccgacttaccgtaaccgtacccttaccgtcggaaccgtcggggcttacgggaccgaaaggggtccacgaacgttacggngcgcgcagcgcncggcacncgcgcgacgctcgtcgcgcgcgcgacgacgcgcgcgacgacgacgagcgcgngac

SEQ ID NO: 294759 - DNA, 553 bp, Homo sapiens
  misc_feature: GYAE6OF02IRJIO.37.77.G11.1.454.CMB.1.raw
  modified_base (230)..(230): a, c, t, g, unknown or other
  misc_feature (230)..(230): n is a, c, g, or t
  modified_base (521)..(521): a, c, t, g, unknown or other
  misc_feature (521)..(521): n is a, c, g, or t
  modified_base (527)..(527): a, c, t, g, unknown or other
  misc_feature (527)..(527): n is a, c, g, or t
  modified_base (529)..(553): a, c, t, g, unknown or other
  misc_feature (529)..(553): n is a, c, g, or t
tcagtagtgtagatcacgaccggtgctcgatttagctagtcactcaagggaaaggggcgtggagtgggtcgtcagctattaatgggaatggtgataccacatactacgcagactccgtgaagggccggttcaccatctccagggacaattccaagaacacactgtctctgcaaatgaacagacctgagagtcgaggacacggccttatattactgttgtgaagggacctntaagccccttatagcagcggctggtcctgggtactttgacgactggggccagggaacccgtggtccgaacgtcctccgtcagtccctccaccaacgggcccctaagtccggtcctttccccccgtgggcccgtaccccgtcgcccttcccgaaagggcgccgtacctcccgacgaagcccacgtacggccggccctgggcctcggccttacgggcaacggtcgtacttccagtctaaccgactactcggaacgccgggtactcggcgaaacgggccgaccgagttaacggngctgcngnnnnnnnnnnnnnnnnnnnnnnnnn

SEQ ID NO: 294760 - DNA, 543 bp, Homo sapiens
  misc_feature: GYAE6OF02JW7LJ.37.77.G11.1.454.CMB.1.raw
  modified_base (204)..(204): a, c, t, g, unknown or other
  misc_feature (204)..(204): n is a, c, g, or t
  modified_base (237)..(237): a, c, t, g, unknown or other
  misc_feature (237)..(237): n is a, c, g, or t
  modified_base (312)..(312): a, c, t, g, unknown or other
  misc_feature (312)..(312): n is a, c, g, or t
  modified_base (357)..(357): a, c, t, g, unknown or other
  misc_feature (357)..(357): n is a, c, g, or t
  modified_base (389)..(389): a, c, t, g, unknown or other
  misc_feature (389)..(389): n is a, c, g, or t
  modified_base (511)..(511): a, c, t, g, unknown or other
  misc_feature (511)..(511): n is a, c, g, or t
  modified_base (514)..(514): a, c, t, g, unknown or other
  misc_feature (514)..(514): n is a, c, g, or t
  modified_base (516)..(517): a, c, t, g, unknown or other
  misc_feature (516)..(517): n is a, c, g, or t
  modified_base (519)..(543): a, c, t, g, unknown or other
  misc_feature (519)..(543): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgagacacggccttanattactgtagtgaagggacctctagccccttanagcagcggcttggtcctggtactttgtacgaccgtgggggccaggggtaacccctggtccaccggttcctccgtnacgccctcgaccgtagggccccagtccggtcttccccctgggccncccgtgacctccgaggcgtccacctcccgganacgccaactacggccggcccgtgggccttacggccctcgggtaccgaaacgggtcttaaccgttcccactccttacacctacgtcggacggccgggctgggccaaggggtcacctagtacgncgntnntnnnnnnnnnnnnnnnnnnnnnnnnn

SEQ ID NO: 294761 - DNA, 450 bp, Homo sapiens
  misc_feature: GYAE6OF02H4UQ1.37.77.G11.1.454.CMB.1.raw
  modified_base (442)..(450): a, c, t, g, unknown or other
  misc_feature (442)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccaggggaaccctggtcaccgtctcctcagcctccaccagggcccatccggtcttccccctggcgccctgctccaggcgcaccctccgagacgcacagcggccctgggctgcctggtcaaggactacttccatctacactactgacgcgggctggacaaggcgacatagnnnnnnnnn

SEQ ID NO: 294762 - DNA, 471 bp, Homo sapiens
  misc_feature: GYAE6OF02G31NP.37.77.G11.1.454.CMB.1.raw
  modified_base (450)..(452): a, c, t, g, unknown or other
  misc_feature (450)..(452): n is a, c, g, or t
  modified_base (454)..(471): a, c, t, g, unknown or other
  misc_feature (454)..(471): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcacccgtctccctcacgccctcccaccaacgggcccagtccggtcttccccctggccgccctcgctccgaggacgcacctccgagacgcacagccggccctgggcctgcctggtacaggactactccatcacactactgacgcgggctggcaggcgacatagnnngnnnnnnnnnnnnnnnnnn

SEQ ID NO: 294763 - DNA, 446 bp, Homo sapiens
  misc_feature: GYAE6OF02FM63V.37.77.G11.1.454.CMB.1.raw
  modified_base (353)..(353): a, c, t, g, unknown or other
  misc_feature (353)..(353): n is a, c, g, or t
  modified_base (430)..(430): a, c, t, g, unknown or other
  misc_feature (430)..(430): n is a, c, g, or t
  modified_base (436)..(446): a, c, t, g, unknown or other
  misc_feature (436)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcagcctccaccaagggcccatcggtcttccccctggccgccctgctccaggancacctccgagagcacagcgccctgggctgcctggtcaaggctacttccatccacactactgagcgggctggcaggcncatagnnnnnnnnnnn

SEQ ID NO: 294764 - DNA, 444 bp, Homo sapiens
  misc_feature: GYAE6OF02F4HRN.37.77.G11.1.454.CMB.1.raw
  modified_base (91)..(91): a, c, t, g, unknown or other
  misc_feature (91)..(91): n is a, c, g, or t
  modified_base (438)..(444): a, c, t, g, unknown or other
  misc_feature (438)..(444): n is a, c, g, or t
tcagtagtgtagatcacgaccggtgctcgatttagctagtcactcaagggaaaggggctggagtgggtctcagctattaatgggaatggtnataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatcggtcttccccctggccgccctgctccaggagcacctccgagagcacagcggccctgggctgcctggtccaaggactacttccatctacactactgagcgggctggcaaggcgcatagnnnnnnn

SEQ ID NO: 294765 - DNA, 532 bp, Homo sapiens
  misc_feature: GYAE6OF02JFBBV.37.77.G11.1.454.CMB.1.raw
  modified_base (341)..(341): a, c, t, g, unknown or other
  misc_feature (341)..(341): n is a, c, g, or t
  modified_base (499)..(499): a, c, t, g, unknown or other
  misc_feature (499)..(499): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (507)..(532): a, c, t, g, unknown or other
  misc_feature (507)..(532): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcacccgtctcctcagccctccaccaacggccccagtccggtcctttccccccgnggccgcccctgcctccgaggacgccaccctccgagacgccacacggccggccctggggcctcgcccgtgggtaccaacgggtaccttacctttccacgttcctaaccaccttacgtggacggtcgggcctgggccaagggccgaccgaagttaggcancancncgnnnnnnnnnnnnnnnnnnnnnnnnnn

SEQ ID NO: 294766 - DNA, 473 bp, Homo sapiens
  misc_feature: GYAE6OF02IXSQH.37.77.G11.1.454.CMB.1.raw
  modified_base (451)..(451): a, c, t, g, unknown or other
  misc_feature (451)..(451): n is a, c, g, or t
  modified_base (456)..(473): a, c, t, g, unknown or other
  misc_feature (456)..(473): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtccaccgtctcctcagcctccaccaagggcccatcggtccttcccccgtggccgccctgcctccaggacgccacctccgagagccacaggccggccctgggcctgcccgtcggtcaacgggcctacgttccatcctacactactgagcgggctgggacaagggcncatgnnnnnnnnnnnnnnnnnn

SEQ ID NO: 294767 - DNA, 446 bp, Homo sapiens
  misc_feature: GYAE6OF02I9G15.37.77.G11.1.454.CMB.1.raw
  modified_base (438)..(446): a, c, t, g, unknown or other
  misc_feature (438)..(446): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccgtctcctcagcctccaccaagggcccatcggtcttccccctggccgccctgctccaggagccacctccgagacgcacagcggccctgggctgcctggtcaaggctacttccatctacactactgagcgggctggcaaggcgcatagnnnnnnnnn

SEQ ID NO: 294768 - DNA, 447 bp, Homo sapiens
  misc_feature: GYAE6OF02GU1R4.37.77.G11.1.454.CMB.1.raw
  modified_base (436)..(447): a, c, t, g, unknown or other
  misc_feature (436)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtcttccccctggcgccctgctccaggagcacctccgagagcacagcggccctgggctgcctggtcaggactacttccatctacactactgagcgggctggcaaggcgcatagnnnnnnnnnnnn

SEQ ID NO: 294769 - DNA, 447 bp, Homo sapiens
  misc_feature: GYAE6OF02JH3NA.37.77.G11.1.454.CMB.1.raw
  modified_base (361)..(361): a, c, t, g, unknown or other
  misc_feature (361)..(361): n is a, c, g, or t
  modified_base (422)..(422): a, c, t, g, unknown or other
  misc_feature (422)..(422): n is a, c, g, or t
  modified_base (438)..(438): a, c, t, g, unknown or other
  misc_feature (438)..(438): n is a, c, g, or t
  modified_base (443)..(447): a, c, t, g, unknown or other
  misc_feature (443)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctccgtcagcctccaaccaacgggccccatccggtccttcccccgtggccgccctgcctccgaggacncacctccgagagcacagcggccctgggctgcctggcaaggactactccatcctacactacngagcggctggcaggcncatgnnnnn

SEQ ID NO: 294770 - DNA, 453 bp, Homo sapiens
  misc_feature: GYAE6OF02I9Z9Z.37.77.G11.1.454.CMB.1.raw
  modified_base (410)..(410): a, c, t, g, unknown or other
  misc_feature (410)..(410): n is a, c, g, or t
  modified_base (435)..(435): a, c, t, g, unknown or other
  misc_feature (435)..(435): n is a, c, g, or t
  modified_base (438)..(453): a, c, t, g, unknown or other
  misc_feature (438)..(453): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaaggcccatccggtcttccccctggccgccctgcctccaggagcacctccgagacgcacacgcggcctgggctgcctggcaagggactactccatcctaanactactgagcgggctggcaaggcgnatnnnnnnnnnnnnnnnn

SEQ ID NO: 294771 - DNA, 448 bp, Homo sapiens
  misc_feature: GYAE6OF02GRVEG.37.77.G11.1.454.CMB.1.raw
  modified_base (417)..(417): a, c, t, g, unknown or other
  misc_feature (417)..(417): n is a, c, g, or t
  modified_base (435)..(435): a, c, t, g, unknown or other
  misc_feature (435)..(435): n is a, c, g, or t
  modified_base (441)..(448): a, c, t, g, unknown or other
  misc_feature (441)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatcggtcttccccctggccgccctgcctccaggcgccacctccgagagcacagccggccctgggctgcctggtcaaggactacttccatctacactacngagcgggctggcaaggcncatagnnnnnnnn

SEQ ID NO: 294772 - DNA, 441 bp, Homo sapiens
  misc_feature: GYAE6OF02GPP22.37.77.G11.1.454.CMB.1.raw
  modified_base (353)..(353): a, c, t, g, unknown or other
  misc_feature (353)..(353): n is a, c, g, or t
  modified_base (411)..(411): a, c, t, g, unknown or other
  misc_feature (411)..(411): n is a, c, g, or t
  modified_base (428)..(428): a, c, t, g, unknown or other
  misc_feature (428)..(428): n is a, c, g, or t
  modified_base (434)..(441): a, c, t, g, unknown or other
  misc_feature (434)..(441): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttccccctggccgccctgctccaggacncacctccgagagcacagccggccctgggctgcctggcaagctactcatctacactacngagcgggctggcaggcncatagnnnnnnnn

SEQ ID NO: 294773 - DNA, 474 bp, Homo sapiens
  misc_feature: GYAE6OF02IJ8HB.37.77.G11.1.454.CMB.1.raw
  modified_base (462)..(474): a, c, t, g, unknown or other
  misc_feature (462)..(474): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatcggtccttccccctggccacccctccctccaacgacgccacctcgtcgggggccacgacggccggcccgtgggctcgccgtggtcaaggactaccttccactctactactactgacgcgggctggacgaaggcgacagtagnnnnnnnnnnnnn

SEQ ID NO: 294774 - DNA, 442 bp, Homo sapiens
  misc_feature: GYAE6OF02HHGFA.37.77.G11.1.454.CMB.1.raw
  modified_base (430)..(442): a, c, t, g, unknown or other
  misc_feature (430)..(442): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggccccatcggtcttccccctggcgccctgctccaggagcactccgagagcacagcggccctgggctgcctggtcaaggctacttcatctacactactgagcggctggcaaggcgcatagnnnnnnnnnnnnn

SEQ ID NO: 294775 - DNA, 446 bp, Homo sapiens
  misc_feature: GYAE6OF02FW2AQ.37.77.G11.1.454.CMB.1.raw
  modified_base (350)..(350): a, c, t, g, unknown or other
  misc_feature (350)..(350): n is a, c, g, or t
  modified_base (439)..(446): a, c, t, g, unknown or other
  misc_feature (439)..(446): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatcggtctccccctggcgccctgctccaggancacctccgagacgcacagcggccctgggctgcctggtcaaggactacttccgatctacactactgacgcgggctggcaaggcgcatagnnnnnnnn

SEQ ID NO: 294776 - DNA, 598 bp, Homo sapiens
  misc_feature: GYAE6OF02GY11B.37.77.G11.1.454.CMB.1.raw
  modified_base (244)..(244): a, c, t, g, unknown or other
  misc_feature (244)..(244): n is a, c, g, or t
  modified_base (512)..(512): a, c, t, g, unknown or other
  misc_feature (512)..(512): n is a, c, g, or t
  modified_base (523)..(523): a, c, t, g, unknown or other
  misc_feature (523)..(523): n is a, c, g, or t
  modified_base (547)..(547): a, c, t, g, unknown or other
  misc_feature (547)..(547): n is a, c, g, or t
  modified_base (573)..(573): a, c, t, g, unknown or other
  misc_feature (573)..(573): n is a, c, g, or t
tcagtagtgtagatcacgaccggtgctcgatttagctagtcactcaaggggaaaggggcgtggagtgggtctcagctattaatgggaatggtgataccacatactacgcagactccgtgaagggccggttcaccagtctcccaggggacaacttccaagaacacactgtctctgccaaatgaacagcctgagagtcgaggacacggccttatattactgtgtgaagggacctctagccccttanacgcagcggctggtcctggtactttgacgctggggccagggaaccctggtcaccggtctcctcacgcctccaccgaacgggccccagtccggtccttcccccgtcggccgtccctgcctccgaggacgccgacccgtccgtaggacgcaacgacggcggcccgtggggctcggccctggttaccaaacgggtaccttaccgttccattccgtaacaccgttacgtcggacggtccgggtacttcgggtacaagggtccacgtataggntgactgcgtancgtgtcgcgtcgacggtcaggacngtacgcgtacgcgaactcggctacgntacgtcgtcttacgtcgtactcgtc

SEQ ID NO: 294777 - DNA, 468 bp, Homo sapiens
  misc_feature: GYAE6OF02IIV9R.37.77.G11.1.454.CMB.1.raw
  modified_base (341)..(341): a, c, t, g, unknown or other
  misc_feature (341)..(341): n is a, c, g, or t
  modified_base (449)..(468): a, c, t, g, unknown or other
  misc_feature (449)..(468): n is a, c, g, or t
tcagtagtgtagatcacgaccggtgctcgatttagctagtcactcaaggggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccaggggaaccctggtcaccgtctcctcagcctccaccaagggcccatccggtcttccccctggccnccctgctccaggacgcacctccgagacgcacgagcggccctgggctcgccgtggcaagggactacttcactctacactactgagcgggctggcaagggcgacatacgnnnnnnnnnnnnnnnnnnnn

SEQ ID NO: 294778 - DNA, 477 bp, Homo sapiens
  misc_feature: GYAE6OF02JCZ42.37.77.G11.1.454.CMB.1.raw
  modified_base (458)..(458): a, c, t, g, unknown or other
  misc_feature (458)..(458): n is a, c, g, or t
  modified_base (464)..(477): a, c, t, g, unknown or other
  misc_feature (464)..(477): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagccagcggctggtcctggtactttgacgactggggccagggaaccctggtcaccgtctcctcagcctccaccagggcccatccggtcctccccctggccgccctgcctccaggacgccacctccgagacgcacagccggcccgtgggcctcggccctgggtccaacgggccttacgttcccatcctacacctactgacggcgggctgggacaagggccnagtagnnnnnnnnnnnnnn

SEQ ID NO: 294779 - DNA, 448 bp, Homo sapiens
  misc_feature: GYAE6OF02HXME3.37.77.G11.1.454.CMB.1.raw
  modified_base (333)..(333): a, c, t, g, unknown or other
  misc_feature (333)..(333): n is a, c, g, or t
  modified_base (438)..(448): a, c, t, g, unknown or other
  misc_feature (438)..(448): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctagccccttatagcagcggctggtcctggtactttgacgactggggcagggaaccctggtcacgtctcctcagcctccacaagggcccatcggtcttccccctggccnccctctccaagacgcacctcgtggggccacgacgcggccctgggctcgccgtgtcaaggactactccatctacactactgacgcggctggacaggcgacagtagnnnnnnnnnnn

SEQ ID NO: 294780 - DNA, 464 bp, Homo sapiens
  misc_feature: GYAE6OF02HCDNE.37.77.G11.1.454.CMB.1.raw
  modified_base (449)..(449): a, c, t, g, unknown or other
  misc_feature (449)..(449): n is a, c, g, or t
  modified_base (454)..(464): a, c, t, g, unknown or other
  misc_feature (454)..(464): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccatggaaccctggtcaccgtctcctcagcctccaccgaacggccccatccggtccttccccctggccgcccctgcctccgaggcgccacctccgagagccacacgccggccctgggctcgccgtggtcaaggacctacttcccattcctacactactgacgcgggctggcaaggcncatgnnnnnnnnnnn

SEQ ID NO: 294781 - DNA, 453 bp, Homo sapiens
  misc_feature: GYAE6OF02HOCZ3.37.77.G11.1.454.CMB.1.raw
  modified_base (437)..(437): a, c, t, g, unknown or other
  misc_feature (437)..(437): n is a, c, g, or t
  modified_base (443)..(453): a, c, t, g, unknown or other
  misc_feature (443)..(453): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggcctttatattactgtgtgaagggacctctagcccccttatagcagcggctggtcctggtactttgacgactggggccagggaaccctggtcaccgtctcctcagcctccaccaaggcccatcggtcttccccctggccgccctgctccaggacgcaccctccgacgacgcacacggccggccctggggctgcctggtcaagggctactccatctacactactgagcggctggcaggcncatagnnnnnnnnnnn

SEQ ID NO: 294782 - DNA, 492 bp, Homo sapiens
  misc_feature: GYAE6OF02IW2UH.37.77.G11.1.454.CMB.1.raw
  modified_base (360)..(360): a, c, t, g, unknown or other
  misc_feature (360)..(360): n is a, c, g, or t
  modified_base (466)..(467): a, c, t, g, unknown or other
  misc_feature (466)..(467): n is a, c, g, or t
  modified_base (469)..(492): a, c, t, g, unknown or other
  misc_feature (469)..(492): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgatcggggccagggaaccctggtcaccgtctcctcagccctccaccgaacgggcccacttccggtccttcccccgtggccgccctgcctccgaggngccaccctccgagacgccacacggcgcccgtcgggcctgccgtcggtcgaacggacctacttacccatcctacactactgaacgcggctggcaaggccactatganntnnnnnnnnnnnnnnnnnnnnnnnn

SEQ ID NO: 294783 - DNA, 476 bp, Homo sapiens
  misc_feature: GYAE6OF02GVGXU.37.77.G11.1.454.CMB.1.raw
  modified_base (338)..(338): a, c, t, g, unknown or other
  misc_feature (338)..(338): n is a, c, g, or t
  modified_base (353)..(353): a, c, t, g, unknown or other
  misc_feature (353)..(353): n is a, c, g, or t
  modified_base (448)..(476): a, c, t, g, unknown or other
  misc_feature (448)..(476): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactgggggccaggggaacccctggtcaccgtctcctcagcctccaccaaggcccatcggtctcccctggccnccctgctccaggacncacctccgagacgcacagcggccctgggctgccctggtcaaggtacctacgttccatctacactactgacgcgggctgggcaagggcgcagtagnnnnnnnnnnnnnnnnnnnnnnnnnnnnn

SEQ ID NO: 294784 - DNA, 527 bp, Homo sapiens
  misc_feature: GYAE6OF02HDKE2.37.77.G11.1.454.CMB.1.raw
  modified_base (493)..(493): a, c, t, g, unknown or other
  misc_feature (493)..(493): n is a, c, g, or t
  modified_base (497)..(527): a, c, t, g, unknown or other
  misc_feature (497)..(527): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgactgggggccagggaaccctggtcacccgtctcctcagccctcccaccgaacgggcccacgtccggtccttccccccgtggccgcccctcgcctcccgaggacgccacctccgagacgcacgacggccgcccgtgggctcggcctgggtaccaaacgggtaccttaccttccgactctaaccactacgtggacgcggggctagggaccgtaagggcgactacgtagntcgnnnnnnnnnnnnnnnnnnnnnnnnnnnnnnn

SEQ ID NO: 294785 - DNA, 434 bp, Homo sapiens
  misc_feature: GYAE6OF02H8JMT.37.77.G11.1.454.CMB.1.raw
  modified_base (409)..(409): a, c, t, g, unknown or other
  misc_feature (409)..(409): n is a, c, g, or t
  modified_base (420)..(420): a, c, t, g, unknown or other
  misc_feature (420)..(420): n is a, c, g, or t
  modified_base (426)..(434): a, c, t, g, unknown or other
  misc_feature (426)..(434): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgcgagagatcagacggagtatagcagcagctctgactactggggccacggaaccctggtcaccgtctcctcagcctcccaccaagggcccatccggtctttccccctggccaccctcctccaagagccacctctgggggcacagccggccgtggctcgccgtgtcaaggactacttccatcacactactgagcggntggcaaggcgnactagnnnnnnnnn

SEQ ID NO: 294786 - DNA, 662 bp, Homo sapiens
  misc_feature: GYAE6OF02I8JAD.37.77.G11.1.454.CMB.1.raw
  modified_base (367)..(367): a, c, t, g, unknown or other
  misc_feature (367)..(367): n is a, c, g, or t
  modified_base (463)..(463): a, c, t, g, unknown or other
  misc_feature (463)..(463): n is a, c, g, or t
  modified_base (614)..(614): a, c, t, g, unknown or other
  misc_feature (614)..(614): n is a, c, g, or t
  modified_base (619)..(619): a, c, t, g, unknown or other
  misc_feature (619)..(619): n is a, c, g, or t
  modified_base (623)..(623): a, c, t, g, unknown or other
  misc_feature (623)..(623): n is a, c, g, or t
  modified_base (633)..(633): a, c, t, g, unknown or other
  misc_feature (633)..(633): n is a, c, g, or t
  modified_base (649)..(650): a, c, t, g, unknown or other
  misc_feature (649)..(650): n is a, c, g, or t
  modified_base (652)..(662): a, c, t, g, unknown or other
  misc_feature (652)..(662): n is a, c, g, or t
tcagtagtgtagatcacgaccggtgctcgatttagctagtcactctaaggggaaagggcgtcggagtgggtctcagctattaatgggaactcggtgataccacagtaccgtacgcaggactccgtgaagggtccgttcacctatctaccagggacaattccaaagaacacgaactgtcctctagtcaaatcgaaacacgccctaggaacgacgtacgacggacacggtaccttataattactagtcgtaggaacgggaccctacgtacggtcccccttagtacgactaggccggtcgtcggtccttaggttactttggaccgtacgtgggccacgggtaacccctgggccaaccgtctccgtcgacncctccaccgacggcccatccggtcccttccccgtggtcccgtacccttcgccgttaccgagggacgccgtacccgtaccggaggacgaccgaaccncggaccgggaccccgttggggtccttacgggtccgttacggggtaccgaagggtaccctaccgttaccaacgttcctaactaaccgtacgtacggaacggccgggagtccgggacaaccggggtctaccgacgttacggccgtcacctcgngtacncgtncgtcgacgcncgcgcgcgcgcacgtnncnnnnnnnnnnn

SEQ ID NO: 294787 - DNA, 463 bp, Homo sapiens
  misc_feature: GYAE6OF02I5U6A.37.77.G11.1.454.CMB.1.raw
  modified_base (436)..(436): a, c, t, g, unknown or other
  misc_feature (436)..(436): n is a, c, g, or t
  modified_base (443)..(463): a, c, t, g, unknown or other
  misc_feature (443)..(463): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggtcccatcggtcttccccctggccgccctgctccaggagcacctccgagacgcacagcggccctgggctgcctggtcaacggctacgttccatctaacactatgagcgggctaggcaagggcgnacgtgcnnnnnnnnnnnnnnnnnnnnn

SEQ ID NO: 294788 - DNA, 521 bp, Homo sapiens
  misc_feature: GYAE6OF02FJ4EL.37.77.G11.1.454.CMB.1.raw
  modified_base (498)..(521): a, c, t, g, unknown or other
  misc_feature (498)..(521): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactgggggccagggaaccctggtcaccgtctcctcagcctccaccaacgggcccatcggtccttcccccgtggccgcccctgcctccgaggacgcacccgtccgagacgcaaccacggccggcccgtggggcctcggcccttcgggtacaaacgggtaccttacctttcccatacctaacaccttacgtggacggtccgggccgtcgggaccgaagggccgataacgtacgcnnnnnnnnnnnnnnnnnnnnnnnn

SEQ ID NO: 294789 - DNA, 509 bp, Homo sapiens
  misc_feature: GYAE6OF02HR5KR.37.77.G11.1.454.CMB.1.raw
  modified_base (367)..(367): a, c, t, g, unknown or other
  misc_feature (367)..(367): n is a, c, g, or t
  modified_base (469)..(469): a, c, t, g, unknown or other
  misc_feature (469)..(469): n is a, c, g, or t
  modified_base (476)..(476): a, c, t, g, unknown or other
  misc_feature (476)..(476): n is a, c, g, or t
  modified_base (480)..(509): a, c, t, g, unknown or other
  misc_feature (480)..(509): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctagccccttatagcagcggctggtcctggttactttgacgtacgtggggccaggggaaccctggtccaccgtctcctcacgcctccaccgaacgggcccagtccggtccttcccccgtcggccgcccctgcctccgaggacnccaccgtccgagcgccacgacgccggccgtgggctcggcctggtacaacggtccttactccacttcctacactacgtgaggcgggctgggacgaaggccganacgtagnacgnnnnnnnnnnnnnnnnnnnnnnnnnnnnnn

SEQ ID NO: 294790 - DNA, 560 bp, Homo sapiens
  misc_feature: GYAE6OF02INE1Q.37.77.G11.1.454.CMB.1.raw
  modified_base (118)..(118): a, c, t, g, unknown or other
  misc_feature (118)..(118): n is a, c, g, or t
  modified_base (242)..(242): a, c, t, g, unknown or other
  misc_feature (242)..(242): n is a, c, g, or t
  modified_base (501)..(501): a, c, t, g, unknown or other
  misc_feature (501)..(501): n is a, c, g, or t
  modified_base (509)..(509): a, c, t, g, unknown or other
  misc_feature (509)..(509): n is a, c, g, or t
  modified_base (523)..(523): a, c, t, g, unknown or other
  misc_feature (523)..(523): n is a, c, g, or t
  modified_base (540)..(560): a, c, t, g, unknown or other
  misc_feature (540)..(560): n is a, c, g, or t
tcagtagtgtagatcacgaccggtgctcgatttagctagtcactcaagggaaggggctggagtgggtcgtcagctattaagtgggaatggtgataccacatactacgcagactccgtnaagggccggttcaccactctccagggacaattccaagaacacactcgtctctgacaatgaacagcctgagagtcgaggacacggtccttatatactgtgtagaaggactctacgcccttatacnccagcgctaggtcctggttactttgaccgtacgtcggggccgacgggtaacctggtcaaccggtctcccgtacacggcccttccgaacccaacggggccctaaccgtccgggttcccgttacccccgtgggcccctccccgtcgtcccgttcccaggacgtccctaccgtccgacggacgccaaccgcggtcccggacccggtgggccctggtccctggtacccggaaacggtccttaccgtacccgtatcccgtaacnctaacggngtaacggcgggtcnggacaggctagctacgnnnnnnnnnnnnnnnnnnnnn

SEQ ID NO: 294791 - DNA, 450 bp, Homo sapiens
  misc_feature: GYAE6OF02FE991.37.77.G11.1.454.CMB.1.raw
  modified_base (347)..(347): a, c, t, g, unknown or other
  misc_feature (347)..(347): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (427)..(427): a, c, t, g, unknown or other
  misc_feature (427)..(427): n is a, c, g, or t
  modified_base (434)..(450): a, c, t, g, unknown or other
  misc_feature (434)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaaggcccatcggtctcccctggcgcctgctccaggancacctccgagngcacagcggccctgggcngcctggtcaacggctacttccatctacactactgagcgggctggcaaggcncatacgnnnnnnnnnnnnnnnnn

SEQ ID NO: 294792 - DNA, 464 bp, Homo sapiens
  misc_feature: GYAE6OF02IBN6R.37.77.G11.1.454.CMB.1.raw
  modified_base (444)..(444): a, c, t, g, unknown or other
  misc_feature (444)..(444): n is a, c, g, or t
  modified_base (450)..(464): a, c, t, g, unknown or other
  misc_feature (450)..(464): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactgggggccaggggaaccctggtcacggtctcctcagcctccaccaagggcccatcggtcttccccctggccgccctgctcccagggacgccacctccgacgagcacagcggccctgggctgcctgggtcaaggacctacttcattctacactactgacgcgggctggcaacggcgnatacgnnnnnnnnnnnnnnn

SEQ ID NO: 294793 - DNA, 450 bp, Homo sapiens
  misc_feature: GYAE6OF02F7YNT.37.77.G11.1.454.CMB.1.raw
  modified_base (442)..(450): a, c, t, g, unknown or other
  misc_feature (442)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaaggcccatccggtcttccccctggccgccctgcctccaggacgcacctccgagacgcacagcggccctggggctgcctggtcaaggactacttccatctacactactgagcgggctggcaaggcgcatagnnnnnnnnn

SEQ ID NO: 294794 - DNA, 429 bp, Homo sapiens
  misc_feature: GYAE6OF02GLIX9.37.77.G11.1.454.CMB.1.raw
  modified_base (421)..(429): a, c, t, g, unknown or other
  misc_feature (421)..(429): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggccaccctcctccaagagcacctctgggggcacagcggccctgggctgcctggtcaaggactacttccatctacactactgagcgggctggcaggcgcatagnnnnnnnnn

SEQ ID NO: 294795 - DNA, 725 bp, Homo sapiens
  misc_feature: GYAE6OF02IW4XY.37.77.G11.1.454.CMB.1.raw
  modified_base (211)..(211): a, c, t, g, unknown or other
  misc_feature (211)..(211): n is a, c, g, or t
  modified_base (622)..(622): a, c, t, g, unknown or other
  misc_feature (622)..(622): n is a, c, g, or t
  modified_base (626)..(626): a, c, t, g, unknown or other
  misc_feature (626)..(626): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattacngtgtgaagggaccgtctacgaccctactagcagcggcgtgtcgtcggtacgttgtacgacgtcgggcgacgggaacccgtcggtcgacccgtcttccttccagccctcccgtaccaacgggaccccgtactaccgggtttccgtttaccccccgtccggtaccgggccccttcgtcgttccccacggacggacctaccgttacccggaacgaacggaccaccgaacggccgggacccggttcggggaccggttcgccccgtacgggtttacgaaccgggtaaaccgttaccgttttacccgtaacccgttaacggttaaccaaccctttaaaccgttgggtaaccgggtcccggggggtaccgttccggggaccggttaaacggggccgacccgtaaagtttaggcgtacngtancctagagtacaggctacgcgtacgtacgtacgtagacgtacgtacgacggtacgtacgtacgtcgtacgtacgtacgtacgtacgacgtacgacgtacg

SEQ ID NO: 294796 - DNA, 456 bp, Homo sapiens
  misc_feature: GYAE6OF02HUHX5.37.77.G11.1.454.CMB.1.raw
  modified_base (443)..(443): a, c, t, g, unknown or other
  misc_feature (443)..(443): n is a, c, g, or t
  modified_base (448)..(456): a, c, t, g, unknown or other
  misc_feature (448)..(456): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtccttccccctggccgccctgcctccgaggacgcacctccgagacgccacagccggccctgggctgccttgggtcaagggacctacttccactctacactactgagcgggctggcaggcncatgnnnnnnnnn

SEQ ID NO: 294797 - DNA, 473 bp, Homo sapiens
  misc_feature: GYAE6OF02IP9UL.37.77.G11.1.454.CMB.1.raw
  modified_base (367)..(367): a, c, t, g, unknown or other
  misc_feature (367)..(367): n is a, c, g, or t
  modified_base (457)..(473): a, c, t, g, unknown or other
  misc_feature (457)..(473): n is a, c, g, or t
tcagtagtgtagatcacgaccggtgctcgatttagctagtcactcaagggaaaggggctggagtgggtctcagctattaatgggaatgttgataccacatactacgcagactccgtgaagggccggttcaccatctccagggacaattccaagaacacactgtctctgcaaatgaacagcctgagagtcgaggacacggccttatattattgtgcgaaagacccccaacggtgaccacattggagtcttttgacttcgtggggccaagggacaacggtcaccgtctcttcagccctcaccaacgggcccatccggtcttcccccgtggccgcccctgcctccaggacgccacctccgagacgcacgngccggccctgggcctgcccgtggtcaacggtctacttccatcctaacactactcggaacgcggggctcgggacaagggccgactagtagnnnnnnnnnnnnnnnnn

SEQ ID NO: 294798 - DNA, 436 bp, Homo sapiens
  misc_feature: GYAE6OF02JGHJI.37.77.G11.1.454.CMB.1.raw
  modified_base (212)..(212): a, c, t, g, unknown or other
  misc_feature (212)..(212): n is a, c, g, or t
  modified_base (307)..(307): a, c, t, g, unknown or other
  misc_feature (307)..(307): n is a, c, g, or t
  modified_base (339)..(339): a, c, t, g, unknown or other
  misc_feature (339)..(339): n is a, c, g, or t
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (420)..(436): a, c, t, g, unknown or other
  misc_feature (420)..(436): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagccgaaagacacggccgtatattacngtgtgaaagctgggagtgggggactacgtggggccagggaaccctggtcaccgtctccgtcagcctccacgaggcccatcggtcctccccgcgcncccctctaccagacgcacctcgtcggggcacngccggccctggcctgcctggacacggactacgttccatctaccactacncgtacgcgggctcggcgacggcncgatacggnnnnnnnnnnnnnnnnn

SEQ ID NO: 294799 - DNA, 572 bp, Homo sapiens
  misc_feature: GYAE6OF02IUIY7.37.77.G11.1.454.CMB.1.raw
  modified_base (225)..(225): a, c, t, g, unknown or other
  misc_feature (225)..(225): n is a, c, g, or t
  modified_base (538)..(539): a, c, t, g, unknown or other
  misc_feature (538)..(539): n is a, c, g, or t
  modified_base (541)..(572): a, c, t, g, unknown or other
  misc_feature (541)..(572): n is a, c, g, or t
tcagtagtgtagatcacgaccggtgctcgatttagctagtcactcgaaggggaaaggggctggaggtgggtctcagctattaatgggaatggtgataccacatactacgcagactccgtgaaggggccggttcacatctccagggacaattccaagaacacactgtctctgcaaatgaacagcctgagagtcgaggacacggccttatattactgtgacgagagntcagacggagtattagcagcagtctctgacgtacgtcggggaccacggtaccctacggtccaccgtcctacctcgacgccctacccgaccgaacggccctacgtcccggttccttcccccgcggtaccctccccgtcccgtaccgaacgtaccgccgaaccgttcggcggggaccaaccgacgggccggtcccgggtcgggtccgtcggtccgttcggtaccgtaaacggtacccgtaacctttccacgttacctaacgtaccgttacgcggtaacggccgggacgtcgggaaccgaggcgactaagacggcnncnnnnnnnnnnnnnnnnnnnnnnnnnnnnnnnn

SEQ ID NO: 294800 - DNA, 575 bp, Homo sapiens
  misc_feature: GYAE6OF02H1Q3N.37.77.G11.1.454.CMB.1.raw
  modified_base (347)..(347): a, c, t, g, unknown or other
  misc_feature (347)..(347): n is a, c, g, or t
  modified_base (544)..(575): a, c, t, g, unknown or other
  misc_feature (544)..(575): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggcctttatattactgtgtgaagggcctctagccccttatagcagcggctggtcctggttactttgacgactggggcacggggaaccctggtccaccgtctcctcacgcctcccaccgaacgggccccagttcccggtcctttcccccgnggcccgtcccctgcctccgaggacgcctaccgtccgagacgccaacgacggcccggcccgtggggcctcggcccgttacgggtacgaaacgggttacccttaacctttcccaacgttcccttaacctccgttaaacgttggaccgggacgggggtcccgttagggaccggaaacggggtcccgtacgaagttacggnnnnnnnnnnnnnnnnnnnnnnnnnnnnnnnn

SEQ ID NO: 294801 - DNA, 507 bp, Homo sapiens
  misc_feature: GYAE6OF02H3UMW.37.77.G11.1.454.CMB.1.raw
  modified_base (483)..(507): a, c, t, g, unknown or other
  misc_feature (483)..(507): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtccaccgtctcctcacgcctcccaaccgaaggccccaagtccggttccctttccccccgtggcccgtcccctggcctccgacggacgcctaccgtccgagagccacgacggtccggcccgtgggcctgccgtggtcagggtacctacttccatcctacactactgacggtcgggactggcgaacggccgacatacgnnnnnnnnnnnnnnnnnnnnnnnnn

SEQ ID NO: 294802 - DNA, 477 bp, Homo sapiens
  misc_feature: GYAE6OF02HHKJ5.37.77.G11.1.454.CMB.1.raw
  modified_base (345)..(345): a, c, t, g, unknown or other
  misc_feature (345)..(345): n is a, c, g, or t
  modified_base (365)..(365): a, c, t, g, unknown or other
  misc_feature (365)..(365): n is a, c, g, or t
  modified_base (458)..(458): a, c, t, g, unknown or other
  misc_feature (458)..(458): n is a, c, g, or t
  modified_base (462)..(477): a, c, t, g, unknown or other
  misc_feature (462)..(477): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccacgggaacccctggtccaccgtctcctcagccctaccgaccgaacggccccagtccggtccttcccccgnggccgcctgctccgaggacncacctcggagcgcacgagcggccgtagggctcgcctggaccaaaggtcttaaccgtcaacttcaacactacgtgacgcggctggcgaagcganatgnnnnnnnnnnnnnnnn

SEQ ID NO: 294803 - DNA, 554 bp, Homo sapiens
  misc_feature: GYAE6OF02F4T6K.37.77.G11.1.454.CMB.1.raw
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (524)..(524): a, c, t, g, unknown or other
  misc_feature (524)..(524): n is a, c, g, or t
  modified_base (526)..(526): a, c, t, g, unknown or other
  misc_feature (526)..(526): n is a, c, g, or t
  modified_base (528)..(531): a, c, t, g, unknown or other
  misc_feature (528)..(531): n is a, c, g, or t
  modified_base (533)..(533): a, c, t, g, unknown or other
  misc_feature (533)..(533): n is a, c, g, or t
  modified_base (535)..(554): a, c, t, g, unknown or other
  misc_feature (535)..(554): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtctggtactttgacgacgtggggccagggaaccctggtcaccgtctcctcagcctccaccaagggcccatccggtccttcccccgtggccgcccctgcctcccaggacgtccacctccgagacgcacgtacgccggcccgtgggcctacgccttcgggtacaacgggtaactaccctttaccaagttacctaaccgacttaaaccgtaggtacggacccgggggaccttggggaccgtaaaggggcccgaactaacggttaacggnanncacgananannnncngnnnnnnnnnnnnnnnnnnnn

SEQ ID NO: 294804 - DNA, 574 bp, Homo sapiens
  misc_feature: GYAE6OF02FOZS8.37.77.G11.1.454.CMB.1.raw
  modified_base (357)..(357): a, c, t, g, unknown or other
  misc_feature (357)..(357): n is a, c, g, or t
  modified_base (541)..(545): a, c, t, g, unknown or other
  misc_feature (541)..(545): n is a, c, g, or t
  modified_base (547)..(559): a, c, t, g, unknown or other
  misc_feature (547)..(559): n is a, c, g, or t
  modified_base (561)..(574): a, c, t, g, unknown or other
  misc_feature (561)..(574): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggcacggccttatattactgtgtgaacgggtacctctacgtcccccttagtacgcaggcggtcgttggtccttggttacgtttgacgacgtggggaccagggaaccccttggtcacccgtctccctcacgcctcccaccgacgggcccagtccggtccttccccgnggcccgtccctgcctccgaggcacctaccgtccggagacgccaacgcggccggtcccgtgggcctcggtcccgtacggttacgaaacgggtacccttaaccttacccgtataccctaacctacgttaaccgtggaccgggccggggtactacggggaccgtaacgggccgtactacggtggacnnnnngnnnnnnnnnnnnngnnnnnnnnnnnnnn

SEQ ID NO: 294805 - DNA, 427 bp, Homo sapiens
  misc_feature: GYAE6OF02GCDTZ.37.77.G11.1.454.CMB.1.raw
  modified_base (331)..(331): a, c, t, g, unknown or other
  misc_feature (331)..(331): n is a, c, g, or t
  modified_base (341)..(341): a, c, t, g, unknown or other
  misc_feature (341)..(341): n is a, c, g, or t
  modified_base (350)..(350): a, c, t, g, unknown or other
  misc_feature (350)..(350): n is a, c, g, or t
  modified_base (419)..(419): a, c, t, g, unknown or other
  misc_feature (419)..(419): n is a, c, g, or t
  modified_base (421)..(421): a, c, t, g, unknown or other
  misc_feature (421)..(421): n is a, c, g, or t
  modified_base (423)..(427): a, c, t, g, unknown or other
  misc_feature (423)..(427): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaaggccatcggtctcccctgcncctgctcagncactcgagngcacagcgccgtgggctgcctggtcaacggactacttccatcctacactatgagcgggctggcaaggcnangnnnnn

SEQ ID NO: 294806 - DNA, 465 bp, Homo sapiens
  misc_feature: GYAE6OF02IBZQK.37.77.G11.1.454.CMB.1.raw
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (360)..(360): a, c, t, g, unknown or other
  misc_feature (360)..(360): n is a, c, g, or t
  modified_base (405)..(405): a, c, t, g, unknown or other
  misc_feature (405)..(405): n is a, c, g, or t
  modified_base (438)..(465): a, c, t, g, unknown or other
  misc_feature (438)..(465): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccacaacggccatccggtcttccccnggccgcctgctcaggngcacctcgagancacagcgcctgggctgcctggacgaaggactacgtccatctaacnctaactgagcgggctcggcaaggcacagtacgnnnnnnnnnnnnnnnnnnnnnnnnnnnn

SEQ ID NO: 294807 - DNA, 168 bp, Homo sapiens
  misc_feature: GYAE6OF02JHA0J.37.77.G11.1.454.CMB.1.raw
  modified_base (168)..(168): a, c, t, g, unknown or other
  misc_feature (168)..(168): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctn

SEQ ID NO: 294808 - DNA, 572 bp, Homo sapiens
  misc_feature: GYAE6OF02G3729.37.77.G11.1.454.CMB.1.raw
  modified_base (538)..(539): a, c, t, g, unknown or other
  misc_feature (538)..(539): n is a, c, g, or t
  modified_base (542)..(544): a, c, t, g, unknown or other
  misc_feature (542)..(544): n is a, c, g, or t
  modified_base (546)..(548): a, c, t, g, unknown or other
  misc_feature (546)..(548): n is a, c, g, or t
  modified_base (550)..(572): a, c, t, g, unknown or other
  misc_feature (550)..(572): n is a, c, g, or t
tcagtagtgtagatcacgaccggtgctcgatttagctagtcactcaagggaaggggctggagtgggtctcagctattaattggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgacgtggggccagggaaccctggtcaccgtctcctcacgccctccaccgaacgggcccacgtccggtccttcccccgtggccgccctcgcctccgaggacgccacccgtccgagacgcaccgacggccggcccgtgggcctacggtcccgtcgggtaccgaaacggtaccttacctttcccaacgtttccctaaaccgtaccgttaaccgttacgggaacgggtccggggtaccgtcgggacccgaaacggggcccggtacctaacgtacggcnncgnnngnnncnnnnnnnnnnnnnnnnnnnnnnn

SEQ ID NO: 294809 - DNA, 449 bp, Homo sapiens
  misc_feature: GYAE6OF02HLY49.37.77.G11.1.454.CMB.1.raw
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (439)..(449): a, c, t, g, unknown or other
  misc_feature (439)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagcctccaccaagggcccatccggtcttcccccnggccgccctgcctccaggngcacctccgagagcacagcggccctgggctgcctggtcaaggctactccatctacactactgacgcgggctggcaaggcgcatagnnnnnnnnnnn

SEQ ID NO: 294810 - DNA, 449 bp, Homo sapiens
  misc_feature: GYAE6OF02HPTWU.37.77.G11.1.454.CMB.1.raw
  modified_base (413)..(413): a, c, t, g, unknown or other
  misc_feature (413)..(413): n is a, c, g, or t
  modified_base (431)..(449): a, c, t, g, unknown or other
  misc_feature (431)..(449): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagccgaggacacggctgtgtattactgtgcgagagcccctccacctcagcagcagcggtgacttctggggccagggaaccctggtcaccgtctcctcagcctccaccaggcccatcggtccttccccctggccacccctcctcccaagacgcacctcgtgggggcacgacgcggcccgtcgggctgccgtggtcaacggactacttccatctacactactgagcgggntcggcaacggcgcatagnnnnnnnnnnnnnnnnnnn

SEQ ID NO: 294811 - DNA, 561 bp, Homo sapiens
  misc_feature: GYAE6OF02JMMXO.37.77.G11.1.454.CMB.1.raw
  modified_base (525)..(525): a, c, t, g, unknown or other
  misc_feature (525)..(525): n is a, c, g, or t
  modified_base (528)..(530): a, c, t, g, unknown or other
  misc_feature (528)..(530): n is a, c, g, or t
  modified_base (532)..(532): a, c, t, g, unknown or other
  misc_feature (532)..(532): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (539)..(561): a, c, t, g, unknown or other
  misc_feature (539)..(561): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggtccagggaacccgtggtcaccgtctcctcacgcctccaccaacgggcccagtccggtaccttcccccgtggccgcccctcgcctccgacggacgccaccgtccgacgacgccacgacgccggacccgtcgggccgtcgcccgttgggtaccaacgggtacctaccgtttcccgaacttcctaacctacccgtaccttaggaaccgggtccgggtcgttacgggcccgaaagggccgaccgaacgttacgggncgnnngncgngncnnnnnnnnnnnnnnnnnnnnnnn

SEQ ID NO: 294812 - DNA, 463 bp, Homo sapiens
  misc_feature: GYAE6OF02JYW4H.37.77.G11.1.454.CMB.1.raw
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (429)..(429): a, c, t, g, unknown or other
  misc_feature (429)..(429): n is a, c, g, or t
  modified_base (436)..(437): a, c, t, g, unknown or other
  misc_feature (436)..(437): n is a, c, g, or t
  modified_base (439)..(463): a, c, t, g, unknown or other
  misc_feature (439)..(463): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgagggacctctagccccttatagcagcggctggtcctggtactttgacgactggggccagggaccctggtcaccgtctcctcagcctaccaccgaggcccatcggtcttccccctggccgaccctgcctccaggacgccaccgtccgagacgccacagcggcctgggctgcctgtcaggctactccatcacnctacngagcgggctgacaggcncagtganncnnnnnnnnnnnnnnnnnnnnnnnnn

SEQ ID NO: 294813 - DNA, 540 bp, Homo sapiens
  misc_feature: GYAE6OF02FXGTH.37.77.G11.1.454.CMB.1.raw
  modified_base (512)..(513): a, c, t, g, unknown or other
  misc_feature (512)..(513): n is a, c, g, or t
  modified_base (515)..(540): a, c, t, g, unknown or other
  misc_feature (515)..(540): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgttcgaaagataggtactctggttcggcgtacttttttaatgtccatctttgaccacgtggggccaggggaacccctggtcaccgtctcctcagcctccaccaagggcccagtccggtccttccccctggccgccctgcctccgaggacgccaccctccgagacgcacgacggccggcccgtggggcctcggcccgttagggtaccaaacgggtacctttaacccgtttcccaagtttccctaacctaacctaacttcgggacggccggggtccgtgggaccgaacgggccgacaagtagnngnnnnnnnnnnnnnnnnnnnnnnnnnn

SEQ ID NO: 294814 - DNA, 476 bp, Homo sapiens
  misc_feature: GYAE6OF02I993C.37.77.G11.1.454.CMB.1.raw
  modified_base (454)..(476): a, c, t, g, unknown or other
  misc_feature (454)..(476): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggccccatccggtcttccccctggccgcccctgcctccaggtagccacctccgagacgcacagcggccctgggctgcctggtcaaggctacttccatctacactactgagcggggctgggaccaaggccgctaagtacgcnnnnnnnnnnnnnnnnnnnnnnn

SEQ ID NO: 294815 - DNA, 538 bp, Homo sapiens
  misc_feature: GYAE6OF02HFS5D.37.77.G11.1.454.CMB.1.raw
  modified_base (364)..(364): a, c, t, g, unknown or other
  misc_feature (364)..(364): n is a, c, g, or t
  modified_base (508)..(508): a, c, t, g, unknown or other
  misc_feature (508)..(508): n is a, c, g, or t
  modified_base (510)..(538): a, c, t, g, unknown or other
  misc_feature (510)..(538): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagccagcggctggtcctggttctttgacgacgtggggccacgggaaccctggtccaccggtctcctcacgcctccaaccgacggcccagtccggtccttccccgtggccgccctgcctccgaggacnccacctccgagcgcacacggccgcccggtgggacctcgccgttcggtacgaacgggtccttaccttccaagtcctaaaccacgttacgtcggaacgggccggggtcttacgggccaaacggggtccgaacctacgtagctgacncnnnnnnnnnnnnnnnnnnnnnnnnnnnnn

SEQ ID NO: 294816 - DNA, 520 bp, Homo sapiens
  misc_feature: GYAE6OF02HGDKF.37.77.G11.1.454.CMB.1.raw
  modified_base (488)..(505): a, c, t, g, unknown or other
  misc_feature (488)..(505): n is a, c, g, or t
  modified_base (507)..(520): a, c, t, g, unknown or other
  misc_feature (507)..(520): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagccctccaccaacgggccccatccggtccttccccctggcgcccctgcctccgaggtacgcaccgtcgtcggggggcacgacgccggccctggggctcggaccgtggcaacgggaccttactttcccagttccctaacgacctacgtggacggccgggctgggaccgaagggccgacgagtagctgnnnnnnnnnnnnnnnnnngnnnnnnnnnnnnnn

SEQ ID NO: 294817 - DNA, 447 bp, Homo sapiens
  misc_feature: GYAE6OF02GO7OA.37.77.G11.1.454.CMB.1.raw
  modified_base (429)..(447): a, c, t, g, unknown or other
  misc_feature (429)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgcgagagatcagacggagtatagcagcagctctgactactggggccacggaaccctggtcaccgtctcctcagcctccaccaaggcccatcggtctccccctgcaccctcctccaagagccacctcgtcggggcacgacgcggccctgggctcgccgtggtcaaggactaccttccactctacactactgaggcgggctcggcaaggcgcatacgnnnnnnnnnnnnnnnnnnn

SEQ ID NO: 294818 - DNA, 536 bp, Homo sapiens
  misc_feature: GYAE6OF02GBMDZ.37.77.G11.1.454.CMB.1.raw
  modified_base (347)..(347): a, c, t, g, unknown or other
  misc_feature (347)..(347): n is a, c, g, or t
  modified_base (499)..(499): a, c, t, g, unknown or other
  misc_feature (499)..(499): n is a, c, g, or t
  modified_base (503)..(503): a, c, t, g, unknown or other
  misc_feature (503)..(503): n is a, c, g, or t
  modified_base (507)..(510): a, c, t, g, unknown or other
  misc_feature (507)..(510): n is a, c, g, or t
  modified_base (512)..(536): a, c, t, g, unknown or other
  misc_feature (512)..(536): n is a, c, g, or t
tcagtagtgtagatcacgaccggtgctcgatttagctagtcactcaagggaaagggggctggagtgggtctcagctattaaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcacgcctccaccgaagggcccagtccggttccttccccctggccnccctgcctccaggacgccaccgtccgagacgcacgacgccggcccgtgggcctaggcccgttgggtaccgaaacggaccttaccttccgatcctaactactactggaacggccgggtctcgggaccaaaggggtccgaccgtagttaacggntagngacnnnngnnnnnnnnnnnnnnnnnnnnnnnnn

SEQ ID NO: 294819 - DNA, 514 bp, Homo sapiens
  misc_feature: GYAE6OF02I56ED.37.77.G11.1.454.CMB.1.raw
  modified_base (370)..(370): a, c, t, g, unknown or other
  misc_feature (370)..(370): n is a, c, g, or t
  modified_base (490)..(491): a, c, t, g, unknown or other
  misc_feature (490)..(491): n is a, c, g, or t
  modified_base (493)..(514): a, c, t, g, unknown or other
  misc_feature (493)..(514): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggaacccctggtccaccgtctcctcacgcctccaccgaacggggcccagtccgggtccttcccccgtgggccgcccctcgcctccgagggacnccaccctccgagacgcacgacgcggccctggggcctcgcctcgggtaccaagggtaccttaccgttccattacctacaacttctaggacggtcgggctcggacgaacgggcacgagtagnngnnnnnnnnnnnnnnnnnnnnnn

SEQ ID NO: 294820 - DNA, 579 bp, Homo sapiens
  misc_feature: GYAE6OF02JVHUN.37.77.G11.1.454.CMB.1.raw
  modified_base (347)..(347): a, c, t, g, unknown or other
  misc_feature (347)..(347): n is a, c, g, or t
  modified_base (527)..(527): a, c, t, g, unknown or other
  misc_feature (527)..(527): n is a, c, g, or t
  modified_base (533)..(533): a, c, t, g, unknown or other
  misc_feature (533)..(533): n is a, c, g, or t
  modified_base (535)..(535): a, c, t, g, unknown or other
  misc_feature (535)..(535): n is a, c, g, or t
  modified_base (537)..(537): a, c, t, g, unknown or other
  misc_feature (537)..(537): n is a, c, g, or t
  modified_base (541)..(541): a, c, t, g, unknown or other
  misc_feature (541)..(541): n is a, c, g, or t
  modified_base (543)..(544): a, c, t, g, unknown or other
  misc_feature (543)..(544): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (558)..(559): a, c, t, g, unknown or other
  misc_feature (558)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (572)..(572): a, c, t, g, unknown or other
  misc_feature (572)..(572): n is a, c, g, or t
  modified_base (575)..(576): a, c, t, g, unknown or other
  misc_feature (575)..(576): n is a, c, g, or t
  modified_base (578)..(578): a, c, t, g, unknown or other
  misc_feature (578)..(578): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccagggtaaccctggtcaccgtctcctcacgcctccaccaacggcccacgttccggtccttcccccgtggcccncccgtcgcctccgaggacgccacccgtccggagacgcaccgacgcccggacccgtgggcctgtcccgtgggttaccaacgggtaccttaccgttaccactttccgtaaactaccgtaccgtggaacggtccgggtaccgttacgggaccgaacgggcgaacctagtaacggcgtcagcgngcgtcngncncgcncnncgcgcgcncgcncnncncncgcncncgngcnncnc

SEQ ID NO: 294821 - DNA, 679 bp, Homo sapiens
  misc_feature: GYAE6OF02JPDSE.37.77.G11.1.454.CMB.1.raw
  modified_base (561)..(561): a, c, t, g, unknown or other
  misc_feature (561)..(561): n is a, c, g, or t
  modified_base (623)..(623): a, c, t, g, unknown or other
  misc_feature (623)..(623): n is a, c, g, or t
  modified_base (631)..(631): a, c, t, g, unknown or other
  misc_feature (631)..(631): n is a, c, g, or t
  modified_base (651)..(651): a, c, t, g, unknown or other
  misc_feature (651)..(651): n is a, c, g, or t
  modified_base (656)..(656): a, c, t, g, unknown or other
  misc_feature (656)..(656): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (669)..(669): a, c, t, g, unknown or other
  misc_feature (669)..(669): n is a, c, g, or t
  modified_base (671)..(671): a, c, t, g, unknown or other
  misc_feature (671)..(671): n is a, c, g, or t
  modified_base (673)..(673): a, c, t, g, unknown or other
  misc_feature (673)..(673): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
tcagtagtgtagatcacgaccggtgctcgatttagctagtcactcaagggaaaggggctggagtgggtctcagctattaatgggaatggtgataccacatactacgcagactccgtgaagggccgttcaccatctccagggacaatttcccaagagcactcgtacgtctcacgacaagtacgacacgcctaggagtaggacggacggaccgaccggttactttaattaccgtagttcgggtgtaacgggaaccgttcccttagtaccctacccgttaagtccggacaccgggtccgacggtttcgaccggtttacggttacgtttcggaactccggggtccgggacgaaccggtaccggtgtcccgtccgtacgtcctgaccggtccaccgtacgaccggacctggttccgttacccctccgggtcgaccctcccgtacgccccgttaggacgggccacccgtaccgtcggaacgtccgccaacgggtcgacccgttccggttggaccgtccgtacggtaccgggtactaaccggttaccgtccgtaccgtctacgtaccncgttacgtcggacgtccgcgtacgtacggacgtcgactagtacgcgactggctcgacgcgtnccgtgacnggcactttggcaagttccgntaacngancgttancncncncncncnnc

SEQ ID NO: 294822 - DNA, 481 bp, Homo sapiens
  misc_feature: GYAE6OF02HCQY8.37.77.G11.1.454.CMB.1.raw
  modified_base (339)..(339): a, c, t, g, unknown or other
  misc_feature (339)..(339): n is a, c, g, or t
  modified_base (419)..(419): a, c, t, g, unknown or other
  misc_feature (419)..(419): n is a, c, g, or t
  modified_base (451)..(481): a, c, t, g, unknown or other
  misc_feature (451)..(481): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggcccatccggtcttcccccgtggccnccctgcctccaggagcacctccgagcgcacgagccggccctgggctcgcctggtcaaggcctactccatcctacactacngacgcgggctggcgaaggccgacagtagcagnnnnnnnnnnnnnnnnnnnnnnnnnnnnnnn

SEQ ID NO: 294823 - DNA, 528 bp, Homo sapiens
  misc_feature: GYAE6OF02GZOAX.37.77.G11.1.454.CMB.1.raw
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (499)..(528): a, c, t, g, unknown or other
  misc_feature (499)..(528): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcacgccctccaccgaacgggcccctagtccggttcctttcccccccgtgggcccgtccccgtcgcctaccgaggacgccacccgtccggagacgccacgacggccggccctggggctcgcctgggtcgaacggtacctacttccattcctaacactactgcggcgggtctcgggaccaagggccgactagtacgntnacgnnnnnnnnnnnnnnnnnnnnnnnnnnnnnn

SEQ ID NO: 294824 - DNA, 468 bp, Homo sapiens
  misc_feature: GYAE6OF02GMU2T.37.77.G11.1.454.CMB.1.raw
  modified_base (450)..(468): a, c, t, g, unknown or other
  misc_feature (450)..(468): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccccatccggtccttccccctggccgccctgcctccaggacgccacctccgagacgcacgacgcggccctgggctcgcctggtcaacggacctacttccatctacactactgagcgggctggcaaggcgcagtagnnnnnnnnnnnnnnnnnnn

SEQ ID NO: 294825 - DNA, 560 bp, Homo sapiens
  misc_feature: GYAE6OF02HAVHH.37.77.G11.1.454.CMB.1.raw
  modified_base (299)..(299): a, c, t, g, unknown or other
  misc_feature (299)..(299): n is a, c, g, or t
  modified_base (358)..(358): a, c, t, g, unknown or other
  misc_feature (358)..(358): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
  modified_base (537)..(560): a, c, t, g, unknown or other
  misc_feature (537)..(560): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctnacgcctccaccaagggcccatccggtccttccccctggccgccctcgctcccgaggacnccacccgtccgagacgcaacgacgaccgggccccgtggggccttacggcccttcgggtaccgaaacgggtacccttacctttacccgaattaccctaaaccaaccgttaaccgttggaaacgggccggggtcctacggggacgtaaaacggggcccggacaagttacggntacgcangnnnnnnnnnnnnnnnnnnnnnnnn

SEQ ID NO: 294826 - DNA, 447 bp, Homo sapiens
  misc_feature: GYAE6OF02IBLL5.37.77.G11.1.454.CMB.1.raw
  modified_base (211)..(211): a, c, t, g, unknown or other
  misc_feature (211)..(211): n is a, c, g, or t
  modified_base (318)..(318): a, c, t, g, unknown or other
  misc_feature (318)..(318): n is a, c, g, or t
  modified_base (414)..(414): a, c, t, g, unknown or other
  misc_feature (414)..(414): n is a, c, g, or t
  modified_base (424)..(447): a, c, t, g, unknown or other
  misc_feature (424)..(447): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaaagaatacggtctatctggaaatgaacagcctgagagccgaggcacggccctctattacngtgcgagagatcagacggagtatagcagcagctctgactactggggccacggaaccctggtcaccgtctcctcagcctccacacggcccatcggtctcccctggccnccctcctccaagacgcacctcgtggggcacacgcggcctggctgcctggtcaagctacttccatctacactactgacgcgggctggacaacgggcncacgtagcannnnnnnnnnnnnnnnnnnnnnnn

SEQ ID NO: 294827 - DNA, 508 bp, Homo sapiens
  misc_feature: GYAE6OF02H0LH2.37.77.G11.1.454.CMB.1.raw
  modified_base (493)..(508): a, c, t, g, unknown or other
  misc_feature (493)..(508): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagacgccgaagacacggccgtatattactgtgtagaaaggcgtgggggagtggggggactacggtcggggaccgacggggaacccgtggtccaccgttctcctcgacgccctccaaccgaacgggccccacgtccggtcccttccccccgtcggcccacccctcccctaccaacgtacgaccacccgtcggtcggggcaccgacggccggcccgtgggcctcgccgtcggtaccgaacgggtaccttacctccgtacttacctactactacgtcgacggccgggtctgggacgtagggccgacgatacgnnnnnnnnnnnnnnnn

SEQ ID NO: 294828 - DNA, 500 bp, Homo sapiens
  misc_feature: GYAE6OF02HKEZA.37.77.G11.1.454.CMB.1.raw
  modified_base (346)..(346): a, c, t, g, unknown or other
  misc_feature (346)..(346): n is a, c, g, or t
  modified_base (470)..(471): a, c, t, g, unknown or other
  misc_feature (470)..(471): n is a, c, g, or t
  modified_base (473)..(500): a, c, t, g, unknown or other
  misc_feature (473)..(500): n is a, c, g, or t
tcagtagtgtagatcacgaccggtgctcgatttagctagtcactcaagggaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaacgggacctctacgccccctttatagcagcggctggtcctggtactttgacgactggggccagggaaccctggtcaccgtctcctcacgcctccaccgaagggcccagtccggtccttcccccgtggccncccctgcctccgaggacgccaccgtccgagcgcacgacggccggcccgtgggctcgcctggtacaacgggctaccgttcactctaacactactggagccgggctcggacgaagggcacgatagnncnnnnnnnnnnnnnnnnnnnnnnnnnnnn

SEQ ID NO: 294829 - DNA, 533 bp, Homo sapiens
  misc_feature: GYAE6OF02JHNT4.37.77.G11.1.454.CMB.1.raw
  modified_base (297)..(297): a, c, t, g, unknown or other
  misc_feature (297)..(297): n is a, c, g, or t
  modified_base (363)..(363): a, c, t, g, unknown or other
  misc_feature (363)..(363): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
  modified_base (501)..(506): a, c, t, g, unknown or other
  misc_feature (501)..(506): n is a, c, g, or t
  modified_base (508)..(508): a, c, t, g, unknown or other
  misc_feature (508)..(508): n is a, c, g, or t
  modified_base (510)..(533): a, c, t, g, unknown or other
  misc_feature (510)..(533): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggttactttgacgactggggcagggaacccctggtccaccgtcncctcacgcctccaccaacgggcccatccggtccttcccccgtcggccgcccctgcctccgaggacncaccgtccgagacgcaacnggccgcccgngggtcctgcccgtggtacctaacgggacttaccgttacctactcctaactacctacgttcggacggtcggggtcgtcgggtaccgaacgggttccggactagtacggannnnnncngnnnnnnnnnnnnnnnnnnnnnnnn

SEQ ID NO: 294830 - DNA, 765 bp, Homo sapiens
  misc_feature: GYAE6OF02IJ0PA.37.77.G11.1.454.CMB.1.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (649)..(649): a, c, t, g, unknown or other
  misc_feature (649)..(649): n is a, c, g, or t
  modified_base (715)..(715): a, c, t, g, unknown or other
  misc_feature (715)..(715): n is a, c, g, or t
tcagtagtgtagatcacgaccggtgctcgatttagctagtcactcaagggaaaggggctggagtgggtctcagctattaatgggaatggtgataccacatactacgcagactccgtgaaggccggttcaccatctccagagacaattccaagaatacggtctaatctggaaatgaacagtcctgagtagccgaggacacggccctctattacngtgcgagagatccgagacggattanagcagccagcctctgactacgtggggaccaacgggtaaccctgggtaccaacccgtctacccttacgacgcccttacccgaaccgtaaggggtcccctaagtttccgggtacccttcccccggtaggacctaccccgttcctacccgtaaaggtaccggcctaaccgttacgggtacgggggtacccaaccgtaacggggtcccgggaccccctttggggaccgttccggtaaccccgtttggggaacccgtaaaacgggtaccgtttaaccccgtttcgaacccgtttacccgtttaaaccgtccgttaaacccggtttaggggtaaaccggtcccgggggttacttaacggggtaacccgaaacggggttccccggttattaaaccggttaacggccgttaggtaaccncgtaacgtacgtcgtaacgcgttaacgcgttcaacgttcgaacgtctagccgtaagtcttaccgtnctacggctaacgtcgtcttaccgaggtttccacgtacgtacgtacgtacg

SEQ ID NO: 294831 - DNA, 660 bp, Homo sapiens
  misc_feature: GYAE6OF02F87C2.37.77.G11.1.454.CMB.1.raw
  modified_base (363)..(363): a, c, t, g, unknown or other
  misc_feature (363)..(363): n is a, c, g, or t
  modified_base (608)..(608): a, c, t, g, unknown or other
  misc_feature (608)..(608): n is a, c, g, or t
  modified_base (612)..(612): a, c, t, g, unknown or other
  misc_feature (612)..(612): n is a, c, g, or t
  modified_base (626)..(627): a, c, t, g, unknown or other
  misc_feature (626)..(627): n is a, c, g, or t
  modified_base (632)..(632): a, c, t, g, unknown or other
  misc_feature (632)..(632): n is a, c, g, or t
  modified_base (634)..(634): a, c, t, g, unknown or other
  misc_feature (634)..(634): n is a, c, g, or t
  modified_base (636)..(636): a, c, t, g, unknown or other
  misc_feature (636)..(636): n is a, c, g, or t
  modified_base (643)..(643): a, c, t, g, unknown or other
  misc_feature (643)..(643): n is a, c, g, or t
  modified_base (648)..(649): a, c, t, g, unknown or other
  misc_feature (648)..(649): n is a, c, g, or t
  modified_base (653)..(655): a, c, t, g, unknown or other
  misc_feature (653)..(655): n is a, c, g, or t
  modified_base (657)..(659): a, c, t, g, unknown or other
  misc_feature (657)..(659): n is a, c, g, or t
tcagtagtgtagatcacgaccggtgctcgatttagctagtcactcaagggaaaggggcgtggaggtgggtcgtcagctattaatgggaatggtgataccacatactacgcagactccatgaagggccggttcacatctccagggacaattccaagaacacactgtctctgcaaatgaacagcctgagagtcgaggacacggcttatagttactgtgtgaagggcctcacgtcccttatacgcagcggctggtcctggttactttgacgacgtcggggccaggggtaacctggtccaccgtcgtccctcgacgccctccgaaccgtaagggcccctaagttcccgggtacccttttcccccggnggcccggtccccttcggccgttacccgaacgggacgacccgtacccgttccggaacgggtaacgccgtaaaccgaccggtcccgggtccccggttacggggccttacgggtcccgttgggggtaaccctaaaaggggtccctttaaccgttttacccagttacccttaaccgtaacgtacccgttaggacgggttcccgggactacggggaccgaaacggtcccgactaaggtaccgagctaagngacncgcgttacgctcgnncgcgncncncgcgcgngctcnncgcnnncnnng

SEQ ID NO: 294832 - DNA, 539 bp, Homo sapiens
  misc_feature: GYAE6OF02IBBAX.37.77.G11.1.454.CMB.1.raw
  modified_base (501)..(502): a, c, t, g, unknown or other
  misc_feature (501)..(502): n is a, c, g, or t
  modified_base (504)..(505): a, c, t, g, unknown or other
  misc_feature (504)..(505): n is a, c, g, or t
  modified_base (507)..(508): a, c, t, g, unknown or other
  misc_feature (507)..(508): n is a, c, g, or t
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
  modified_base (517)..(517): a, c, t, g, unknown or other
  misc_feature (517)..(517): n is a, c, g, or t
  modified_base (519)..(539): a, c, t, g, unknown or other
  misc_feature (519)..(539): n is a, c, g, or t
tcagtagtgtagatcacgaccggtgctcgatttagctagtcactcaagggaaaggggctggagtgggtctcagctattaatgggatggtgataccacatactacgcagactccgtgaagggccggttcaccatctccagggacaattccaagaacacactgtctctgcaaatgaacagcctgagagtcgaggacacggccttatattactgtgtgaaggcctctacgccccttatagcagcgctggtcctggttactttgacgacgtgggccagggacctggtcaccgtctcctcacgcctccgaccaacgggcccagtccggtccttccccgtggccgccctgccctccgaggcgcctaccgtccgagacgccacgacgccggcccgtggccgtcgtccgtggtaccgaaggtcccttaccgtttccaacgtttcctaaccgtacctaccgtggaccgggccggggtactcgggaacgtaacgggccgtacgagtaccgnncnncnncgtnncncncnnnnnnnnnnnnnnnnnnnnn

SEQ ID NO: 294833 - DNA, 529 bp, Homo sapiens
  misc_feature: GYAE6OF02IFIW1.37.77.G11.1.454.CMB.1.raw
  modified_base (233)..(233): a, c, t, g, unknown or other
  misc_feature (233)..(233): n is a, c, g, or t
  modified_base (486)..(486): a, c, t, g, unknown or other
  misc_feature (486)..(486): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(496): a, c, t, g, unknown or other
  misc_feature (496)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(502): a, c, t, g, unknown or other
  misc_feature (502)..(502): n is a, c, g, or t
  modified_base (504)..(504): a, c, t, g, unknown or other
  misc_feature (504)..(504): n is a, c, g, or t
  modified_base (506)..(506): a, c, t, g, unknown or other
  misc_feature (506)..(506): n is a, c, g, or t
  modified_base (508)..(508): a, c, t, g, unknown or other
  misc_feature (508)..(508): n is a, c, g, or t
  modified_base (510)..(510): a, c, t, g, unknown or other
  misc_feature (510)..(510): n is a, c, g, or t
  modified_base (512)..(513): a, c, t, g, unknown or other
  misc_feature (512)..(513): n is a, c, g, or t
  modified_base (515)..(516): a, c, t, g, unknown or other
  misc_feature (515)..(516): n is a, c, g, or t
  modified_base (518)..(522): a, c, t, g, unknown or other
  misc_feature (518)..(522): n is a, c, g, or t
  modified_base (524)..(529): a, c, t, g, unknown or other
  misc_feature (524)..(529): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagccgaggacacggccctatattactgtacgaaaatggctacggatangactactatgggactggtacttcgatctcgtggggccgtggcacctggtcactgtctccgtcagcctccaccgaacgggcccactccggttccttccccctgggccgtcccctggcctccgaggcgcacccgtccgagacgcacacggcggcccgtgggctcggccgtgggtacaacggccttacctccgactccgtaaccactaactcggacggccgggtctacgggccaaagggccgacgaacgttaagcngcgncncngncncncncncncncncnngnncnnnnncnnnnnn

SEQ ID NO: 294834 - DNA, 544 bp, Homo sapiens
  misc_feature: GYAE6OF02GAAVJ.37.77.G11.1.454.CMB.1.raw
  modified_base (513)..(514): a, c, t, g, unknown or other
  misc_feature (513)..(514): n is a, c, g, or t
  modified_base (518)..(544): a, c, t, g, unknown or other
  misc_feature (518)..(544): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgagggacctctagccccttatagcagcggctggtcctggtactttgacgacgtggggccagggaaccctggtccaccgtctcctcacgccctccaaccgaagggcccagtccggtccttcccccgtggccgccctgcctccgagggacgccaccgtccgagacgcacgacggcccggcccgtgggcctcgcccgtgggtaccgaaacgggtaccttaaccgtttccaacgttcctaacctacctacgttcggaacggccggggtactcgggacgaagggtccgataacgtaggcagcnncagnnnnnnnnnnnnnnnnnnnnnnnnnnn

SEQ ID NO: 294835 - DNA, 493 bp, Homo sapiens
  misc_feature: GYAE6OF02GX98V.37.77.G11.1.454.CMB.1.raw
  modified_base (463)..(463): a, c, t, g, unknown or other
  misc_feature (463)..(463): n is a, c, g, or t
  modified_base (469)..(493): a, c, t, g, unknown or other
  misc_feature (469)..(493): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgactggggccaggaaccctggtcaccgtctcctcagcctccaccaacgggcccagtccggttccttccccccgtggcccgcccctgcctaccgagggacgccaccctaccgagacgccacgacgccggcccgtgggcctcgccttgggacaacggtactactccatctacactctgacgcgggctcggacaagggcanactgcnnnnnnnnnnnnnnnnnnnnnnnnn

SEQ ID NO: 294836 - DNA, 450 bp, Homo sapiens
  misc_feature: GYAE6OF02GPY7N.37.77.G11.1.454.CMB.1.raw
  modified_base (226)..(226): a, c, t, g, unknown or other
  misc_feature (226)..(226): n is a, c, g, or t
  modified_base (336)..(336): a, c, t, g, unknown or other
  misc_feature (336)..(336): n is a, c, g, or t
  modified_base (364)..(364): a, c, t, g, unknown or other
  misc_feature (364)..(364): n is a, c, g, or t
  modified_base (408)..(408): a, c, t, g, unknown or other
  misc_feature (408)..(408): n is a, c, g, or t
  modified_base (414)..(414): a, c, t, g, unknown or other
  misc_feature (414)..(414): n is a, c, g, or t
  modified_base (430)..(430): a, c, t, g, unknown or other
  misc_feature (430)..(430): n is a, c, g, or t
  modified_base (437)..(450): a, c, t, g, unknown or other
  misc_feature (437)..(450): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctntacgccccttatagcagcggctggtcctggtactttgacgactggggccagggaacctggtcacggtctcctcagcctccacaacggcccatcggtcttccccctggccnccctgcctccgaggagccacctccgagngcacacgcggcccgtggctgcctggtcaggactactcatctacnctactnagcggcgtgcgaggcncatacgnnnnnnnnnnnnnn

SEQ ID NO: 294837 - DNA, 462 bp, Homo sapiens
  misc_feature: GYAE6OF02GUXZ9.37.77.G11.1.454.CMB.1.raw
  modified_base (425)..(425): a, c, t, g, unknown or other
  misc_feature (425)..(425): n is a, c, g, or t
  modified_base (442)..(442): a, c, t, g, unknown or other
  misc_feature (442)..(442): n is a, c, g, or t
  modified_base (447)..(462): a, c, t, g, unknown or other
  misc_feature (447)..(462): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcagccctccaccaagggcccagtccggtccttcccccgtggccgcccctgcctcccgaggacgcacctccgagacgcacagcggcccgtgggctgcctggtcaaggctactccatctacactacgngagcgggctggcaggcnatagnnnnnnnnnnnnnnnn

SEQ ID NO: 294838 - DNA, 445 bp, Homo sapiens
  misc_feature: GYAE6OF02IA6KD.37.77.G11.1.454.CMB.1.raw
  modified_base (337)..(337): a, c, t, g, unknown or other
  misc_feature (337)..(337): n is a, c, g, or t
  modified_base (351)..(351): a, c, t, g, unknown or other
  misc_feature (351)..(351): n is a, c, g, or t
  modified_base (436)..(445): a, c, t, g, unknown or other
  misc_feature (436)..(445): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggcctttatattactgtgtgaagggacctctagccccttatagcagcggctggtcctggtactttgacgactggggccaggggaaccctggtccaccgtctcctcagcctccaccaagggcccatcggtctcccctggcnccctgcctccaggngcacctcgagagcacagcggccctgggctgcctggtcaaggactacttccatctacactactgagcggctggcaaggcgcatagnnnnnnnnnn

SEQ ID NO: 294839 - DNA, 524 bp, Homo sapiens
  misc_feature: GYAE6OF02IT8F5.37.77.G11.1.454.CMB.1.raw
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (490)..(490): a, c, t, g, unknown or other
  misc_feature (490)..(490): n is a, c, g, or t
  modified_base (493)..(493): a, c, t, g, unknown or other
  misc_feature (493)..(493): n is a, c, g, or t
  modified_base (495)..(501): a, c, t, g, unknown or other
  misc_feature (495)..(501): n is a, c, g, or t
  modified_base (503)..(505): a, c, t, g, unknown or other
  misc_feature (503)..(505): n is a, c, g, or t
  modified_base (507)..(524): a, c, t, g, unknown or other
  misc_feature (507)..(524): n is a, c, g, or t
tcagtagtgtagatcacgaccggtgctcgattttagctagtcactcaagggaaaggggcgtggagtgggtctcagcgtattaatgggaatggtgataccacatactacgcacgtactccgtgaagggccggttcaccatctccagggacattccaagaacgacactgtctctgacaaatgaacagcctagagagtcgagacacggtcttatattactgtgtacgaacggacctctactccccttagtacgcagcgcgtcggtccgtggtacttgacgacggcgggaccgaacggaaccctggtcctaccgtctcctcacgccctaccgaccgtacggacctacgtccggtccctccccgcggcccgtccgtcgccgtccgaggcgaccnccgacgacgacncacgacgcccgtccgtcggctccgcgtcggtacgacgtactaccttccactaccactactagtcggacggcggtcacggacgacgcganagncnnnnnnnannncnnnnnnnnnnnnnnnnnn

SEQ ID NO: 294840 - DNA, 589 bp, Homo sapiens
  misc_feature: GYAE6OF02FMDVL.37.77.G11.1.454.CMB.1.raw
  modified_base (520)..(520): a, c, t, g, unknown or other
  misc_feature (520)..(520): n is a, c, g, or t
  modified_base (537)..(537): a, c, t, g, unknown or other
  misc_feature (537)..(537): n is a, c, g, or t
  modified_base (542)..(542): a, c, t, g, unknown or other
  misc_feature (542)..(542): n is a, c, g, or t
  modified_base (547)..(547): a, c, t, g, unknown or other
  misc_feature (547)..(547): n is a, c, g, or t
  modified_base (549)..(549): a, c, t, g, unknown or other
  misc_feature (549)..(549): n is a, c, g, or t
  modified_base (575)..(575): a, c, t, g, unknown or other
  misc_feature (575)..(575): n is a, c, g, or t
  modified_base (582)..(582): a, c, t, g, unknown or other
  misc_feature (582)..(582): n is a, c, g, or t
  modified_base (585)..(586): a, c, t, g, unknown or other
  misc_feature (585)..(586): n is a, c, g, or t
tcagtagtgtagatcacgaccggtgctcgatttagctagtcactcgaaaggggaaaggggctggacgtgggtctcagctattaatgggaatggtgataccgaccatactacgcagacgtccgtgaagggccggttcaccatctccagggacaatccaagaacacactgtctctgacaaatcgaacacgcctgagacgtcgaaggacaccggtcgttaatattaactagtcgtaggaacgggtacctctacgcccccgttataacgcaagcggcgttaggtcctggtactttggacgacgttggggcaagggaaccctggacgaccgtctaccgtcacgcctcaccaacgggcccagtccgtcctcccctgggcctacctgcctccgaggacgctaccgtcgagacgcgactaggccggccgtgggctcgccgtggtacgaacggacttaccttccgattacctacgtaactacgttgaaccgcgggtacgtcggacgtaaacggcgacgtaattaacggntcgtgtagatacgctanctacncgcgngngcgagcgcgagcacgacgcgacagcncgtcacnctnntcg

SEQ ID NO: 294841 - DNA, 508 bp, Homo sapiens
  misc_feature: GYAE6OF02GLJ2U.37.77.G11.1.454.CMB.1.raw
  modified_base (485)..(508): a, c, t, g, unknown or other
  misc_feature (485)..(508): n is a, c, g, or t
tcagtagtgtagatcacgaccggtgctcgatttagctagtcactcaagggaaggggctggagtgggtctcagctattaatgggaatggtgataccacatactacgcagactcccgtgaagggccggttcaccatctccagggacaattccaagaacacactgtctctgcaaatgaacagcctgagagtcgaggacacggccttatattactgtgtgaagggacctctacgccccttatacgcagcggctggtcctggttactttgacgtacgtggggccgagggtaaccctggtccacccggtctcctcacgcctccaccgaacgggcccagtccggtccttcccccgtggccgcccgtcgcctccgaggacgccaccgtccgagcgcacgacggccggcccgtgggcctgccgtggtacaacggtctaccgttccactctaactactactcggaggcgggctaggacgaaggccgactagtagnnnnnnnnnnnnnnnnnnnnnnnn

SEQ ID NO: 294842 - DNA, 550 bp, Homo sapiens
  misc_feature: GYAE6OF02HM62P.37.77.G11.1.454.CMB.1.raw
  modified_base (528)..(550): a, c, t, g, unknown or other
  misc_feature (528)..(550): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgagacacggccttatattactgtgtgaagggacctctacgccccttatagcagcggcgtggtcctggtactttgacgacgtggggccaacgggaccctggtccaccgtcctcctcgacgccctacccaccgaacgggccctacgttccggttcccttccccccgtggcccgtcccgtcgcctccgaggacgcctaccgtccgacgacgcaacgcggccggcccgtggggccttcggcccgttgggtaccgaaacgggtaccttaccgttccacttccgttaaacgacctacgttgggacggtccggggtcgtcggggaccaagggcccgagtagtacgnnnnnnnnnnnnnnnnnnnnnnn

SEQ ID NO: 294843 - DNA, 537 bp, Homo sapiens
  misc_feature: GYAE6OF02GEUF0.37.77.G11.1.454.CMB.1.raw
  modified_base (362)..(362): a, c, t, g, unknown or other
  misc_feature (362)..(362): n is a, c, g, or t
  modified_base (492)..(492): a, c, t, g, unknown or other
  misc_feature (492)..(492): n is a, c, g, or t
  modified_base (499)..(499): a, c, t, g, unknown or other
  misc_feature (499)..(499): n is a, c, g, or t
  modified_base (505)..(505): a, c, t, g, unknown or other
  misc_feature (505)..(505): n is a, c, g, or t
  modified_base (507)..(508): a, c, t, g, unknown or other
  misc_feature (507)..(508): n is a, c, g, or t
  modified_base (510)..(510): a, c, t, g, unknown or other
  misc_feature (510)..(510): n is a, c, g, or t
  modified_base (512)..(513): a, c, t, g, unknown or other
  misc_feature (512)..(513): n is a, c, g, or t
  modified_base (516)..(524): a, c, t, g, unknown or other
  misc_feature (516)..(524): n is a, c, g, or t
  modified_base (526)..(537): a, c, t, g, unknown or other
  misc_feature (526)..(537): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacaactgtctctgcaaatgaacagcctgagagtcgaggacacggccttatattactgtgtgaagggacctctagcccccttatagcagcggctggtcctggtactttgactactggggccagggaacccctggtccaccgtctcctcagccctccaccgaagggcccatccggtcttcccccgtggccgccctgcctccgaggacnccacccgtccgagtacgcgaccaggccggccctagggcctggccttaggtccaaacgggaccttacgttcccaagtcccgtaactaccgttactaggacggccgggtactgggaccgtaagggcccgtanagtacgngcctangnncntnnatnnnnnnnnncnnnnnnnnnnnn

SEQ ID NO: 294844 - DNA, 506 bp, Homo sapiens
  misc_feature: GYAE6OF02FTGOV.37.77.G11.1.454.CMB.1.raw
  modified_base (342)..(342): a, c, t, g, unknown or other
  misc_feature (342)..(342): n is a, c, g, or t
  modified_base (355)..(355): a, c, t, g, unknown or other
  misc_feature (355)..(355): n is a, c, g, or t
  modified_base (367)..(367): a, c, t, g, unknown or other
  misc_feature (367)..(367): n is a, c, g, or t
  modified_base (447)..(447): a, c, t, g, unknown or other
  misc_feature (447)..(447): n is a, c, g, or t
  modified_base (457)..(457): a, c, t, g, unknown or other
  misc_feature (457)..(457): n is a, c, g, or t
  modified_base (463)..(463): a, c, t, g, unknown or other
  misc_feature (463)..(463): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
  modified_base (477)..(477): a, c, t, g, unknown or other
  misc_feature (477)..(477): n is a, c, g, or t
  modified_base (479)..(479): a, c, t, g, unknown or other
  misc_feature (479)..(479): n is a, c, g, or t
  modified_base (486)..(486): a, c, t, g, unknown or other
  misc_feature (486)..(486): n is a, c, g, or t
  modified_base (488)..(488): a, c, t, g, unknown or other
  misc_feature (488)..(488): n is a, c, g, or t
  modified_base (490)..(490): a, c, t, g, unknown or other
  misc_feature (490)..(490): n is a, c, g, or t
  modified_base (492)..(496): a, c, t, g, unknown or other
  misc_feature (492)..(496): n is a, c, g, or t
  modified_base (498)..(498): a, c, t, g, unknown or other
  misc_feature (498)..(498): n is a, c, g, or t
  modified_base (500)..(500): a, c, t, g, unknown or other
  misc_feature (500)..(500): n is a, c, g, or t
  modified_base (502)..(506): a, c, t, g, unknown or other
  misc_feature (502)..(506): n is a, c, g, or t
tcagtagtgtagatcacgaccggtgctcgatttagctagtcactcgaaggggaaaggggctggagttggtctcagctattaatggggaatggtgataccacagtactacgcagactccgtgaagggccggttcaccatctccagggacaattccaagaacacactgtctctgcaaatgaacagcctgagagtcgaggacacggccttatattactgtgtgaagggtacctctagccccttatagcagcggctggtcctggtactttggacgactgggggccagggaccctggtcacgtctcctcagcctacaccaacgggccatccggtctccccgtggccnccctgcctcaggngccaccgtcganacgcacaggccggcctggggctgggcctgggtcaacggcctacgtcgatctacactgtgacgcgggactggcaagggccncacgtgctcncgagtnacncgngtctcgcncncagctgncngncnnnnncncngnnnnn

SEQ ID NO: 294845 - DNA, 615 bp, Homo sapiens
  misc_feature: GYAE6OF02GFEOV.37.77.G11.1.454.CMB.1.raw
  modified_base (241)..(241): a, c, t, g, unknown or other
  misc_feature (241)..(241): n is a, c, g, or t
  modified_base (599)..(599): a, c, t, g, unknown or other
  misc_feature (599)..(599): n is a, c, g, or t
tcagtagtgtagatcacgaccggtgctcgatttagctagtcactcaaggggaaaggggcgtggagtgggtctcagctattaatgggaatggtgataccacatactacgcagactccgtgaagggccggttcaccatctccagggacaattccaagaacacactgtctctgcaaatgaacacgcctgagagtcgaggacacggccttatattactgtgtgaagggacctctacgccccttanagcagtcgctggtctggtactttgacgacgtcggggccacgggaaccctggtccaccgtctcctcacgtcctccaccgaacgggcccaagtccggtccttcccccgtggccgccctgcctccgaggacgcacccgtacggagtacgacctacgacggccggtcccgtgggcctacgccgttgggtaccaaacgggtaccttaccgttaccgaacttaccgtaaccacttacctagggtacggccgggtactacgggtaccaagggtccgaaccgtaagttaaggctataacgcgagaccttagcgtacgtcgacgtacgaggcagtacgcttaaggctacggaccagagacacgtacncgtactactctctctc

SEQ ID NO: 294846 - DNA, 536 bp, Homo sapiens
  misc_feature: GYAE6OF02HV7IU.37.77.G11.1.454.CMB.1.raw
  modified_base (514)..(536): a, c, t, g, unknown or other
  misc_feature (514)..(536): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggttactttgacgcgtggggccagggaaccctggtcaccgtctcctcacgcctccaccaacgggccctagtccggttccttccccctggcccgccctgccttccgacggacgccacccgtaccgacgacgaccgacgtacggcccgggcccgtgggtcctcggtcccgtgggtaccgaacggtaccttaccttccacttcctaacctacttacgtggtacggccggggtcgtacgggcgtaacgggccgacgtagtacgnnnnnnnnnnnnnnnnnnnnnnn

SEQ ID NO: 294847 - DNA, 463 bp, Homo sapiens
  misc_feature: GYAE6OF02FKUB3.37.77.G11.1.454.CMB.1.raw
  modified_base (439)..(439): a, c, t, g, unknown or other
  misc_feature (439)..(439): n is a, c, g, or t
  modified_base (447)..(447): a, c, t, g, unknown or other
  misc_feature (447)..(447): n is a, c, g, or t
  modified_base (450)..(450): a, c, t, g, unknown or other
  misc_feature (450)..(450): n is a, c, g, or t
  modified_base (452)..(463): a, c, t, g, unknown or other
  misc_feature (452)..(463): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctcccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtcctcctcacgcctccaccaagggccccatccggtccttcccccgtggcccgccctgcctccgaggacgccacctccggagcgcacacggccggcccgtgggctcgccgtggtcaaggtcctactcatctatctactgcgcgggcnggcaggcncangnnnnnnnnnnnn

SEQ ID NO: 294848 - DNA, 553 bp, Homo sapiens
  misc_feature: GYAE6OF02G7GRK.37.77.G11.1.454.CMB.1.raw
  modified_base (349)..(349): a, c, t, g, unknown or other
  misc_feature (349)..(349): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (501)..(501): a, c, t, g, unknown or other
  misc_feature (501)..(501): n is a, c, g, or t
  modified_base (510)..(510): a, c, t, g, unknown or other
  misc_feature (510)..(510): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (522)..(522): a, c, t, g, unknown or other
  misc_feature (522)..(522): n is a, c, g, or t
  modified_base (524)..(524): a, c, t, g, unknown or other
  misc_feature (524)..(524): n is a, c, g, or t
  modified_base (526)..(528): a, c, t, g, unknown or other
  misc_feature (526)..(528): n is a, c, g, or t
  modified_base (531)..(531): a, c, t, g, unknown or other
  misc_feature (531)..(531): n is a, c, g, or t
  modified_base (534)..(534): a, c, t, g, unknown or other
  misc_feature (534)..(534): n is a, c, g, or t
  modified_base (536)..(536): a, c, t, g, unknown or other
  misc_feature (536)..(536): n is a, c, g, or t
  modified_base (538)..(539): a, c, t, g, unknown or other
  misc_feature (538)..(539): n is a, c, g, or t
  modified_base (541)..(548): a, c, t, g, unknown or other
  misc_feature (541)..(548): n is a, c, g, or t
  modified_base (550)..(551): a, c, t, g, unknown or other
  misc_feature (550)..(551): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgcccttatagcagcggcgtcggtcctggtactttgacgcgtgggccaggacctggtcaccgtctcctcacgcctcccaccgaacgggccacgtccggtccttccccgcggcgccctcgcnccgaggcgcnccgtcgagacncacgacgccgcgtggcctagccgttcggacgtaacgggaccttaaccgtccgtaaacttccgtaactaaccgtacgtaacggaccggcggggtacgtcgggaacgtaacgggcgttaaccgaggttaaccncgtcacgtncgcgngcncgcncncnnncgngcngngnncnnnnnnnncnngc

SEQ ID NO: 294849 - DNA, 566 bp, Homo sapiens
  misc_feature: GYAE6OF02HRF5X.37.77.G11.1.454.CMB.1.raw
  modified_base (304)..(304): a, c, t, g, unknown or other
  misc_feature (304)..(304): n is a, c, g, or t
  modified_base (531)..(531): a, c, t, g, unknown or other
  misc_feature (531)..(531): n is a, c, g, or t
  modified_base (536)..(536): a, c, t, g, unknown or other
  misc_feature (536)..(536): n is a, c, g, or t
  modified_base (538)..(542): a, c, t, g, unknown or other
  misc_feature (538)..(542): n is a, c, g, or t
  modified_base (544)..(566): a, c, t, g, unknown or other
  misc_feature (544)..(566): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggcctctacgccccttatagccagcggctggtcctggtactttgacgactggggccagggaaccctggtcaccgtctcctcacncctccaccgaacggcccatccggtccttcccccgtggcccgccctgcctccgaggacgccaccgtcccgagacgccacgacggcccgggcccgtcggggacttccggcccgttagggtacccgaaacgggtaccctttaaccgtttacccaacttcctaaacctaactaccttgggacggtccggggtccgttcggggacgtaaacgggcccgacgaacgttacggntcgangnnnnncnnnnnnnnnnnnnnnnnnnnnnn

SEQ ID NO: 294850 - DNA, 473 bp, Homo sapiens
  misc_feature: GYAE6OF02HJPJ6.37.77.G11.1.454.CMB.1.raw
  modified_base (349)..(349): a, c, t, g, unknown or other
  misc_feature (349)..(349): n is a, c, g, or t
  modified_base (432)..(432): a, c, t, g, unknown or other
  misc_feature (432)..(432): n is a, c, g, or t
  modified_base (463)..(473): a, c, t, g, unknown or other
  misc_feature (463)..(473): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccacgggaacccgtggtcaccgtcctcctcagcctccaccacggcccactcggtccttccccctcggccaccctccnccagacgccacctcgtcgggcacgagccggcccgtgggctcgccgtggtaccaaggacctacctttccacgtcctacactacngacggccgggctcggcgaacggcgacatagnnnnnnnnnnn

SEQ ID NO: 294851 - DNA, 539 bp, Homo sapiens
  misc_feature: GYAE6OF02GYHB4.37.77.G11.1.454.CMB.1.raw
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (509)..(512): a, c, t, g, unknown or other
  misc_feature (509)..(512): n is a, c, g, or t
  modified_base (514)..(514): a, c, t, g, unknown or other
  misc_feature (514)..(514): n is a, c, g, or t
  modified_base (516)..(539): a, c, t, g, unknown or other
  misc_feature (516)..(539): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcgctggcctggtactttgacgactggggccagggaaccctggtcaccgtctcctcngcctccaccaagggcccatccggtcttcccccgtggccgccctgcctccaggacgccacccgtccgaggancacgagccggccctcggggctcggccctggtaccgaacgggaccttaccttcccgtaattcctaaccgaacctttacctaggaaacggtcccgggggacttcggggacctaaaggggccccgtagacgttacgagcacnnnngngnnnnnnnnnnnnnnnnnnnnnnnn

SEQ ID NO: 294852 - DNA, 456 bp, Homo sapiens
  misc_feature: GYAE6OF02JIP9B.37.77.G11.1.454.CMB.1.raw
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (437)..(437): a, c, t, g, unknown or other
  misc_feature (437)..(437): n is a, c, g, or t
  modified_base (440)..(456): a, c, t, g, unknown or other
  misc_feature (440)..(456): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaacccctggtcaccgtctcctcagcctccaccaagggcccatcggtcttccccctggcgccctgcttccaggagcacctccgagacgcacagcgccctgggctgcctggtcaaggctacttccagtctacactacngagcgggctcggcaaggcncanagnnnnnnnnnnnnnnnnn

SEQ ID NO: 294853 - DNA, 503 bp, Homo sapiens
  misc_feature: GYAE6OF02GBWQA.37.77.G11.1.454.CMB.1.raw
  modified_base (474)..(474): a, c, t, g, unknown or other
  misc_feature (474)..(474): n is a, c, g, or t
  modified_base (478)..(503): a, c, t, g, unknown or other
  misc_feature (478)..(503): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattattgtgcgaaatgtggggggagtgggggctactcctggcgtttttgactacgtggggccagggagccctggtcaccgtctcctcagcctccaccgaagggccccagtccggtccttcccccgtgggccgccctggcctcccgaggtacgccacctccgagacgccacgacgccggccctggggcctcggccttgggtacaaagggtaccttaccgttccaattccgtacactactggacgcgggctgggccaagggccgcagtagnacgnnnnnnnnnnnnnnnnnnnnnnnnnn

SEQ ID NO: 294854 - DNA, 442 bp, Homo sapiens
  misc_feature: GYAE6OF02IIG6M.37.77.G11.1.454.CMB.1.raw
  modified_base (352)..(352): a, c, t, g, unknown or other
  misc_feature (352)..(352): n is a, c, g, or t
  modified_base (438)..(438): a, c, t, g, unknown or other
  misc_feature (438)..(438): n is a, c, g, or t
  modified_base (440)..(442): a, c, t, g, unknown or other
  misc_feature (440)..(442): n is a, c, g, or t
tcagtagtgtagatcacgaccggtgctcgatttagctagtcactcaaggggaaaggggctggagtggggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtacttttgacgactggggccagggaaccctggtcaccgtctcctcagcctccaccaagggcccatcggtcttccccctggcgccctgctccaggngcacctccgagagcacagcggccctgggctgcctggtcaagggactacttccatctacactactgagcgggctggcaaggcgtcangnnn

SEQ ID NO: 294855 - DNA, 606 bp, Homo sapiens
  misc_feature: GYAE6OF02IAM0A.37.77.G11.1.454.CMB.1.raw
  modified_base (367)..(367): a, c, t, g, unknown or other
  misc_feature (367)..(367): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (580)..(581): a, c, t, g, unknown or other
  misc_feature (580)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (591)..(592): a, c, t, g, unknown or other
  misc_feature (591)..(592): n is a, c, g, or t
  modified_base (594)..(603): a, c, t, g, unknown or other
  misc_feature (594)..(603): n is a, c, g, or t
  modified_base (605)..(606): a, c, t, g, unknown or other
  misc_feature (605)..(606): n is a, c, g, or t
tcagtagtgtagatcacgaccggtgctcgattttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttaatatttactgtgtggaagggacctctacgtccccttatacgcaggcggctggtcctggttactttgacgacgtgggccagggaaccctggtccaccgtcctcctcgacgtcctcccgaaccgaacggccccacgtccggttcccgtttcccccgtcggtccncccgtcgcctccgaggcgccgaccgtaccgagacgccacgaccggccggtccgcggtcgtcgccgtcgggtacgtaaacggtacccgttaccttaccgtaccttaccttaaccgtaaccgttaacgtacggtacggtcccggggtaccgtcgggggtaaccgaaccgggggccctaacggtaacgtaacggngngcncgcgcacgagngngcnncngngnncgnnannnnnnnnnnann

SEQ ID NO: 294856 - DNA, 513 bp, Homo sapiens
  misc_feature: GYAE6OF02G7ELX.37.77.G11.1.454.CMB.1.raw
  modified_base (481)..(481): a, c, t, g, unknown or other
  misc_feature (481)..(481): n is a, c, g, or t
  modified_base (483)..(488): a, c, t, g, unknown or other
  misc_feature (483)..(488): n is a, c, g, or t
  modified_base (490)..(498): a, c, t, g, unknown or other
  misc_feature (490)..(498): n is a, c, g, or t
  modified_base (500)..(513): a, c, t, g, unknown or other
  misc_feature (500)..(513): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaggcccatccggtcctccccctggccgccctgctccgaggacgcacctccgagacgcaccagccggacccgtgggcctgcccgtggtacgaacggactaccttccgattccgtaacacctactggacggaccggggcgttagggacctaaacgggccgacaagtaacggacnannnnnnannnnnnnnngnnnnnnnnnnnnnn

SEQ ID NO: 294857 - DNA, 615 bp, Homo sapiens
  misc_feature: GYAE6OF02JFRUG.37.77.G11.1.454.CMB.1.raw
  modified_base (577)..(577): a, c, t, g, unknown or other
  misc_feature (577)..(577): n is a, c, g, or t
  modified_base (579)..(580): a, c, t, g, unknown or other
  misc_feature (579)..(580): n is a, c, g, or t
  modified_base (585)..(585): a, c, t, g, unknown or other
  misc_feature (585)..(585): n is a, c, g, or t
  modified_base (587)..(588): a, c, t, g, unknown or other
  misc_feature (587)..(588): n is a, c, g, or t
  modified_base (593)..(594): a, c, t, g, unknown or other
  misc_feature (593)..(594): n is a, c, g, or t
  modified_base (596)..(596): a, c, t, g, unknown or other
  misc_feature (596)..(596): n is a, c, g, or t
  modified_base (601)..(604): a, c, t, g, unknown or other
  misc_feature (601)..(604): n is a, c, g, or t
  modified_base (606)..(615): a, c, t, g, unknown or other
  misc_feature (606)..(615): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatagaacagcctgagagtcgaggacgacggtcttatattactgtgtagaggacctctacgtcccttagtacgacagcggcgtggtccgtgttacgttgacgacgtcgggacgacgggaaccgtcggtacacccgttctcctcacgcctacccaccgaacggcccacgtccggttacccttcccccgtcggcccgtcccgtcgtcctccggacggtaaccgccgtacctccggaacggacgaccgaccgacgggcccggtacccggttcgggaccgttcgtcccggttacgggtaccggaaacgggttaccgttaaccgtttacccgacgtttaccttaacccgaaccgtttacgtacggacggcgggtacgcgggtacgaaccgggctaccggagacgtacagtncnngcagncnncgagnngncgagnnnncnnnnnnnnnn

SEQ ID NO: 294858 - DNA, 428 bp, Homo sapiens
  misc_feature: GYAE6OF02JBC41.37.77.G11.1.454.CMB.1.raw
  modified_base (412)..(428): a, c, t, g, unknown or other
  misc_feature (412)..(428): n is a, c, g, or t
tcagtagtgtagatcacgaccggtgctcgatttagctagtcactcaagggaaagggactggagtgggtctcagctattaatgggaatggtgataccacatactacgcagactccgtgaagggccggttcaccatctccagggacaattccaagaacacactgtctctgcaaatgaacagcctgagagccgaggacacggctgtgtattactgtgcgagagccctcacctcagcagcagcggtgacttctgggccaggaacccctggtcaccgtctcctcacgcctccacccaagggcccatcggtccttcccctggccaccctcctccaacgagcacctctggggcacagcgcctggctgcctggtcaagactactccatctacactactgagcgggctggcaagcgcatgnnnnnnnnnnnnnnnnn

SEQ ID NO: 294859 - DNA, 545 bp, Homo sapiens
  misc_feature: GYAE6OF02JVN2A.37.77.G11.1.454.CMB.1.raw
  modified_base (518)..(545): a, c, t, g, unknown or other
  misc_feature (518)..(545): n is a, c, g, or t
tcagtagtgtagatcacgaccggtgctcgatttagctagtcactcaagggaaaggggctggagtgggtctcagctattaatgggaatggtgataccacatactacgcagactccgtgaaggggccggttcaccatctccagggacaattccaagaacacactgtctctgcaaatgaacagcctgagagtcgaggacacggccttatattactgtgtgaagggacctctacgcccccttatagcagcggcgtggtcctggtactttgacgacgtggggccgagggaccctggtcgaccgtctcctcacgccctccaccgaacgggcccacgtccggttccttcccccgtcggcccgcccctcgcctcccgaggacgccgaccctccgagacgcacgacggcccggccgtcgggctcgcccgtcggtcgaacggtcctaccgttccacgttaccctaacctacgtaccgtgggaccggtccgggcgtcgggaccgaacgggtccgacgttaagtacggcnnnnnnnnnnnnnnnnnnnnnnnnnnnn

SEQ ID NO: 294860 - DNA, 470 bp, Homo sapiens
  misc_feature: GYAE6OF02HNZED.37.77.G11.1.454.CMB.1.raw
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
  modified_base (461)..(470): a, c, t, g, unknown or other
  misc_feature (461)..(470): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattacngtgtgaagggacctctagccccttatagcagcggctggtcctggtactttgccgatggggccagggaaccctggtcaccgtctcctnagccctccaccgaacggcccatccggtccttcccccgnggccnccctgcctccgaggacgccacctccgagacgcacgagccggccgtgggctcgcccgtggtacaagggacctactcccgataccacactaactgacggcggctggacgaaggcgcatacgnnnnnnnnnn

SEQ ID NO: 294861 - DNA, 694 bp, Homo sapiens
  misc_feature: GYAE6OF02H4S1O.37.77.G11.1.454.CMB.1.raw
  modified_base (222)..(222): a, c, t, g, unknown or other
  misc_feature (222)..(222): n is a, c, g, or t
  modified_base (254)..(254): a, c, t, g, unknown or other
  misc_feature (254)..(254): n is a, c, g, or t
  modified_base (323)..(323): a, c, t, g, unknown or other
  misc_feature (323)..(323): n is a, c, g, or t
  modified_base (656)..(656): a, c, t, g, unknown or other
  misc_feature (656)..(656): n is a, c, g, or t
  modified_base (662)..(662): a, c, t, g, unknown or other
  misc_feature (662)..(662): n is a, c, g, or t
  modified_base (664)..(694): a, c, t, g, unknown or other
  misc_feature (664)..(694): n is a, c, g, or t
tcagtagtgtagatcacgaccggtgctcgatttagctagtcactcaagggaaaggggctggagtgggtggccaacataaagcaagatggaagtaagaaggagtatgtggactctgtgaagggtccgtttcaccatctccagtagacaacgccaagaacctccgtgcatctgactaaatgaaactgtctagagacgccgaggtacaccggtatatttattacngcgcgtaagagagggactggggtccggtttanaactacggtcgggggaccaaggggtaaccccctgggtacccgtacccggttaccgttccgttccgaacncccgttaccccaacccggtaaacgggcccctaaacgttcccgggttaccctttacccccgtccgggtaccccggtccctttccggacccgttaccccgaacgggaccgcccctacccggtacccggtaacggaaccgacgaacccgacggcccgggtaccccgtcgggggtacctccggtacccgggttacgggtaaccgtaaccgggaacccgttttaccgtaacccgtacgttacccttaaacccggtacctttaaaccgtggtaaacccgggtccggggtacgttacccggggaggtaaaccgggtcccacgtacgtaacgctagccgancacgtncnnnnnnnnnnnnnnnnnnnnnnnnnnnnnnn

SEQ ID NO: 294862 - DNA, 543 bp, Homo sapiens
  misc_feature: GYAE6OF02FT5NQ.37.77.G11.1.454.CMB.1.raw
  modified_base (303)..(303): a, c, t, g, unknown or other
  misc_feature (303)..(303): n is a, c, g, or t
  modified_base (513)..(513): a, c, t, g, unknown or other
  misc_feature (513)..(513): n is a, c, g, or t
  modified_base (515)..(543): a, c, t, g, unknown or other
  misc_feature (515)..(543): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagagacaattccaagaacaccctgtctctgcaaatgaacaacctgagagccgaggacacggccctatattactgtaacgaaaatggcctaggatatgactactattgggactggtacttcgatctcgtggggccgtggccacccgtggtcacgtgtctcctcacnccctcccaccgacgggccctagtccggttcccttcccccgtcggcccgtcccctcgcctccgagggacgccaacccgtccgagacgccaacgcggcccggcccgtgggcgtcgccgtgggtacgaacggtaccttacctttccacttacctacctacgtaccgtggacgggcgggtccgtagggacccgaagggccagtacgtaggactnannnnnnnnnnnnnnnnnnnnnnnnnnnnn

SEQ ID NO: 294863 - DNA, 509 bp, Homo sapiens
  misc_feature: GYAE6OF02FPJ9V.37.77.G11.1.454.CMB.1.raw
  modified_base (442)..(442): a, c, t, g, unknown or other
  misc_feature (442)..(442): n is a, c, g, or t
  modified_base (477)..(477): a, c, t, g, unknown or other
  misc_feature (477)..(477): n is a, c, g, or t
  modified_base (480)..(481): a, c, t, g, unknown or other
  misc_feature (480)..(481): n is a, c, g, or t
  modified_base (483)..(509): a, c, t, g, unknown or other
  misc_feature (483)..(509): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctcccagggacaattccaagaacacactgtctctgcaaatgaacagcctgagagtcgaggacacggccttatattactgtgtgaagggacctctagcccccttatagcagcggctggtctggtactttgacgactggggccagggaaccctggtcaccgtctcctcagcctccaccgaacggcccatccggtccttcccccgtggcccgccctgcctccgaggacgccaccgtccgagacgcacacgccggcccgtgggcctggcccgtggtccgaagggtaccttacttccatctaaccacgttacnggacgccgggtctcggacgaaggccgctacgtagnacnncnnnnnnnnnnnnnnnnnnnnnnnnnnn

SEQ ID NO: 294864 - DNA, 529 bp, Homo sapiens
  misc_feature: GYAE6OF02JK76I.37.77.G11.1.454.CMB.1.raw
  modified_base (361)..(361): a, c, t, g, unknown or other
  misc_feature (361)..(361): n is a, c, g, or t
  modified_base (502)..(529): a, c, t, g, unknown or other
  misc_feature (502)..(529): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaaacacactgtctctgacaaatgaacagcctgagagtacgaggacacggccttatattacgtgtgtagaagggacctctacgccccttatacgcagcggtctaggtcctggtactttgacgacgtgggggaccagggaaccctgggtccacccggttctccgtcacgccctcccaccgaaggtccccatccggtcctccccctggccnccctcgactccgaggcgccaccgtccgagacgaccacgtacggccggtacccgtcggggctcgacccgtcggtactaacgggaccttaccgtccactcctaacgacctatcgaggtcgcgtacgcgaaggtcactagagcnnnnnnnnnnnnnnnnnnnnnnnnnnnn

SEQ ID NO: 294865 - DNA, 590 bp, Homo sapiens
  misc_feature: GYAE6OF02HSRBC.37.77.G11.1.454.CMB.1.raw
  modified_base (544)..(544): a, c, t, g, unknown or other
  misc_feature (544)..(544): n is a, c, g, or t
  modified_base (548)..(549): a, c, t, g, unknown or other
  misc_feature (548)..(549): n is a, c, g, or t
  modified_base (551)..(551): a, c, t, g, unknown or other
  misc_feature (551)..(551): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (564)..(564): a, c, t, g, unknown or other
  misc_feature (564)..(564): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (574)..(576): a, c, t, g, unknown or other
  misc_feature (574)..(576): n is a, c, g, or t
  modified_base (578)..(581): a, c, t, g, unknown or other
  misc_feature (578)..(581): n is a, c, g, or t
  modified_base (584)..(586): a, c, t, g, unknown or other
  misc_feature (584)..(586): n is a, c, g, or t
  modified_base (588)..(590): a, c, t, g, unknown or other
  misc_feature (588)..(590): n is a, c, g, or t
tcagtagtgtagatcacgaccggtgctcgatttagctagtcactcaagggaaaggggctggagtgggtctcagctattaaatgggaatggtgataccacatactacgcagactccgtgaagggccggttcaccatctccagggacaattccaagaacacactgtctctgacaaatgaacagcctgagagtcgaggacacggtccttatattactgtgtgaagggtcctctacgtcccttatagcaggcggctggtccgtggttactttgaacgcgtgggccgagggtacctgtccaccgtctcctcacgccctcccacgaaccggccacgttccggttcccctttcccccgcggccctcccgtcgcctaccgtaacggcgacccgtacccgtaccggacgtaacgccgacgacggccgggtcccgcgggctcggtcccgtaggtaccgtaacgggtccttaacccgttaccacttcccttaacactttacgtcggacgggccgggtcggtccgggtacgaacgggcgtacgaataacggcagcncgannancancnncncncgngancncncgnnngnnnntcnnncnnn

SEQ ID NO: 294866 - DNA, 709 bp, Homo sapiens
  misc_feature: GYAE6OF02JO4ML.37.77.G11.1.454.CMB.1.raw
  modified_base (451)..(451): a, c, t, g, unknown or other
  misc_feature (451)..(451): n is a, c, g, or t
  modified_base (677)..(677): a, c, t, g, unknown or other
  misc_feature (677)..(677): n is a, c, g, or t
  modified_base (681)..(681): a, c, t, g, unknown or other
  misc_feature (681)..(681): n is a, c, g, or t
  modified_base (683)..(684): a, c, t, g, unknown or other
  misc_feature (683)..(684): n is a, c, g, or t
  modified_base (686)..(689): a, c, t, g, unknown or other
  misc_feature (686)..(689): n is a, c, g, or t
  modified_base (691)..(699): a, c, t, g, unknown or other
  misc_feature (691)..(699): n is a, c, g, or t
  modified_base (701)..(702): a, c, t, g, unknown or other
  misc_feature (701)..(702): n is a, c, g, or t
  modified_base (704)..(706): a, c, t, g, unknown or other
  misc_feature (704)..(706): n is a, c, g, or t
  modified_base (708)..(709): a, c, t, g, unknown or other
  misc_feature (708)..(709): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctcccagggacaattccaagaacacactgtctctgcaaatgaacagcctgacgagtcgaggacacggccttatatttactgtcgttaggaacgggaccttctagtccccctttatacgtcaggccgcgtcggtccgtcggttactttcggaaccgtaacggttcggggtacccgacggggtaaacccccttggtacccgacccggttaccttccgtccgacgccccttccggtaacccaacggggcccctaacgttcccgggttacccctttcccccggtggaccccgtccccgtctcccgtcccggaacggtaccncccgtaaccctccggtacgaccggaccaaccaccgggcccgggtacccctgggggtcccttaccggacccgttccgggtaacgaaaacccgggtacccgtttaccgtttaccctaacggttccctaaacccgtaccgttacgtacgggtaacccgggcgggtaaccgtacccgggtccgtaaacggggtccctaacgtaacggtaacctgcgcaggttcagctacntacncnncnnnncnnnnnnnnncnncnnngnn

SEQ ID NO: 294867 - DNA, 541 bp, Homo sapiens
  misc_feature: GYAE6OF02JKVLZ.37.77.G11.1.454.CMB.1.raw
  modified_base (226)..(226): a, c, t, g, unknown or other
  misc_feature (226)..(226): n is a, c, g, or t
  modified_base (300)..(300): a, c, t, g, unknown or other
  misc_feature (300)..(300): n is a, c, g, or t
  modified_base (337)..(337): a, c, t, g, unknown or other
  misc_feature (337)..(337): n is a, c, g, or t
  modified_base (508)..(508): a, c, t, g, unknown or other
  misc_feature (508)..(508): n is a, c, g, or t
  modified_base (512)..(512): a, c, t, g, unknown or other
  misc_feature (512)..(512): n is a, c, g, or t
  modified_base (516)..(516): a, c, t, g, unknown or other
  misc_feature (516)..(516): n is a, c, g, or t
  modified_base (518)..(541): a, c, t, g, unknown or other
  misc_feature (518)..(541): n is a, c, g, or t
tcagtagtgtagatcacgaccggtgctcgatttagctagtcactcaagggaaaggggctggagtgggcctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctntacgccccttatagcagcggctggtcctggtactttgacgactggggccagggaccctggccaccgtctcctcngcctccaccgaggcccatcggtcctccccgtaggccncccgtgctccaggacgccaccctcggacgtacgccacacggcccggtacccgtcgggcctcgcccgttgggtaccgtaaacgggaccttaacgtttcccaacgttcctacgaacccttacgtagtacgggccgggtacgtacgggacgaacgggtccgacgtacgtagctncgtnacgnannnnnnnnnnnnnnnnnnnnnnnn

SEQ ID NO: 294868 - DNA, 474 bp, Homo sapiens
  misc_feature: GYAE6OF02FFSMG.37.77.G11.1.454.CMB.1.raw
  modified_base (119)..(119): a, c, t, g, unknown or other
  misc_feature (119)..(119): n is a, c, g, or t
  modified_base (340)..(340): a, c, t, g, unknown or other
  misc_feature (340)..(340): n is a, c, g, or t
  modified_base (365)..(365): a, c, t, g, unknown or other
  misc_feature (365)..(365): n is a, c, g, or t
  modified_base (430)..(430): a, c, t, g, unknown or other
  misc_feature (430)..(430): n is a, c, g, or t
  modified_base (441)..(441): a, c, t, g, unknown or other
  misc_feature (441)..(441): n is a, c, g, or t
  modified_base (446)..(446): a, c, t, g, unknown or other
  misc_feature (446)..(446): n is a, c, g, or t
  modified_base (448)..(449): a, c, t, g, unknown or other
  misc_feature (448)..(449): n is a, c, g, or t
  modified_base (452)..(455): a, c, t, g, unknown or other
  misc_feature (452)..(455): n is a, c, g, or t
  modified_base (457)..(474): a, c, t, g, unknown or other
  misc_feature (457)..(474): n is a, c, g, or t
tcagtagtgtagatcacgaccggtgctcgatttagctagtcactcaagggaaagggggctggagtgggtctcagctatttaatgggaatggtgataccacatactacgcagactccgtnaagggccggttcaccatctccagggacaattccaagaacacactgtctctgcaaatgaacagcctgagagtcgaggacacggccttatattactgtgtgaagggcctctagcccccttatagcagcgctggtcctggtacttttgacgactggggccagggaaccccttggtcaccgtctcctcagccctccaccaaggcccagtcgtctccccctggccnccctgctccagagcaccttccgagngcacagccggcccgtgggctgccgtggtacaacggtactacttccatctacactactgagcggcnggcgaaggcgnagtgncnngtnnnncnnnnnnnnnnnnnnnnnn

SEQ ID NO: 294869 - DNA, 623 bp, Homo sapiens
  misc_feature: GYAE6OF02HAM45.37.77.G11.1.454.CMB.1.raw
  modified_base (562)..(562): a, c, t, g, unknown or other
  misc_feature (562)..(562): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
  modified_base (576)..(576): a, c, t, g, unknown or other
  misc_feature (576)..(576): n is a, c, g, or t
  modified_base (598)..(598): a, c, t, g, unknown or other
  misc_feature (598)..(598): n is a, c, g, or t
  modified_base (614)..(614): a, c, t, g, unknown or other
  misc_feature (614)..(614): n is a, c, g, or t
  modified_base (622)..(622): a, c, t, g, unknown or other
  misc_feature (622)..(622): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggttactttgacgactggggccagggaaccctggtccaccgtctcctcacgcctacccaccgaacgggaccccagtccggttccttcccccgtggccgtccccgtgcctccgaggacgcctaccgtccgacggacgcgaccgaacggcccgggtacccgtggggaccttcggcccggtagggttacccgaaaacggggttaccctaaccgtttaccccgaacttacccgtaaaccgtacctaaacgttcggaacggtccggggacgtacggggaccgaacgggtcccgacgtaactaacgggcaggaancancgtagtanacncacacacgacgctacacacagngagcgacatagacacnatacacgna

SEQ ID NO: 294870 - DNA, 492 bp, Homo sapiens
  misc_feature: GYAE6OF02IQXTG.37.77.G11.1.454.CMB.1.raw
  modified_base (469)..(492): a, c, t, g, unknown or other
  misc_feature (469)..(492): n is a, c, g, or t
tcagtagtgtagatcacgaccggtgctcgatttagctagtcactcaagggaaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtccaccgtctcctcacgccctccaccgaacgggcccagtccggttccttccccctggccctacccctccctaccaacgacgccaccgtcggtcgggggcaacgcggcccggccgtgggcctcgccgtcggtacgaaggacttaccttccatcctacacctacgtcgacggcggtcgtaggacgacggcacgatacgnnnnnnnnnnnnnnnnnnnnnnnn

SEQ ID NO: 294871 - DNA, 547 bp, Homo sapiens
  misc_feature: GYAE6OF02F13YI.37.77.G11.1.454.CMB.1.raw
  modified_base (506)..(506): a, c, t, g, unknown or other
  misc_feature (506)..(506): n is a, c, g, or t
  modified_base (511)..(512): a, c, t, g, unknown or other
  misc_feature (511)..(512): n is a, c, g, or t
  modified_base (514)..(514): a, c, t, g, unknown or other
  misc_feature (514)..(514): n is a, c, g, or t
  modified_base (516)..(516): a, c, t, g, unknown or other
  misc_feature (516)..(516): n is a, c, g, or t
  modified_base (518)..(529): a, c, t, g, unknown or other
  misc_feature (518)..(529): n is a, c, g, or t
  modified_base (531)..(532): a, c, t, g, unknown or other
  misc_feature (531)..(532): n is a, c, g, or t
  modified_base (534)..(547): a, c, t, g, unknown or other
  misc_feature (534)..(547): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggactctacgccccttatagcagcggctggtcctggttacttggacgacgtcgggaccgacgggtaacctcggtcctaccgtcctcctacacgtccctaccgaaccggaacggccctacgtcccggttcccgtccccgtcggtcccgccgtcgtccgtaccgaggacgccaccgaccggacgacgacacgacggccggccgtcggctcgtctacggtaacgaacggtaccttactaccaactacctaacactacgtcggacggcggacgtacggacgaggtccganagtcnncnanannnnnnnnnnnncnngnnnnnnnnnnnnnn

SEQ ID NO: 294872 - DNA, 730 bp, Homo sapiens
  misc_feature: GYAE6OF02JJUMX.37.77.G11.1.454.CMB.1.raw
  modified_base (704)..(704): a, c, t, g, unknown or other
  misc_feature (704)..(704): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagccctgagagtcgaggacgacggccttaatattactgtgtgaaggacctctacgtccccttatacgcagcggctggtcctggtactttgacgacgtggggccgacggaacctggtccaccggtcctccgtctacgccctcccgacctaacgggacccgacgttccggtccttccccccgtagggtccccggtacccctcggtcctcccgtacggacggtaccacccgtccgaacggacggaccaaccgtacgggacccgggccccggttcgggggtcctaccggtcccgttaccggggtaccgtaaaaccgggtacccgtttaaccctttacccggtaacttacccgtttaaacccggaaccctttaaaccggttagggaccgggtacccgggggtaccgttacggggacccggaaacgggggtcccgtaaccgttaacgttaaaccggacgtacgtacgtcgcgacgtacgtcgtacgagacgtacgacgtagtacgcgacgacgtacgctcgtacgcgtacgngacgtcgaccacgacgtacgagtacg

SEQ ID NO: 294873 - DNA, 463 bp, Homo sapiens
  misc_feature: GYAE6OF02F0BE4.37.77.G11.1.454.CMB.1.raw
  modified_base (441)..(463): a, c, t, g, unknown or other
  misc_feature (441)..(463): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaacgggcccatccggtcttccccctggcgccctgctccaggagcacctccgagagcacagcggccctgggctgcctggtcaaggactacttccatctacactactgagcgggctgggcaagggcgcatacgnnnnnnnnnnnnnnnnnnnnnnn

SEQ ID NO: 294874 - DNA, 545 bp, Homo sapiens
  misc_feature: GYAE6OF02GOG1I.37.77.G11.1.454.CMB.1.raw
  modified_base (504)..(505): a, c, t, g, unknown or other
  misc_feature (504)..(505): n is a, c, g, or t
  modified_base (508)..(512): a, c, t, g, unknown or other
  misc_feature (508)..(512): n is a, c, g, or t
  modified_base (515)..(515): a, c, t, g, unknown or other
  misc_feature (515)..(515): n is a, c, g, or t
  modified_base (518)..(519): a, c, t, g, unknown or other
  misc_feature (518)..(519): n is a, c, g, or t
  modified_base (521)..(524): a, c, t, g, unknown or other
  misc_feature (521)..(524): n is a, c, g, or t
  modified_base (528)..(530): a, c, t, g, unknown or other
  misc_feature (528)..(530): n is a, c, g, or t
  modified_base (532)..(533): a, c, t, g, unknown or other
  misc_feature (532)..(533): n is a, c, g, or t
  modified_base (535)..(545): a, c, t, g, unknown or other
  misc_feature (535)..(545): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctggtcctggtactttgacgacgtgggccagggaaccctggtcaccgtctcctcagcctccaccgaacgggccctatccggttccttacccccgtggcccaccccgtcctaccaacggacgccaccgtcgtcggggaccacgacgccggcccgtcgggctcgccgtggtaccaagggtacctaccttaccgacttacctacaccttacgtcggacggccgggtcgtacgggaccgtaacgggccgaccgtagtagcgnngcnnnnncgnagnngnnnngcgnnncnncnnnnnnnnnnn

SEQ ID NO: 294875 - DNA, 501 bp, Homo sapiens
  misc_feature: GYAE6OF02GJSPB.37.77.G11.1.454.CMB.1.raw
  modified_base (299)..(299): a, c, t, g, unknown or other
  misc_feature (299)..(299): n is a, c, g, or t
  modified_base (470)..(470): a, c, t, g, unknown or other
  misc_feature (470)..(470): n is a, c, g, or t
  modified_base (472)..(501): a, c, t, g, unknown or other
  misc_feature (472)..(501): n is a, c, g, or t
tcagtagtgtagatcacgaccggtgctcgatttagctagtcactcaagggaaagggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattaactgtgtgaagggacctctagcccccttatagcagcggctggtcctggtactttgacgactgggggccagggaacccctggtcaccgtntcctcagcctccaccaagggcccatccggtctccccctggccgccctgcctccaggacgcaccctccggagagccacaggccgcccgtgggctgcctggtaccaacgggacttacttccataccgtaacactacctagcgacgggctagggcaaacgggcgaccaagtagntnnnnnnnnnnnnnnnnnnnnnnnnnnnnnn

SEQ ID NO: 294876 - DNA, 556 bp, Homo sapiens
  misc_feature: GYAE6OF02J2WZZ.37.77.G11.1.454.CMB.1.raw
  modified_base (259)..(259): a, c, t, g, unknown or other
  misc_feature (259)..(259): n is a, c, g, or t
  modified_base (447)..(447): a, c, t, g, unknown or other
  misc_feature (447)..(447): n is a, c, g, or t
  modified_base (477)..(477): a, c, t, g, unknown or other
  misc_feature (477)..(477): n is a, c, g, or t
  modified_base (485)..(485): a, c, t, g, unknown or other
  misc_feature (485)..(485): n is a, c, g, or t
  modified_base (519)..(519): a, c, t, g, unknown or other
  misc_feature (519)..(519): n is a, c, g, or t
  modified_base (521)..(522): a, c, t, g, unknown or other
  misc_feature (521)..(522): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (532)..(556): a, c, t, g, unknown or other
  misc_feature (532)..(556): n is a, c, g, or t
tcagtagtgtagatcacgaccggtgctcgatttagctagtcactcaagggaaaggggctggagtgggtctcagctattaatgggaatggtgataccacatactacgcagactccgtgaacggccgttcaccatctaccgaggactaagttccaagaaccactactgtcactagacaatcgaacacgcctgagcgtacgacggtacaccggtctttaagcttacgtacgtggagtaaccggcttctacggtccccttaanacggcacggtcggtcttacgggtccttaggttactacgacgcggacggaccgtacgtaccgtcgacctaccgtcaccgtaccgacgtcccaccgacgtaccgtccacgtccggtccctccccgtcgccctccgtcaccgtccgacgtccaccgtaccacgagaccgccgacgtccggccggctcggcncgtccgtacgacgtacgacctacgtctacncgttaccnctacgacgcgcggtacgtacgacgtacgcgtcancnnancnnatcgnnnnnnnnnnnnnnnnnnnnnnnnn

SEQ ID NO: 294877 - DNA, 856 bp, Homo sapiens
  misc_feature: GYAE6OF02H02GS.37.77.G11.1.454.CMB.1.raw
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtagaagggtacctactacgtaccccttatagccgaggacggtctcggtccgtggtacttttggaccggtacgttcggggaccaggggtaacccctggtaccaacccggttctcccgttacacggtcccctacccgaacccggaacggggtccccctaaggttccccggggttcccctttacccccccggtcggggtaccccgttccccgttccggtaccgttaccccggaagggtacccggtacccgtacccggtacccggtaaggaccggtaccaaccggtacggtaccccggggtccccggtcggggtaacccttaccggtcccgtttacggggttacccggaaaaccggggttaacccgtttaacccgtttaacccggtaacctttaaccccggtaaaccgtttaaccgttacccggttaccgggtaaacgggtccgggggttaccgtaccggggggtaccgtaaaccgggttacccgggaaccttaacgggtaccgttacggaactaaccggtagaaccggtcaaggaccctccggaaggtacctacgggttacaccggttagacggttacaccggttccgaaccgacggtacgtccgtacgtcggtacgtacgtacgtaacgtactacgtacgtacg

SEQ ID NO: 294878 - DNA, 660 bp, Homo sapiens
  misc_feature: GYAE6OF02I5PRP.37.77.G11.1.454.CMB.1.raw
  modified_base (590)..(590): a, c, t, g, unknown or other
  misc_feature (590)..(590): n is a, c, g, or t
  modified_base (599)..(600): a, c, t, g, unknown or other
  misc_feature (599)..(600): n is a, c, g, or t
  modified_base (612)..(612): a, c, t, g, unknown or other
  misc_feature (612)..(612): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacgccttatattactgtgtagaagggacctctacgccccttatacgcagcggctggtcctgtactttgacgacgtcggggccacgggaaccctggtaccaccgtctcctcacgccctaccaccgaacgggcccctagtccggtccctttacccccgtcggcccgtcccgtcgccgttaccgaaggacgccacccgttaccgaggaacgcctaacgaccggcccgggacccgtcgggaccgttcggtccccgttacgggtaccgtaaaacgggtaaccttaacccggtttaccctaacgtttccttaaacccgtaacccttaacggttacggtaacgggtacccggggtacgttaccggggacctaaaccggggccgtaaccaagttacgacgtancgcgacatnncacgacgacagngtacgtagtacgacgacgtcacagagacgagacacgagacacancgtn

SEQ ID NO: 294879 - DNA, 693 bp, Homo sapiens
  misc_feature: GYAE6OF02F249K.37.77.G11.1.454.CMB.1.raw
  modified_base (237)..(237): a, c, t, g, unknown or other
  misc_feature (237)..(237): n is a, c, g, or t
  modified_base (364)..(364): a, c, t, g, unknown or other
  misc_feature (364)..(364): n is a, c, g, or t
  modified_base (379)..(379): a, c, t, g, unknown or other
  misc_feature (379)..(379): n is a, c, g, or t
  modified_base (609)..(609): a, c, t, g, unknown or other
  misc_feature (609)..(609): n is a, c, g, or t
  modified_base (615)..(615): a, c, t, g, unknown or other
  misc_feature (615)..(615): n is a, c, g, or t
  modified_base (632)..(632): a, c, t, g, unknown or other
  misc_feature (632)..(632): n is a, c, g, or t
  modified_base (653)..(653): a, c, t, g, unknown or other
  misc_feature (653)..(653): n is a, c, g, or t
  modified_base (691)..(691): a, c, t, g, unknown or other
  misc_feature (691)..(691): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaatagaacagcctgagagtcgaggacacggccttatattactgtgtgaagggacctctacgcccttanagcagcggcgtggtcctggttactttgacgaccgtggggccaggaacccgtggtcgaccgttctctcacgccctaccacgaacgggcccacgtccgtcccttccccgtacggccgtcccctcgtccnccgtacggggtaacncccgtaacccgtccgaacggtcgaccacccgaacgggccccggggtccccgtcgggggaccgtttacgggccccgttacgggggttacccgtaaacgggtaaccccgtttaccggtttaccccctaagtttaccccttaacctaaccccgtttaaaccggtcggtaaacccggttcccggggggtattccgggggaccgtaaacgggccgtaccgtaaggtaacggtacncgtacncgcgtcgcgcgcgcacncgcgcgacgcgcgtcgacgcncgtacggtacgtcgtcgtacgtcgacgtatcgtcgacncg

SEQ ID NO: 294880 - DNA, 512 bp, Homo sapiens
  misc_feature: GYAE6OF02FGCYB.37.77.G11.1.454.CMB.1.raw
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (480)..(481): a, c, t, g, unknown or other
  misc_feature (480)..(481): n is a, c, g, or t
  modified_base (485)..(485): a, c, t, g, unknown or other
  misc_feature (485)..(485): n is a, c, g, or t
  modified_base (487)..(512): a, c, t, g, unknown or other
  misc_feature (487)..(512): n is a, c, g, or t
tcagtagtgtagatcacgaccggtgctcgatttagctagtcactcaagggaaaggggctggagtgggtctcagctattaatgggaatggtgataccacatactacgcagactccgtgaaggggccggttcaccatctccagggacaattccaagaacacactgtctctgcaaatgaacagcctgagagtcgaggacacggccttatattactgtgtgaacgggacctctagcccccttatacgcagcggctggtcctggtactttgacgacgtggggccagggaaccccttggtcacccgtctcctcacgccctccaccaaggccctatccgtccttccccctggccnccctgcctccgagganccaccctcgagacgcaccacggccgccccgtgggcctcggccctgggaccaacgggcctaccgttccatcctacactacgtgaacggccgggctgggactacgggcgcctaatagnncgancnnnnnnnnnnnnnnnnnnnnnnnnnn

SEQ ID NO: 294881 - DNA, 466 bp, Homo sapiens
  misc_feature: GYAE6OF02FG9DC.37.77.G11.1.454.CMB.1.raw
  modified_base (358)..(358): a, c, t, g, unknown or other
  misc_feature (358)..(358): n is a, c, g, or t
  modified_base (448)..(448): a, c, t, g, unknown or other
  misc_feature (448)..(448): n is a, c, g, or t
  modified_base (454)..(466): a, c, t, g, unknown or other
  misc_feature (454)..(466): n is a, c, g, or t
tcagtagtgtagatcacgaccggtgctcgatttagctagtcactcaagggaaagggtctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaaccctggtcaccgtctcctcacgcctccaccaaggcccatccggtccttccccctggccgccctgcctaccagggacnccaccctccgagacgccacgagccggccctgggctggcctgggtacaacggctacttccatcctacactactgagcgggctggcaaggcncatagnnnnnnnnnnnnn

SEQ ID NO: 294882 - DNA, 519 bp, Homo sapiens
  misc_feature: GYAE6OF02GIMIW.37.77.G11.1.454.CMB.1.raw
  modified_base (361)..(361): a, c, t, g, unknown or other
  misc_feature (361)..(361): n is a, c, g, or t
  modified_base (489)..(519): a, c, t, g, unknown or other
  misc_feature (489)..(519): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatatactgtgtgaagggacctctagccccttatagcagcggctggtcctggtactttgacgactggggccagggaaccctggtcaccgtctctcagcctaccaccgaagggcccatccggtccttccccctcggcgcccctgccttccaacgggtacncgaacccgtccggaagacgacacgacggcggccctggggacctgccctgggtacaacgggtactaaccttccgaatcctaaacaccgtactagacgacgggtctacggcaacggcgcaacgttaacgnnnnnnnnnnnnnnnnnnnnnnnnnnnnnnn

SEQ ID NO: 294883 - DNA, 643 bp, Homo sapiens
  misc_feature: GYAE6OF02JXLNM.37.77.G11.1.454.CMB.1.raw
  modified_base (330)..(330): a, c, t, g, unknown or other
  misc_feature (330)..(330): n is a, c, g, or t
  modified_base (600)..(600): a, c, t, g, unknown or other
  misc_feature (600)..(600): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
  modified_base (614)..(614): a, c, t, g, unknown or other
  misc_feature (614)..(614): n is a, c, g, or t
  modified_base (617)..(617): a, c, t, g, unknown or other
  misc_feature (617)..(617): n is a, c, g, or t
  modified_base (620)..(620): a, c, t, g, unknown or other
  misc_feature (620)..(620): n is a, c, g, or t
  modified_base (623)..(627): a, c, t, g, unknown or other
  misc_feature (623)..(627): n is a, c, g, or t
  modified_base (629)..(635): a, c, t, g, unknown or other
  misc_feature (629)..(635): n is a, c, g, or t
  modified_base (637)..(642): a, c, t, g, unknown or other
  misc_feature (637)..(642): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggccttatattactgtgtgaagggacctcgtacgccccttatacgcagcggcgtcggtccgttcggttacttttcggacgacgtggggacccgtaacgggaaccccgtggtaccgacccgttcctccgtacncgccctacccgaccgaacggcccaagttccggtcccttcccccgcgggcccgtccccgtcgccgtacccgtaggacgcccgtaccctaccggaacggtacgccaccggaacggcccgggtccccggtacgggtaccgtccggtacccggttcgggtacccgaaacgggtaccctttacctacccgtaagtttaccctaacctaaccgttaccgtaggaccgggcccgggttacgacgggtaccgacggttaccggtacgaacggttacgngtcancncnngacncancgncannnnngnnnnnnncnnnnnng

SEQ ID NO: 294884 - DNA, 501 bp, Homo sapiens
  misc_feature: GYAE6OF02I3D4H.37.77.G11.1.454.CMB.1.raw
  modified_base (213)..(213): a, c, t, g, unknown or other
  misc_feature (213)..(213): n is a, c, g, or t
  modified_base (332)..(332): a, c, t, g, unknown or other
  misc_feature (332)..(332): n is a, c, g, or t
  modified_base (360)..(360): a, c, t, g, unknown or other
  misc_feature (360)..(360): n is a, c, g, or t
  modified_base (441)..(441): a, c, t, g, unknown or other
  misc_feature (441)..(441): n is a, c, g, or t
  modified_base (477)..(477): a, c, t, g, unknown or other
  misc_feature (477)..(477): n is a, c, g, or t
  modified_base (479)..(487): a, c, t, g, unknown or other
  misc_feature (479)..(487): n is a, c, g, or t
  modified_base (489)..(501): a, c, t, g, unknown or other
  misc_feature (489)..(501): n is a, c, g, or t
tcagtagtgtagatcacgaccggtgctcgatttagctagtcactcaagggaaagggggctggagtgggtctcagctattaatgggaatggtgataccacatactacgcagactccgtgaaggggccggttcaccatctccagggacaattccaagaacacactgtctctgcaaatgaacagcctgagagtcgaggacacggccttatattacngtgtgaaggacctctagccccttatagcagcggctggtcctggtactttgacgactggggccagggaacctggtcacgtctctcagcctccaccaaggcccatccggtcctttcccccnggcccgccctgcctccaggacgccaccncccgagacgcacagccggcccgtggggctcggccctggtcaaacgggacctaactttcccacttcctaactaccttaaccngacggcgggtccgtgggctaaacggggctcaagtgncnnnnnnnnncnnnnnnnnnnnnn

SEQ ID NO: 294885 - DNA, 780 bp, Homo sapiens
  misc_feature: GYAE6OF02JUTR2.37.77.G11.1.454.CMB.1.raw
  modified_base (177)..(177): a, c, t, g, unknown or other
  misc_feature (177)..(177): n is a, c, g, or t
  modified_base (738)..(738): a, c, t, g, unknown or other
  misc_feature (738)..(738): n is a, c, g, or t
  modified_base (745)..(745): a, c, t, g, unknown or other
  misc_feature (745)..(745): n is a, c, g, or t
  modified_base (754)..(754): a, c, t, g, unknown or other
  misc_feature (754)..(754): n is a, c, g, or t
  modified_base (760)..(780): a, c, t, g, unknown or other
  misc_feature (760)..(780): n is a, c, g, or t
tcagtagtgtagatcacgaccggtgctcgatttagctagtcactcaagggaaagggctggagtgggtctcagctattaatgggaatggtgataccacatactacgcagactccgtgaagggccggttcaccgatctccagggacattccaagaacacactgtctctgcaatgaacancctagagagtcgaggacaacggtccttaagtaacttacgtgttcggtagaacgggaccttctaacgtcccctttagtacgaccgagtcggcgttcgggtaccttaggttaccgtttacggtaccggaccgttccgggggccgaaaccggggttaaaccccgttcgggttaccgtaaccccgtccgttaccccgtaccgtaaccggtccccttaccccgaaccccggtaaacgggtccccccgtaaacgttacccggggtttaccccttacccccccgggtttgggaccccccggtaccccgtttccggtaaccccgtttccccggaacggggtacccgtaccccgtaacccggttaacccgacggaacccggccggaacccgacgggtaccccggggtcccgtcgggaaccggttccgtacccggttacgggtaccgtaacgggtaccccgtttaacgtttacccctaccgttacgttaaaccctaccgtaccggtacggaccgggtaccgggtaccggttacgggaccgtaaacgggacctaccggaagttaacgggcanccgacgnacgcgcagnacttcnnnnnnnnnnnnnnnnnnnnn

SEQ ID NO: 294886 - DNA, 698 bp, Homo sapiens
  misc_feature: GYAE6OF02HG99W.37.77.G11.1.454.CMB.1.raw
  modified_base (98)..(98): a, c, t, g, unknown or other
  misc_feature (98)..(98): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
  modified_base (625)..(625): a, c, t, g, unknown or other
  misc_feature (625)..(625): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (638)..(638): a, c, t, g, unknown or other
  misc_feature (638)..(638): n is a, c, g, or t
  modified_base (640)..(640): a, c, t, g, unknown or other
  misc_feature (640)..(640): n is a, c, g, or t
  modified_base (658)..(658): a, c, t, g, unknown or other
  misc_feature (658)..(658): n is a, c, g, or t
  modified_base (660)..(660): a, c, t, g, unknown or other
  misc_feature (660)..(660): n is a, c, g, or t
  modified_base (667)..(667): a, c, t, g, unknown or other
  misc_feature (667)..(667): n is a, c, g, or t
  modified_base (676)..(676): a, c, t, g, unknown or other
  misc_feature (676)..(676): n is a, c, g, or t
  modified_base (686)..(686): a, c, t, g, unknown or other
  misc_feature (686)..(686): n is a, c, g, or t
tcagtagtgtagatcacgaccggtgctcgatttagctagtcactcaagggaaagggctggagtgggtctcaggtattacgtggtagtggtaataccgnatactacgcagactcgtgacggcgttcacgtctcagagacaattccaagaatacggtctatctggaaaatgaactagcctagagagccgaggacacggcctctattactgngcagaacntcagngtacgtanagcagctagctcgtagactacgtgggccaacggaacctggtacaccgtcgtccttcacgtcctaccgaacccgaacgggacccaacgttccggttaccccgtttaccccccgtgggtaccctaaccccttacccgtacccgtaaaacgttacgaacccgttaaccgtccggttaccggggggaacctaaccggtaaccggcccgggtaaccccgttacgggggcccttaaccgggtcccgttaacgggttaaccgaaaacggggtaccttaaacccggtttaccgaaactttaccgtaaaccgtaacccgtttaacgtaggggaaccggtaccggggtcgggttaacgggacccgtaaagggaccgttaaccaaagttaagggcacgttcgaatncgcgcgcngnacngngatcacgacagacgagancncgtagcngacacgacncgacgacacncgtacgctagac

SEQ ID NO: 294887 - DNA, 624 bp, Homo sapiens
  misc_feature: GYAE6OF02IU36T.37.77.G11.1.454.CMB.1.raw
  modified_base (229)..(229): a, c, t, g, unknown or other
  misc_feature (229)..(229): n is a, c, g, or t
  modified_base (325)..(325): a, c, t, g, unknown or other
  misc_feature (325)..(325): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (590)..(592): a, c, t, g, unknown or other
  misc_feature (590)..(592): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
  modified_base (600)..(601): a, c, t, g, unknown or other
  misc_feature (600)..(601): n is a, c, g, or t
  modified_base (603)..(604): a, c, t, g, unknown or other
  misc_feature (603)..(604): n is a, c, g, or t
  modified_base (606)..(607): a, c, t, g, unknown or other
  misc_feature (606)..(607): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(617): a, c, t, g, unknown or other
  misc_feature (615)..(617): n is a, c, g, or t
  modified_base (619)..(624): a, c, t, g, unknown or other
  misc_feature (619)..(624): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctagagagtcgaggacacggcttatattactgtgtgaggcctcgtacnccccttatacgcagccggtcgtgggtctcggtactttgacggtacgtcgggggccgtacggggaaccccgttggtccacccgttctacccctgacnccctcccaaccggaacgggtccccacggttccgggtcccctttccccgtcgggcccgtccccgttcgcccgtaccggacgggtaccgcctaccccgtaccggaacggccgtacgacccacgggccccgggacccgttgggccctcgtccggttaccgggtaccaaaccgggtaccttaccttaccgcttaccgaaccttacacgtcggacggggtccggttacgcgggaaccgcgggtaccgctaagttcgagctanacgngtannngnngnacnncnncnngncngncnnncnnnnnn

SEQ ID NO: 294888 - DNA, 577 bp, Homo sapiens
  misc_feature: GYAE6OF02JX0K6.37.77.G11.1.454.CMB.1.raw
  modified_base (265)..(265): a, c, t, g, unknown or other
  misc_feature (265)..(265): n is a, c, g, or t
  modified_base (375)..(375): a, c, t, g, unknown or other
  misc_feature (375)..(375): n is a, c, g, or t
  modified_base (552)..(577): a, c, t, g, unknown or other
  misc_feature (552)..(577): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacgacggccttatacttactgtgtgaagggcctctacgccccttagatcagcggctggtcctggttactttnacgacgtcgggccgacgggaacctggcctaccggtcctccgtcacgtccctccaccgaacggcccatccggttccttcccccgtggaccgccctgccctccgacgggacncctaacccgtccggagaacgccgaacgacccggcccgggtcccgtgggccgttccgggacccgttacgggtacgaaacgggttacccttaacccggtttcctactacctaacccgtaaccgtttctaccgggtaccgggccgggtacgaccggtacggaacggtccgtagtaactgnnnnnnnnnnnnnnnnnnnnnnnnnn

SEQ ID NO: 294889 - DNA, 640 bp, Homo sapiens
  misc_feature: GYAE6OF02JUG4U.37.77.G11.1.454.CMB.1.raw
  modified_base (603)..(603): a, c, t, g, unknown or other
  misc_feature (603)..(603): n is a, c, g, or t
  modified_base (614)..(614): a, c, t, g, unknown or other
  misc_feature (614)..(614): n is a, c, g, or t
  modified_base (621)..(640): a, c, t, g, unknown or other
  misc_feature (621)..(640): n is a, c, g, or t
tcagtagtgtagatcacgaccggtgctcgatttagctagtcactcaagggaaaggggctggagtgggtctcagctattaatgggaatggtgataccacatactacgcagactctgtgaggccgattcaccatctccagagacaacgccagaactcatgtatctgcaatgaacagactgagagccgaggacacggctgtgtattactgtgcgtagagaacgggagggacgtattaggtagtaaaatgggtacctggggcctttacgtacttaccgtaacttacctacagtcggaacgttcggtggggaccaaaagggggaccgtaaccggtcctaaccggtccgtacctcgtaccgaccctcccaccgaaccggggtcccctaagttccccggtccgttacccccgttggaccccggtcccttcgcccgtccgaagggtaccggaccctcccggtaccgaacgggcgtacccgaacgtaccgggcccggtcccggtcggggacctccggtccgggtcggtacccgaaacggtccgttaccttccggacttacgtaacctaccgtacgttcgacgggtaccggcgtacgggaccgacgggtaccncgtacgtacgnagctagnnnnnnnnnnnnnnnnnnnn

SEQ ID NO: 294890 - DNA, 691 bp, Homo sapiens
  misc_feature: GYAE6OF02JP51A.37.77.G11.1.454.CMB.1.raw
  modified_base (531)..(531): a, c, t, g, unknown or other
  misc_feature (531)..(531): n is a, c, g, or t
  modified_base (554)..(554): a, c, t, g, unknown or other
  misc_feature (554)..(554): n is a, c, g, or t
  modified_base (619)..(619): a, c, t, g, unknown or other
  misc_feature (619)..(619): n is a, c, g, or t
  modified_base (653)..(653): a, c, t, g, unknown or other
  misc_feature (653)..(653): n is a, c, g, or t
  modified_base (664)..(664): a, c, t, g, unknown or other
  misc_feature (664)..(664): n is a, c, g, or t
  modified_base (681)..(681): a, c, t, g, unknown or other
  misc_feature (681)..(681): n is a, c, g, or t
  modified_base (687)..(687): a, c, t, g, unknown or other
  misc_feature (687)..(687): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagacacactgtctcctgcaaatgaacagcctgagagtcggaggacgacggccttacgtattactgtgtgaagggtacctcgtacggccccctttaatacgcgagaccggtcgtacgggtcctggttacctttcggaccggtaccgttggggccaacggggtaaccccgtcgggttccaacccgttcctcccgttaccacgtcccgtacccaccgaacgggccccctagtcccggttcccttacccccgtcgggcccgccccttggaccttccgaacggtccggcctacccgtaccgtagacgtcctaacgacggccggtccccggtgggtcccgtccggtcccgtcgggtaccgtaacggtaacccttaccgtttacccngtaccgtaaccgtacgttaacgnggtaccgggccgggttacgcgggtaaccgacggtccgtacgtacgtaaggctaaggtcgaacgtnccgaagtcggccttgcggttgaacttccgcgcgngacgtcgcgcncgtctcgcgacgcgacncgcgcngacg

SEQ ID NO: 294891 - DNA, 557 bp, Homo sapiens
  misc_feature: GYAE6OF02IXHJS.37.77.G11.1.454.CMB.1.raw
  modified_base (304)..(304): a, c, t, g, unknown or other
  misc_feature (304)..(304): n is a, c, g, or t
  modified_base (309)..(309): a, c, t, g, unknown or other
  misc_feature (309)..(309): n is a, c, g, or t
  modified_base (360)..(360): a, c, t, g, unknown or other
  misc_feature (360)..(360): n is a, c, g, or t
  modified_base (519)..(519): a, c, t, g, unknown or other
  misc_feature (519)..(519): n is a, c, g, or t
  modified_base (524)..(524): a, c, t, g, unknown or other
  misc_feature (524)..(524): n is a, c, g, or t
  modified_base (526)..(527): a, c, t, g, unknown or other
  misc_feature (526)..(527): n is a, c, g, or t
  modified_base (529)..(534): a, c, t, g, unknown or other
  misc_feature (529)..(534): n is a, c, g, or t
  modified_base (536)..(536): a, c, t, g, unknown or other
  misc_feature (536)..(536): n is a, c, g, or t
  modified_base (540)..(542): a, c, t, g, unknown or other
  misc_feature (540)..(542): n is a, c, g, or t
  modified_base (544)..(544): a, c, t, g, unknown or other
  misc_feature (544)..(544): n is a, c, g, or t
  modified_base (546)..(557): a, c, t, g, unknown or other
  misc_feature (546)..(557): n is a, c, g, or t
tcagtagtgtagatcacgaccggtgctcgatttagctagtcactcaaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtggaagggcctctagccccttatagcagcggctggtcctggtactttgacgacgtggggccagggaacccctggtcacccgtctcctcncgccnccaccgaggcccagtccggtccttccccctgccgccctcgctccgaggacnccacccgtccgacgacgacacgacggcccggcccgtgggcctacggtccgttcgggtaccgaacgggaacctaccgtttaccacttaccgtacccactaccgtacggacgggccggggtacgttccgggacggaacgggtaccgtacaacggttacgancagcngnngnnnnnngncgcnnngncnnnnnnnnnnnn

SEQ ID NO: 294892 - DNA, 625 bp, Homo sapiens
  misc_feature: GYAE6OF02JHKZW.37.77.G11.1.454.CMB.1.raw
  modified_base (276)..(276): a, c, t, g, unknown or other
  misc_feature (276)..(276): n is a, c, g, or t
  modified_base (285)..(285): a, c, t, g, unknown or other
  misc_feature (285)..(285): n is a, c, g, or t
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
  modified_base (553)..(553): a, c, t, g, unknown or other
  misc_feature (553)..(553): n is a, c, g, or t
  modified_base (564)..(564): a, c, t, g, unknown or other
  misc_feature (564)..(564): n is a, c, g, or t
tcagtagtgtagatcacgaccggtgctcgatttagctagtcactcaagggaaaggggctggagtgggtctcagctattaatgggaatggtggataccacatactacgcagactccgtgaagggccggttcaccatctccagggacaattccaagaacacactgtcctctgcaaatgaacacgcctgagagtcggaggacacggctagtttattactgcgcgagacgaaggactgggcggtttcgactacgtggggcacgggaacctggtccacgtntcctcgacncctaccaccgaacgggccccagttccggtccttccccgtaggtccggccctggtaccttccgaagggacgcctaaccctccggaacggacaccgacgaccggccggcccgtcggggtaccgtcgcccggttcggtaccaaaccgggtccttaacctttaccgaacttacccgtaacgaaccgtttaccagggtacgtaccggggcctagggacccgtaagggtccggacttaccgagcgtatgcaagcagacgcngtacgcgacncancgtcgcgcgcnctacgcgacgacgtcgacgcgtcacacgaccgacgtacgacacgacacgacgacgtacgcg

SEQ ID NO: 294893 - DNA, 590 bp, Homo sapiens
  misc_feature: GYAE6OF02F47L6.37.77.G11.1.454.CMB.1.raw
  modified_base (240)..(240): a, c, t, g, unknown or other
  misc_feature (240)..(240): n is a, c, g, or t
  modified_base (301)..(301): a, c, t, g, unknown or other
  misc_feature (301)..(301): n is a, c, g, or t
  modified_base (555)..(555): a, c, t, g, unknown or other
  misc_feature (555)..(555): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (566)..(590): a, c, t, g, unknown or other
  misc_feature (566)..(590): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcatcatctccagggacaattccaagaacacactgtctctgcaaatgaacagcctgagagtcgaggacacggccttatattactgtgtgaagggacctctacgccccttatancagcggctggtcctggtactttgacgcgtggggccagggaaccctggtcaccgtctcctcngcctccaccaacgggcccagtccggtccttcccccgtggccgccctcgcctccgaggagccaccctccggacgcgacacgagccgggcccgtacgggggcctacggcccgttagggtaccgaaacgggtaccctttaacccgtttccctaaactttaccgtaaacccgtaacccttaaccggttacgggacgggtcccggggggtaccgttacggggaccgttaaaccgggggccgtaaccgtaaggttaacgngtaccntnagnnnnnnnnnnnnnnnnnnnnnnnnn

SEQ ID NO: 294894 - DNA, 481 bp, Homo sapiens
  misc_feature: GYAE6OF02FV7WN.37.77.G11.1.454.CMB.1.raw
  modified_base (368)..(368): a, c, t, g, unknown or other
  misc_feature (368)..(368): n is a, c, g, or t
  modified_base (375)..(375): a, c, t, g, unknown or other
  misc_feature (375)..(375): n is a, c, g, or t
  modified_base (444)..(444): a, c, t, g, unknown or other
  misc_feature (444)..(444): n is a, c, g, or t
  modified_base (453)..(481): a, c, t, g, unknown or other
  misc_feature (453)..(481): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagcccccttatagcagcggctggtcctggtactttgacgactggggccagggaacccctggtcaccgtctcctcagcctccaccaacgggcccatccggtcttcccccgtggccgccctgcctccaggacgcacctcgganagcacgngcgccgtgggctcgcctggtcaacggactacctcatctacgaactctgacgcgggctgggcaacgggcncgagtacgnnnnnnnnnnnnnnnnnnnnnnnnnnnnn

SEQ ID NO: 294895 - DNA, 638 bp, Homo sapiens
  misc_feature: GYAE6OF02IH520.37.77.G11.1.454.CMB.1.raw
  modified_base (605)..(606): a, c, t, g, unknown or other
  misc_feature (605)..(606): n is a, c, g, or t
  modified_base (608)..(608): a, c, t, g, unknown or other
  misc_feature (608)..(608): n is a, c, g, or t
  modified_base (610)..(611): a, c, t, g, unknown or other
  misc_feature (610)..(611): n is a, c, g, or t
  modified_base (613)..(614): a, c, t, g, unknown or other
  misc_feature (613)..(614): n is a, c, g, or t
  modified_base (616)..(616): a, c, t, g, unknown or other
  misc_feature (616)..(616): n is a, c, g, or t
  modified_base (619)..(619): a, c, t, g, unknown or other
  misc_feature (619)..(619): n is a, c, g, or t
  modified_base (621)..(622): a, c, t, g, unknown or other
  misc_feature (621)..(622): n is a, c, g, or t
  modified_base (624)..(638): a, c, t, g, unknown or other
  misc_feature (624)..(638): n is a, c, g, or t
tcagtagtgtagatcacgaccggtgctcgatttagctagtcactcaaagggaaaaggggctggagtgggtctcagctattaaatgggaatggtgataccacatactacgcagactccgtgaagggccggttcaccatctccagggacaattccaagaacacactgtctctgacaaatgaacacgcctgagagtacgaggacgaccggtcctttaatattactgtgtaggaagggacctctacgtcccttatagcagcgcgtggtccgtggttacttgacgacgtcggggccgacgggtaaccctcggtccgaccgtcctccttccgacgtccctcctaaccgaaccgggcccgtacgtaccggttcccgtttacccccgtcggcccgtccctcgtcctaccggacggtacgcccaaccgtcccgaacgacgacccgtaaccgacgggccccgggtcccggtacgggccgtcgtcccgttagggtaaccgtaaacgggtacccttacgtttacccacgtttaccctaaccaaaccgtttccgtaggaaccgggtcggggtccgttcgggacggtaaccgggtaccgacctaggttaagcgcgtagnngncnngnncncgncnngnnnnnnnnnnnnnnn

SEQ ID NO: 294896 - DNA, 666 bp, Homo sapiens
  misc_feature: GYAE6OF02HVEE1.37.77.G11.1.454.CMB.1.raw
  modified_base (579)..(579): a, c, t, g, unknown or other
  misc_feature (579)..(579): n is a, c, g, or t
  modified_base (581)..(581): a, c, t, g, unknown or other
  misc_feature (581)..(581): n is a, c, g, or t
  modified_base (591)..(591): a, c, t, g, unknown or other
  misc_feature (591)..(591): n is a, c, g, or t
  modified_base (623)..(623): a, c, t, g, unknown or other
  misc_feature (623)..(623): n is a, c, g, or t
tcagtagtgtagatcacgaccggtgctcgatttagctagtcactcaagggaaaggggctggagtgggtctcagctattaatgggaatggtgataccacatactacgcagactccgtgagggccggttcaccatctccagggacaattccaagaacacactgtctctgacaaatgaacacgcctgagagtcggaggacacggtacctttaatacttacgtgttagtaggaacggaccgtaccgtacgtccccttatacgtacgacggtcggtacgttacggtccgttaggttacttacggacggtacggtacggggaccgtacgggtacccgtcggtactaccgtcctccgtacgaccgtcccacccgaaccgaccggtccgtacgtcccggttcccttccccggtcggacccgtccgtcgtccgtaccgaggacacctaccgacgacgcgacgacgacggcccgtacgcggtcgtcgtaccgtacggtaacgacgtaccttacgtacaacgtacctaccgtacgtacgtcggacgcgggtacgacggaaccgtacggacgtaacgtacgtacgatacgngntacagtacgnacgtcgtactacgacactatacgtagtgacgngtatacgacgacgtacgtcgtacgacgagacgtacgtacgacg

SEQ ID NO: 294897 - DNA, 678 bp, Homo sapiens
  misc_feature: GYAE6OF02GWNOF.37.77.G11.1.454.CMB.1.raw
  modified_base (590)..(590): a, c, t, g, unknown or other
  misc_feature (590)..(590): n is a, c, g, or t
tcagtagtgtagatcacgaccggtgctcgatttagctagtcactcaagggaaagggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctcgtacgtccccttatacgcagtcggctaggtccttaggttactttgacgacgtagggaccagggtaacctggtccaccgtctacctcaacgtccctacctaccgaacggccacgtccggtccttccccgtgtccgccgtcgccgttaccgaggacgactacccgtaccgaaggaacgtaccgacgaaccggtcggtacccgtcggggtacctcggtcccgtacggttaccgaacgggtaacctaccggtttccaacgttaccgtaaccgtaacgttacggtacggtaccggtaccggggcgtttaacggaacggtaacgggtacccgtaacgttaacggaagtacgattccgaaggtccgtaanacgacgacgtagacgacgtacgacgtacacgtagtacgtacgtacgacgtcgacgtacgtacgctacgctacgtacgtacgtagtacg

SEQ ID NO: 294898 - DNA, 525 bp, Homo sapiens
  misc_feature: GYAE6OF02GP9V3.37.77.G11.1.454.CMB.1.raw
  modified_base (469)..(469): a, c, t, g, unknown or other
  misc_feature (469)..(469): n is a, c, g, or t
  modified_base (485)..(485): a, c, t, g, unknown or other
  misc_feature (485)..(485): n is a, c, g, or t
  modified_base (492)..(492): a, c, t, g, unknown or other
  misc_feature (492)..(492): n is a, c, g, or t
  modified_base (494)..(495): a, c, t, g, unknown or other
  misc_feature (494)..(495): n is a, c, g, or t
  modified_base (497)..(525): a, c, t, g, unknown or other
  misc_feature (497)..(525): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctagccccttatagcagcggctggtcctggtactttgacgacgtggggccacgggaaccctggtccaccgtctccctcagccctcccaccaacgggccccacgtccggtcccttcccccgtggcccgtcccctagcctccgaggacgccaccctaccggagacgccacgacggccggcccgtagggcctcgcccgtggtacaacggtactaccttccgactctacactacgtgacgcgggtacncggacgaacgggctanacgtagncnncnnnnnnnnnnnnnnnnnnnnnnnnnnnnn

SEQ ID NO: 294899 - DNA, 586 bp, Homo sapiens
  misc_feature: GYAE6OF02IQV4M.37.77.G11.1.454.CMB.1.raw
  modified_base (327)..(327): a, c, t, g, unknown or other
  misc_feature (327)..(327): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
  modified_base (563)..(586): a, c, t, g, unknown or other
  misc_feature (563)..(586): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcggaggacacggccttatattacgtgtgtggaacgggtacctctacgccccctttatacgcagcggctcggtcctggttactttggacgacgtcgggggcccaacggggaaccccttggtccacccggtcctccgtcncgcctcccgaaccgaccggggcccagtccggtcccttcccccgtgggcccgtcccgtcgaccttccggaacggacgccgaccccgtcggagcgaccaaccgcgggccccggtcccgtgggtccttcggaccgttacggtacgaaccgggttctaacccgtttccacgtacctacgtaaccttcgtaggcgggcggtacgcggacggacggcgacgtagtgtcgcagngctgccngnnnnnnnnnnnnnnnnnnnnnnnn

SEQ ID NO: 294900 - DNA, 748 bp, Homo sapiens
  misc_feature: GYAE6OF02GU6PZ.37.77.G11.1.454.CMB.1.raw
  modified_base (237)..(237): a, c, t, g, unknown or other
  misc_feature (237)..(237): n is a, c, g, or t
  modified_base (665)..(665): a, c, t, g, unknown or other
  misc_feature (665)..(665): n is a, c, g, or t
  modified_base (682)..(682): a, c, t, g, unknown or other
  misc_feature (682)..(682): n is a, c, g, or t
  modified_base (696)..(696): a, c, t, g, unknown or other
  misc_feature (696)..(696): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaatgaacagcctgacgagtcgaggacacggccttatattactgtgtgaagggacctctacgcccttanagcagcggctggtcctggttactttgacgtacgtcgggaccgagggaaccctcggtcaacccgttccgttcctaccgacgtccctacccaacccgtaaacggggacccctaagtccgggtttaccctttacccccccgtaggggtcccgacccccgttggacccttaccgaacgggtaccggaccgtaaccccgttacccggaacggaacgtaccgaaccgaacgggcccggtaccccggtcggggtacctcgggccccgttaacgggttacccgtaaaacggggtaacccttttaacccgttccctaaaccgttacccgttaaaacgtaacccctttaaaccggttaaggaccgggtacccggggttacgggttacccgggaccgaaacggggtccggtaccgtaaaacggttaggaataacgtagngtagacgacgcgcgagngcgacgacgacganacgtagtacgtacgacgtacgtagtacgagacgacgacgagactacgagtcg

SEQ ID NO: 294901 - DNA, 598 bp, Homo sapiens
  misc_feature: GYAE6OF02HD5U1.37.77.G11.1.454.CMB.1.raw
  modified_base (346)..(346): a, c, t, g, unknown or other
  misc_feature (346)..(346): n is a, c, g, or t
  modified_base (352)..(352): a, c, t, g, unknown or other
  misc_feature (352)..(352): n is a, c, g, or t
  modified_base (568)..(598): a, c, t, g, unknown or other
  misc_feature (568)..(598): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctctacgccccttatagcagcggctcggtcctggtactttgacgacgtcggggccacgggaaccctggtcaccgtcctcctcacgcctcccaccgacgggcccacgtccggtcccttcccccngggccnccccgtgcctccgaggacgccaccgtccgagacgtacaccgaggcccgggcccgtggggtccgtcgtaccggttacgggtacccgaaacggggttacccttaacccgtttacccaagttttccccgtaaacctaacccgttaaccgttaggggtaaccggtcccgggggtactacggggaccgtaaaacggggcccgtacaaacgttaggctacgnnnnnnnnnnnnnnnnnnnnnnnnnnnnnnn

SEQ ID NO: 294902 - DNA, 715 bp, Homo sapiens
  misc_feature: GYAE6OF02G0WTO.37.77.G11.1.454.CMB.1.raw
  modified_base (651)..(651): a, c, t, g, unknown or other
  misc_feature (651)..(651): n is a, c, g, or t
  modified_base (657)..(657): a, c, t, g, unknown or other
  misc_feature (657)..(657): n is a, c, g, or t
  modified_base (662)..(662): a, c, t, g, unknown or other
  misc_feature (662)..(662): n is a, c, g, or t
  modified_base (666)..(666): a, c, t, g, unknown or other
  misc_feature (666)..(666): n is a, c, g, or t
  modified_base (669)..(669): a, c, t, g, unknown or other
  misc_feature (669)..(669): n is a, c, g, or t
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (688)..(688): a, c, t, g, unknown or other
  misc_feature (688)..(688): n is a, c, g, or t
  modified_base (698)..(698): a, c, t, g, unknown or other
  misc_feature (698)..(698): n is a, c, g, or t
  modified_base (707)..(707): a, c, t, g, unknown or other
  misc_feature (707)..(707): n is a, c, g, or t
  modified_base (711)..(712): a, c, t, g, unknown or other
  misc_feature (711)..(712): n is a, c, g, or t
  modified_base (714)..(715): a, c, t, g, unknown or other
  misc_feature (714)..(715): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacacggtcttatatactgtgtgaagggacctctacgccccttatacgcagcggctcggtctggtacttgacgacgtggggccaacgggtaaccctggtccacccgtctccgtcacgccctacccaaccgaacgggcccctaagttcccgggttccctttaccccccgtcgggcccgtcccctcggtccgttacccggaacggggaaccggaccctaaccccgttacccggaaacgggaaccgacccgtaaaccggtaccgggaccccgggtaccccggttcgggggtacccttccgggtaccccggttacggggtaacccgtaaaacggggtaacccgtttaaccctttacccgtaacgttacccgtaaaacctaaccgttaaccggtaccggaacgggtacccgggggtacgtaacggggaacccggtaaaacgggtccggaactaacgtaacgggntacganacgancacnacncgtagacgcgacgcncncncgagcacagngcagacgcncacnntnn

SEQ ID NO: 294903 - DNA, 664 bp, Homo sapiens
  misc_feature: GYAE6OF02JED8B.37.77.G11.1.454.CMB.1.raw
  modified_base (335)..(335): a, c, t, g, unknown or other
  misc_feature (335)..(335): n is a, c, g, or t
  modified_base (583)..(583): a, c, t, g, unknown or other
  misc_feature (583)..(583): n is a, c, g, or t
  modified_base (589)..(589): a, c, t, g, unknown or other
  misc_feature (589)..(589): n is a, c, g, or t
  modified_base (614)..(614): a, c, t, g, unknown or other
  misc_feature (614)..(614): n is a, c, g, or t
tcagtagtgtagatcacgaccggtgctcgatttagctagtcactcaagggaaaggggctggagttggtctcagctattaatgggaatggtgataccacatactacgcagactccgtgaagggccggttcaccatctccagggacaattccaagaacacactgtctctgacaaatgaacagcctgagagtcgagacacggccttatatactgtgtgaaggactctagccccttatagcagcgctggtctggtacttgacgactggggccacgggaacctggtcaccgtctcctcacgcctcccaaccgaacgggcccagtccggtcttacccccgnggaccgtccccgtcgccgtaccgaacggtacgaccctaccgtaaaccggaacgtacggaccaaaccgaacgggtacccggtccccggtacggggccgttccggggtaccctaccgggggtaccgtaaaacgggaaccgttttacccgttacctaaacctttaaccgtaaccgtaacccttaaacgtacgggaacgggtacggggtccgtaacgggtacgaaaccgggacgtaccggaacgttaccggngaaacncacactcgacgagacgacgacacanacgtcacgtacacacgtcacgacgactatagacacagacgtcacgagtag

SEQ ID NO: 294904 - DNA, 579 bp, Homo sapiens
  misc_feature: GYAE6OF02G6DDP.37.77.G11.1.454.CMB.1.raw
  modified_base (217)..(217): a, c, t, g, unknown or other
  misc_feature (217)..(217): n is a, c, g, or t
  modified_base (366)..(366): a, c, t, g, unknown or other
  misc_feature (366)..(366): n is a, c, g, or t
  modified_base (382)..(382): a, c, t, g, unknown or other
  misc_feature (382)..(382): n is a, c, g, or t
  modified_base (520)..(520): a, c, t, g, unknown or other
  misc_feature (520)..(520): n is a, c, g, or t
  modified_base (527)..(527): a, c, t, g, unknown or other
  misc_feature (527)..(527): n is a, c, g, or t
  modified_base (536)..(536): a, c, t, g, unknown or other
  misc_feature (536)..(536): n is a, c, g, or t
  modified_base (541)..(541): a, c, t, g, unknown or other
  misc_feature (541)..(541): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (548)..(549): a, c, t, g, unknown or other
  misc_feature (548)..(549): n is a, c, g, or t
  modified_base (552)..(552): a, c, t, g, unknown or other
  misc_feature (552)..(552): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (560)..(560): a, c, t, g, unknown or other
  misc_feature (560)..(560): n is a, c, g, or t
  modified_base (562)..(563): a, c, t, g, unknown or other
  misc_feature (562)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacagcctgagagtcgaggacgacggccttattattactgtgngaacgggacctctacgtccccttatacgcagcggcgtggtccttggtactttgacgacgtcggggccagggaaccctggtccaccgtctcctacgacgcctccaccgaacggcccagtcggtccttcccccgtggacccgccctcgccnccgaggacgactcccnccgtagactccgaccgtgacccgggccgtacgggcgtaacgcccgttacggtccgaaaccgggcttaccttactacttaccctacacctacggacacgggcgggtccgtaggccgtaaaggcccgaagttacgtacgngtaccanacgtcagtnaacgncngngcnnctngcncngananncncncncntntngntc

SEQ ID NO: 294905 - DNA, 531 bp, Homo sapiens
  misc_feature: GYAE6OF02IPFO2.37.77.G11.1.454.CMB.1.raw
  modified_base (354)..(354): a, c, t, g, unknown or other
  misc_feature (354)..(354): n is a, c, g, or t
  modified_base (384)..(384): a, c, t, g, unknown or other
  misc_feature (384)..(384): n is a, c, g, or t
  modified_base (492)..(492): a, c, t, g, unknown or other
  misc_feature (492)..(492): n is a, c, g, or t
  modified_base (499)..(500): a, c, t, g, unknown or other
  misc_feature (499)..(500): n is a, c, g, or t
  modified_base (502)..(531): a, c, t, g, unknown or other
  misc_feature (502)..(531): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcgaggacacggccttatattactgtgtagaagggacctctacgccccttatagcagcggtctggtccgtggtactttgacgtacgtcggggaccacgggaaccctggtccaccgtcctcctacacgccctcccaccgaaccggccacgtccgtcccttcccccgngggcccgtccctcgtcctccgacgcgaccncctccgagacgcacgacgccgcgtcgtcgggctccggtcgtcggtacacggtactaccttccgaactcgtaccacgttctagggcgccgggctcgggacaacgggtcncaacgtnncnnnnnnnnnnnnnnnnnnnnnnnnnnnnnn

SEQ ID NO: 294906 - DNA, 697 bp, Homo sapiens
  misc_feature: GYAE6OF02JFZJX.37.77.G11.1.454.CMB.1.raw
  modified_base (402)..(402): a, c, t, g, unknown or other
  misc_feature (402)..(402): n is a, c, g, or t
  modified_base (466)..(466): a, c, t, g, unknown or other
  misc_feature (466)..(466): n is a, c, g, or t
  modified_base (639)..(639): a, c, t, g, unknown or other
  misc_feature (639)..(639): n is a, c, g, or t
  modified_base (646)..(646): a, c, t, g, unknown or other
  misc_feature (646)..(646): n is a, c, g, or t
  modified_base (656)..(656): a, c, t, g, unknown or other
  misc_feature (656)..(656): n is a, c, g, or t
  modified_base (660)..(660): a, c, t, g, unknown or other
  misc_feature (660)..(660): n is a, c, g, or t
  modified_base (663)..(664): a, c, t, g, unknown or other
  misc_feature (663)..(664): n is a, c, g, or t
  modified_base (681)..(681): a, c, t, g, unknown or other
  misc_feature (681)..(681): n is a, c, g, or t
  modified_base (683)..(683): a, c, t, g, unknown or other
  misc_feature (683)..(683): n is a, c, g, or t
  modified_base (686)..(686): a, c, t, g, unknown or other
  misc_feature (686)..(686): n is a, c, g, or t
  modified_base (689)..(689): a, c, t, g, unknown or other
  misc_feature (689)..(689): n is a, c, g, or t
  modified_base (697)..(697): a, c, t, g, unknown or other
  misc_feature (697)..(697): n is a, c, g, or t
tcagtagtgtagatcacgaccggtgctcgatttagctagtcactcaagggaaaggggctggagtgggtctcagctattaatgggaatggtgataccacatactacgcagactccgtgaacgggccggttcaccatctccagggacaacttccaagaacacactgtctctgcaaatgaacagcctagagagtcgaggacaccggacctttagtaattacctggtagtacggaacgggaccctacgtaacgccccctttaataacgcaacggcggtactcggtacccttggtaacttttcgacgtaccgtacggggccaacggggtaacccttcgggtaccacccggtcctccctacacggtccctacgaaccacgggcccagtccgggtccctttacccccgnggcccgtccccgtacgcccgttccgacggacacccgtacccctaccggacgaacgtacccaacnccgggcccggtccccggtggggtcccgtaccggtccgttaccggggtaccgtaaacggggacctttaaccctcccgaacgtttacccaactaccccggtttaagcggtaaccgggaccgggttcggttcggaaaccgccggggtaacgccgtaaccgtaggcacacgggtttnactaganaccgatcgangacnctnncacgtagtctagtacgncngcngcncgctcgan

SEQ ID NO: 294907 - DNA, 745 bp, Homo sapiens
  misc_feature: GYAE6OF02J0036.37.77.G11.1.454.CMB.1.raw
  modified_base (151)..(151): a, c, t, g, unknown or other
  misc_feature (151)..(151): n is a, c, g, or t
  modified_base (668)..(668): a, c, t, g, unknown or other
  misc_feature (668)..(668): n is a, c, g, or t
  modified_base (675)..(676): a, c, t, g, unknown or other
  misc_feature (675)..(676): n is a, c, g, or t
  modified_base (678)..(678): a, c, t, g, unknown or other
  misc_feature (678)..(678): n is a, c, g, or t
  modified_base (686)..(686): a, c, t, g, unknown or other
  misc_feature (686)..(686): n is a, c, g, or t
  modified_base (697)..(698): a, c, t, g, unknown or other
  misc_feature (697)..(698): n is a, c, g, or t
  modified_base (700)..(700): a, c, t, g, unknown or other
  misc_feature (700)..(700): n is a, c, g, or t
  modified_base (704)..(704): a, c, t, g, unknown or other
  misc_feature (704)..(704): n is a, c, g, or t
  modified_base (708)..(708): a, c, t, g, unknown or other
  misc_feature (708)..(708): n is a, c, g, or t
  modified_base (728)..(728): a, c, t, g, unknown or other
  misc_feature (728)..(728): n is a, c, g, or t
tcagtagtgtagatcacgaccggtgctcgatttagctagtcactcaagggaaaggggctggagtgggtctcagctattaatgggaatggtgataccacatactacgcagctcgtgaagggcgttcaccatctccagggactaatccgaaanaaccacacgttgtctactgacaaatgaacacgcctgaggacgtaccggaacggtcgaacggtacctttaattactttacgttgttaggtacggaacggttacctcgtaaccgtcccctttaagagcgacgtcggtcgttccgggtctttacggtactttcggacggtacggtacggggacccgtaacgggacccgttacgttaccgtaaccccgtccgttcctaccgtaccgtaccccgtaccacccgggtaacccggtccccttacgttccccggggtttacccctcccccggttccgggtcccgtaccccggtccccggtaccttacccggggaacggacccgttcccaaaccggtcccggaaacgggcacctaaccggggccgtaccccggggttccctacgggttccgacgggtccccttaagggtccgtaaaccggtacccttaccgtacccgtacttctaacttaacgtacgcggtacggtcgtacggtgaccggtacgctacgcgttaancgacgtnncncgtacgcnatacacgacgnncncgcncgcnggctacgtcgttaacactcngtacgtactacgtacgc

SEQ ID NO: 294908 - DNA, 798 bp, Homo sapiens
  misc_feature: GYAE6OF02IX1EC.37.77.G11.1.454.CMB.1.raw
  modified_base (736)..(736): a, c, t, g, unknown or other
  misc_feature (736)..(736): n is a, c, g, or t
  modified_base (744)..(744): a, c, t, g, unknown or other
  misc_feature (744)..(744): n is a, c, g, or t
  modified_base (758)..(758): a, c, t, g, unknown or other
  misc_feature (758)..(758): n is a, c, g, or t
  modified_base (761)..(761): a, c, t, g, unknown or other
  misc_feature (761)..(761): n is a, c, g, or t
tcagtagtgtagatcacgaccggtgctcgatttagctagtcactcaagggaaaggggctggagtgggtctcagctattaatgggaatggtgatacacatactacgcagactccgtgagggccgtcaccatctcgaggacacttcaagacacactcgtctctgaactaatcgaacgacgcctaggaagtacgtcgacggacgaccggtcctttaagtactttaacgtggttacgtaggaacggtaaccttctaaccggtacccctttaaagtacggccgaaggccggtacgtcgggttaccggttacggtttaacgtttcggaaccggtcgggtacggggcccggtaaaccgggtaaccgtcggggtaccctacccggttacccttccgacgtacccgttacccgaacccgaaccggaaccgggttcccaacgttcccggtttccccgttcccccggtaccgggccccgttaaccccggttacccggccccggtaaacggccgaccccgaacccggttccggaaacgaaccgtccgaaacgggtcccggacccgggtacccggtcggggtccttcccgggtacggttacccgggtaaccgaaacgggttaaccccttttcccgtaccgtaacgtttaaccctaaaccggtacctttaacggacccgggttgggtaccgggtcgttaaccgggacgaaaccgggtctaccggttaaagcggcgcgacgcgcgcgcgcncacgcgcncacgcgcgcgacgngcncgtacgctactacgtgactacgacgagacgtacgagc

SEQ ID NO: 294909 - DNA, 525 bp, Homo sapiens
  misc_feature: GYAE6OF02GM3GO.37.77.G11.1.454.CMB.1.raw
  modified_base (242)..(242): a, c, t, g, unknown or other
  misc_feature (242)..(242): n is a, c, g, or t
  modified_base (310)..(310): a, c, t, g, unknown or other
  misc_feature (310)..(310): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (489)..(489): a, c, t, g, unknown or other
  misc_feature (489)..(489): n is a, c, g, or t
  modified_base (497)..(497): a, c, t, g, unknown or other
  misc_feature (497)..(497): n is a, c, g, or t
  modified_base (500)..(525): a, c, t, g, unknown or other
  misc_feature (500)..(525): n is a, c, g, or t
tcagtagtgtagatcacgaccggtgctcgatttagctagtcactcaaggggaaagggggctggagttggtctcagctattaatgggaatggtgataccacatactacgcagactccgtgaagggccggttcaccatctccagggacaattccaagaacacactgtctctgcaaatgaacagcctgagagtcgaggacacggccttatattactgtgtgaagggacctcgtacgcccctttanagtcgagcggcgtggtccttggttactttgacgcggtcggggccacgggaccctggtcaccgtctccncncgcctccaccgaggccngtccggtcctccccgtggccncctcgcctccgaggtacgccacctacgagacgcgacgacggcccggcccgtgggctcgtccgtcggtaccgaacgtacctaccgttaccactacctaactacgtcgacgtaggccgggtacgtcgggacggaggaccgngagtacgngcnnnnnnnnnnnnnnnnnnnnnnnnnn

SEQ ID NO: 294910 - DNA, 551 bp, Homo sapiens
  misc_feature: GYAE6OF02FUAI0.37.77.G11.1.454.CMB.1.raw
  modified_base (317)..(317): a, c, t, g, unknown or other
  misc_feature (317)..(317): n is a, c, g, or t
  modified_base (512)..(512): a, c, t, g, unknown or other
  misc_feature (512)..(512): n is a, c, g, or t
  modified_base (517)..(517): a, c, t, g, unknown or other
  misc_feature (517)..(517): n is a, c, g, or t
  modified_base (520)..(520): a, c, t, g, unknown or other
  misc_feature (520)..(520): n is a, c, g, or t
  modified_base (522)..(522): a, c, t, g, unknown or other
  misc_feature (522)..(522): n is a, c, g, or t
  modified_base (524)..(525): a, c, t, g, unknown or other
  misc_feature (524)..(525): n is a, c, g, or t
  modified_base (527)..(551): a, c, t, g, unknown or other
  misc_feature (527)..(551): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgcaaatgaacacgcctgagagtcgaggacacggccttatattacgtgtgtgaacgggacctcgtacgccccttatacgcagccggctcggtctggttactttgacgtacgtgggggccaggggaacccttcggtctacccggtctcctcncgccctcccgaccgacggccctatccggttcctcccccgtggcccgcccgtgtccctccgaggacgtccacccgtcgaacgtacgcaccaggcccggcccgtcggggtctacggtcgttcggtcgaacggaccttacgttacctactccaactacctacgtggacggcgggtcgtaggacgtagggacgcgagtnactcngtncngnngnnnnnnnnnnnnnnnnnnnnnnnnn

SEQ ID NO: 294911 - DNA, 633 bp, Homo sapiens
  misc_feature: GYAE6OF02J01W4.37.77.G11.1.454.CMB.1.raw
  modified_base (558)..(558): a, c, t, g, unknown or other
  misc_feature (558)..(558): n is a, c, g, or t
  modified_base (568)..(568): a, c, t, g, unknown or other
  misc_feature (568)..(568): n is a, c, g, or t
  modified_base (575)..(575): a, c, t, g, unknown or other
  misc_feature (575)..(575): n is a, c, g, or t
  modified_base (583)..(583): a, c, t, g, unknown or other
  misc_feature (583)..(583): n is a, c, g, or t
  modified_base (594)..(594): a, c, t, g, unknown or other
  misc_feature (594)..(594): n is a, c, g, or t
  modified_base (607)..(607): a, c, t, g, unknown or other
  misc_feature (607)..(607): n is a, c, g, or t
  modified_base (618)..(618): a, c, t, g, unknown or other
  misc_feature (618)..(618): n is a, c, g, or t
  modified_base (623)..(623): a, c, t, g, unknown or other
  misc_feature (623)..(623): n is a, c, g, or t
tcagtagtgtagatcacgaccggtgctcgatttagctagtcactcaagggaaaggggctggagttggtctcagctattaatgggaatggtgataccacatactacgcagactccgtggagggccggttcaccatctccagggacattccaagaacacactgtctctgcaatgaacagcctgagagtcgagacacgccttatattactgtgtgaagggacctctacgtccccttagtacgcacgcggcgttggtcttggtactttgacgtacgtcggggccacgggtaaccctggtacctaccgtctcctcacgtccctaccgaccgaacggtcccacgtaccggtccttcccccggtggcccgtcccgtcgtccgtccgacggacgacctaccgtacgacgacgcgtaccgacggtccggccgtggaccgtcgcccgtacgggtaccgaacggtacctaccgttaccactaccgtaacctaccgttacggtagggtaaccggaccggggtcgttccgggaccggtaaacccgggtgtaacccgtaaggttaacggcgnaacgttcgcncgtacgngtcgagcncgcgtcacgcncgagcgagtcacngtacgtagacncgacngcgtcgtgcg

SEQ ID NO: 294912 - DNA, 524 bp, Homo sapiens
  misc_feature: GYAE6OF02FOYU9.37.77.G11.1.454.CMB.1.raw
  modified_base (233)..(233): a, c, t, g, unknown or other
  misc_feature (233)..(233): n is a, c, g, or t
  modified_base (486)..(486): a, c, t, g, unknown or other
  misc_feature (486)..(486): n is a, c, g, or t
  modified_base (488)..(489): a, c, t, g, unknown or other
  misc_feature (488)..(489): n is a, c, g, or t
  modified_base (494)..(495): a, c, t, g, unknown or other
  misc_feature (494)..(495): n is a, c, g, or t
  modified_base (497)..(498): a, c, t, g, unknown or other
  misc_feature (497)..(498): n is a, c, g, or t
  modified_base (500)..(506): a, c, t, g, unknown or other
  misc_feature (500)..(506): n is a, c, g, or t
  modified_base (508)..(516): a, c, t, g, unknown or other
  misc_feature (508)..(516): n is a, c, g, or t
  modified_base (518)..(521): a, c, t, g, unknown or other
  misc_feature (518)..(521): n is a, c, g, or t
  modified_base (523)..(524): a, c, t, g, unknown or other
  misc_feature (523)..(524): n is a, c, g, or t
tcagtagtgtagatcacgaccggtgctcgatttagctagtcactcaagggaaaggggctggagtgggtctcagctattaatcgggaatggtgataccacatactacgcagactccgtgaagggccggttcaccatctccagggacaattccaagacacactgtctctgcaaatgaacagcctgagagtcgaggacacggcttatattatgtgtgaaggactcgacgcccttangcagccggctggtcctggttacttagacgtcgcggggccgaacggacctggtaccactactcctccacgactccctccaaccgaccggccctagttccggtccctccccgtcggccgccctgcctaccgaggcgtccaccgtcgagacgcacgacggcggtccgtcgggctcgcgtcgaccgaaggtcctactctactacctactaccgtacgtcgacggtccgggtcgagggacgacggccgtacgtaacgngnnacgtnncnncnnnnnnncnnnnnnnnncnnnncnn

SEQ ID NO: 294913 - DNA, 570 bp, Homo sapiens
  misc_feature: GYAE6OF02H5RE2.37.77.G11.1.454.CMB.1.raw
  modified_base (535)..(535): a, c, t, g, unknown or other
  misc_feature (535)..(535): n is a, c, g, or t
  modified_base (538)..(541): a, c, t, g, unknown or other
  misc_feature (538)..(541): n is a, c, g, or t
  modified_base (544)..(550): a, c, t, g, unknown or other
  misc_feature (544)..(550): n is a, c, g, or t
  modified_base (552)..(570): a, c, t, g, unknown or other
  misc_feature (552)..(570): n is a, c, g, or t
tcagtagtgtagatcacgaccggtgctcgattttagctagtcactcaagggaaaggggctggagtggggtctcagctattaatggggaatggtgataccacatactacgcagactcccgtgaagggccggttcaccatctaccagggacaattccaagaacacactgtctctgcaaatgaacagcctgagagtcggaggacgacggtccttatacttactgtgtggaacgggacctctacgccccttatagcaggcggcgtcggtccttggtactttgacgtacggtcggggaccgaccggtaacccgtcggtccacccgtctacctcacgtcctacccgaccgaccggcctacgtccgttcccgtccccgtcgccgcccgtcgcctaccgacggaccgccaccgtaccggacggaccgaccaccggaccggccggtccgtcgggtccgtacgtccgtacggacgtaacggtaccttacttacctacttactacctactacgtcggacggcggcggtacggacgacgacgactanagnnnncannnnnnncnnnnnnnnnnnnnnnnnnn

SEQ ID NO: 294914 - DNA, 584 bp, Homo sapiens
  misc_feature: GYAE6OF02F9UBC.37.77.G11.1.454.CMB.1.raw
  modified_base (547)..(547): a, c, t, g, unknown or other
  misc_feature (547)..(547): n is a, c, g, or t
  modified_base (551)..(551): a, c, t, g, unknown or other
  misc_feature (551)..(551): n is a, c, g, or t
  modified_base (555)..(555): a, c, t, g, unknown or other
  misc_feature (555)..(555): n is a, c, g, or t
  modified_base (557)..(584): a, c, t, g, unknown or other
  misc_feature (557)..(584): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcggaggaccacggtccttatattactgtgtaggaacgggtacctctacgtaccccttatacgcaggcggcgttcggtccgttggttactttggacgacgtcggggaccacgggtaacccctggtccaccgtctcctcagtccctaccaccgaacggcccacgttccggtacccttcccccgtggcccgtcccctcgacctccgagtaccgcctacccgtccgagacgcacgacggcccggtcccggtcgggcctcgtcccgtagggtaccgaaacggtaccttaccgttccgaaccttcctaacgtaaccttacgtacgggacggtaccggggcttacgggacctaagggccacgtanaggnacgncnnnnnnnnnnnnnnnnnnnnnnnnnnnn

SEQ ID NO: 294915 - DNA, 588 bp, Homo sapiens
  misc_feature: GYAE6OF02FVG9O.37.77.G11.1.454.CMB.1.raw
  modified_base (186)..(186): a, c, t, g, unknown or other
  misc_feature (186)..(186): n is a, c, g, or t
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (343)..(343): a, c, t, g, unknown or other
  misc_feature (343)..(343): n is a, c, g, or t
  modified_base (358)..(358): a, c, t, g, unknown or other
  misc_feature (358)..(358): n is a, c, g, or t
  modified_base (511)..(511): a, c, t, g, unknown or other
  misc_feature (511)..(511): n is a, c, g, or t
  modified_base (516)..(516): a, c, t, g, unknown or other
  misc_feature (516)..(516): n is a, c, g, or t
  modified_base (529)..(529): a, c, t, g, unknown or other
  misc_feature (529)..(529): n is a, c, g, or t
  modified_base (541)..(541): a, c, t, g, unknown or other
  misc_feature (541)..(541): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaatgaacagcctgagngtcgaggacacggccttatattacngtgtgaagggacctctacgccccttatagcagtcggctggtcctggttactttgacgacgtgggccaggacctgtacaccgtctccncacgccctacaccgacggccagttccggtccttccccgaggcccncctgcctccaggacnccacctcgagacgacacgacgcccggaccgtcgggactcggccgttacggtcgaacgggtaccttacgttaccacgttcctaactacgttaccgaggtaaccgggtcgggaccttacgggaacgaacggggccaacgtagttaccggcacgtnaccgntacgcagcacgcnacgttcagtacnacncngtacncacgtacgtagtacgacgactacgacgacgtacgtcg

SEQ ID NO: 294916 - DNA, 713 bp, Homo sapiens
  misc_feature: GYAE6OF02GGRMI.37.77.G11.1.454.CMB.1.raw
  modified_base (179)..(179): a, c, t, g, unknown or other
  misc_feature (179)..(179): n is a, c, g, or t
  modified_base (660)..(660): a, c, t, g, unknown or other
  misc_feature (660)..(660): n is a, c, g, or t
  modified_base (665)..(665): a, c, t, g, unknown or other
  misc_feature (665)..(665): n is a, c, g, or t
  modified_base (669)..(669): a, c, t, g, unknown or other
  misc_feature (669)..(669): n is a, c, g, or t
  modified_base (674)..(674): a, c, t, g, unknown or other
  misc_feature (674)..(674): n is a, c, g, or t
  modified_base (676)..(678): a, c, t, g, unknown or other
  misc_feature (676)..(678): n is a, c, g, or t
  modified_base (685)..(685): a, c, t, g, unknown or other
  misc_feature (685)..(685): n is a, c, g, or t
  modified_base (695)..(695): a, c, t, g, unknown or other
  misc_feature (695)..(695): n is a, c, g, or t
  modified_base (710)..(710): a, c, t, g, unknown or other
  misc_feature (710)..(710): n is a, c, g, or t
tcagtagtgtagatcacgaccggtgctcgattttagctagtcactcaagggaaaggggctggagtgggtctcagctattaatgggaatggtgataccacatactacgcagactccgtgaagggcggttcaccatctccagggacaattccaagaacacactgtctctgcaaatgaacancctagacgaggtacgaaggaccgaccggtaccttattacgttactggtggttacggaagggtaccctactaccggtcccccgtttataacggcgaacggtcggaccgttcgggttaccctagggtttaaccttttacggaaccggtaacggtcgggggaccgtaaccggggtaaaccccttgggtaccctaaccgttccgtcctcacggtaccctacccgaccgtaaccgggcctaacgttccggtcccgtccccgtcggcctcccgtacgtcctacgacgggtcgcctaacccgtccggacgtacgacctaacggacggtacccggtcccggtcgggtaccgtcggtacccgtacggtttaaccggaacgggtaacccgtaaccttttaccgaacttaacccggtaaccacgttaaaccgtgggacgtaaccgggtcgtacggacgtaaacgggcgtacgaacgttacgcactgatcganggacnctanctcgnannngagtgcngcgacgcgtntcacgcgcacgcgtntcg

SEQ ID NO: 294917 - DNA, 574 bp, Homo sapiens
  misc_feature: GYAE6OF02HBEUR.37.77.G11.1.454.CMB.1.raw
  modified_base (252)..(252): a, c, t, g, unknown or other
  misc_feature (252)..(252): n is a, c, g, or t
  modified_base (353)..(353): a, c, t, g, unknown or other
  misc_feature (353)..(353): n is a, c, g, or t
  modified_base (512)..(513): a, c, t, g, unknown or other
  misc_feature (512)..(513): n is a, c, g, or t
  modified_base (515)..(515): a, c, t, g, unknown or other
  misc_feature (515)..(515): n is a, c, g, or t
  modified_base (517)..(518): a, c, t, g, unknown or other
  misc_feature (517)..(518): n is a, c, g, or t
  modified_base (520)..(526): a, c, t, g, unknown or other
  misc_feature (520)..(526): n is a, c, g, or t
  modified_base (529)..(531): a, c, t, g, unknown or other
  misc_feature (529)..(531): n is a, c, g, or t
  modified_base (533)..(533): a, c, t, g, unknown or other
  misc_feature (533)..(533): n is a, c, g, or t
  modified_base (535)..(538): a, c, t, g, unknown or other
  misc_feature (535)..(538): n is a, c, g, or t
  modified_base (540)..(541): a, c, t, g, unknown or other
  misc_feature (540)..(541): n is a, c, g, or t
  modified_base (543)..(545): a, c, t, g, unknown or other
  misc_feature (543)..(545): n is a, c, g, or t
  modified_base (569)..(569): a, c, t, g, unknown or other
  misc_feature (569)..(569): n is a, c, g, or t
  modified_base (571)..(572): a, c, t, g, unknown or other
  misc_feature (571)..(572): n is a, c, g, or t
  modified_base (574)..(574): a, c, t, g, unknown or other
  misc_feature (574)..(574): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaaacagcctgagagccgaggacacggcctctattactgtgcgaagagatcaaggacggagtataggcagacagctcngactacgtgggaccaacggacctggtaccaccgtctcctcacgccctccaacgaacggcccagtccggtccttccccgtcgaccacccctccaccaagacnccaacctcgtacggggaccacacggccggcccgtgggacgtcgaccgtacggtacaaacggtaccgttaaccttctaacgttccctaacgtaaccttacgttacggacggtccggggccgtacgggacgaaacgggtcgaacgtaacggtaagcagcannanannannnnnnncannnanannnnannannntttttttttttttttttttttttnannan

SEQ ID NO: 294918 - DNA, 621 bp, Homo sapiens
  misc_feature: GYAE6OF02H90EU.37.77.G11.1.454.CMB.1.raw
  modified_base (213)..(213): a, c, t, g, unknown or other
  misc_feature (213)..(213): n is a, c, g, or t
  modified_base (549)..(549): a, c, t, g, unknown or other
  misc_feature (549)..(549): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (563)..(563): a, c, t, g, unknown or other
  misc_feature (563)..(563): n is a, c, g, or t
  modified_base (574)..(574): a, c, t, g, unknown or other
  misc_feature (574)..(574): n is a, c, g, or t
  modified_base (609)..(609): a, c, t, g, unknown or other
  misc_feature (609)..(609): n is a, c, g, or t
  modified_base (618)..(618): a, c, t, g, unknown or other
  misc_feature (618)..(618): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacattccaagaacacactgtctctgcaaatgaacagcctgagagtcgaggacaccggtcctttatattacngtgtagaaggcctctacgtcccttaatacgcagcggctggtccgtgttctttgacgtactggggccacgggacctcggtcgaccgtcctcctcgaccgtcctcccaccgaacgggccccacggtccggttccttcccccgtggtcccggtccccgtcgccttaccgacggacgccaccgtccggtacgacgaccacgacggcccggcccgtgggtcctacgtcgtacggtcgaacgggtacttacgtctaacgtcctaaccgtactaccgtagacggccgggtacgtacgggtaccggaacggtccgtaccgtaacggtaacgtgcaacgttcgancgtncgctcnctcncgcgtacgtcncgtcgcgtgtcgctacgtactagtacgtcgtactntactacgtntcg

SEQ ID NO: 294919 - DNA, 483 bp, Homo sapiens
  misc_feature: GYAE6OF02G1HCQ.37.77.G11.1.454.CMB.1.raw
  modified_base (221)..(221): a, c, t, g, unknown or other
  misc_feature (221)..(221): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (458)..(483): a, c, t, g, unknown or other
  misc_feature (458)..(483): n is a, c, g, or t
tcagtagtgtagatcacgaccggtgctcgatttagctagtcactcaagggaaaggggctggagtgggtctcagctattaatgggaatggtgataccacatactacgcagactccgtgaagggccggttcaccatctccagggacaattccaagaacacactgtctctgacaaatgaacagcctgagagtcggagacacggccctctattactgtgcgaganatcagacggagtatagcagcagctctgactacgtcggggccaacgggaacccttggtaccaccgtcctcctcacgccctccaccgacggcccagtccggtcccttcccccgngccacccctcctaccaacgcncctacgtccggtgggccagacggccggcccgtgggctcgccgtggtacaaggccttactcactcctacacctgtgaggcggcgcggacgacggcgccagtagcnnnnnnnnnnnnnnnnnnnnnnnnnn

SEQ ID NO: 294920 - DNA, 117 bp, Homo sapiens
  misc_feature: GYAE6OF01DZSBT.51.72.G06.1.454.CMB.1.raw
tcagcgatcgtatacacgaccggtgctcgatttagctacgactgcaagggaagggcagcgtcactctgttcccgccctcctctcgtagcactctgagcgggctggcaaggcgcatag

SEQ ID NO: 294921 - DNA, 119 bp, Homo sapiens
  misc_feature: GYAE6OF01BEWMI.51.72.G06.1.454.CMB.1.raw
  modified_base (119)..(119): a, c, t, g, unknown or other
  misc_feature (119)..(119): n is a, c, g, or t
tcagcgatcgtatacacgaccggtgctcgatttagctacgactgcaagggaaagggcagcgtcactctgttcccgccctcctctcgtagcactctgagcgggctggcaaggcgcatagn

SEQ ID NO: 294922 - DNA, 121 bp, Homo sapiens
  misc_feature: GYAE6OF01AR9JY.51.72.G06.1.454.CMB.1.raw
  modified_base (113)..(113): a, c, t, g, unknown or other
  misc_feature (113)..(113): n is a, c, g, or t
  modified_base (119)..(121): a, c, t, g, unknown or other
  misc_feature (119)..(121): n is a, c, g, or t
tcagcgatcgtatacacgaccggtgctcgatttagctacgactgcaagggaaagggcagcgtcactctgttcccaccctcctctcgtagcactctgagcgggctggcaaggcncatagnnn

SEQ ID NO: 294923 - DNA, 119 bp, Homo sapiens; identical to SEQ ID NO: 294921
  misc_feature: GYAE6OF02GYWAW.51.72.G06.1.454.CMB.1.raw
  modified_base (119)..(119): a, c, t, g, unknown or other
  misc_feature (119)..(119): n is a, c, g, or t

SEQ ID NO: 294924 - DNA, 130 bp, Homo sapiens
  misc_feature: GYAE6OF02G8UVS.51.72.G06.1.454.CMB.1.raw
  modified_base (118)..(130): a, c, t, g, unknown or other
  misc_feature (118)..(130): n is a, c, g, or t
tcagcgatcgtatacacgaccggtgctcgatttagctacgactgcaagggaaagggcagcgtcactctgttcccacctcctctcgtagcactctgagcgggctggcaaggcgcatagnnnnnnnnnnnnn

SEQ ID NO: 294925 - DNA, 117 bp, Homo sapiens
  misc_feature: GYAE6OF02FW2WE.51.72.G06.1.454.CMB.1.raw
tcagcgatcgtatacacgaccggtgctcgatttagctacgactgcaagggaaagggcagcgtcactctgttcccgcctcctctcgtagcactctgagcgggctggcaaggcgcatag

SEQ ID NO: 294926 - DNA, 119 bp, Homo sapiens; identical to SEQ ID NO: 294921
  misc_feature: GYAE6OF02FXWN2.51.72.G06.1.454.CMB.1.raw
  modified_base (119)..(119): a, c, t, g, unknown or other
  misc_feature (119)..(119): n is a, c, g, or t

SEQ ID NO: 294927 - DNA, 124 bp, Homo sapiens
  misc_feature: GYAE6OF02HT60C.51.72.G06.1.454.CMB.1.raw
  modified_base (119)..(124): a, c, t, g, unknown or other
  misc_feature (119)..(124): n is a, c, g, or t
tcagcgatcgtatacacgaccggtgctcgatttagctacgactgcaagggaaagggcagcgtcactctgttcccaccctcctctcgtagcactctgagcgggctggcaaggcgcatagnnnnnn

SEQ ID NO: 294928 - DNA, 256 bp, Homo sapiens
  misc_feature: GYAE6OF01AMMRD.28.87.H10.1.454.CMB.1.raw
  modified_base (255)..(256): a, c, t, g, unknown or other
  misc_feature (255)..(256): n is a, c, g, or t
tcagagtacgctatcacgaccggtgctcgatttagcagtactgcgttgggtttgggacagatttcactctcaccatcagcggcctccagtctgaagatttgcactttatttctgtcaacactatggtgactggcctccgtacacttttggccaggggaccaaactggagatcaaacgaactgtggctgcaccatctgtcttcatcttcccaccctcctcatagcgtactctgagcgggctggcaaggcgcatagnn

SEQ ID NO: 294929 - DNA, 256 bp, Homo sapiens
  misc_feature: GYAE6OF01DV6T5.28.87.H10.1.454.CMB.1.raw
  modified_base (256)..(256): a, c, t, g, unknown or other
  misc_feature (256)..(256): n is a, c, g, or t
tcagagtacgctatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccaccctcctcatagcgtactctgagcgggctggcaaggcgcatagn

SEQ ID NO: 294930 - DNA, 284 bp, Homo sapiens
  misc_feature: GYAE6OF01DB4E1.28.87.H10.1.454.CMB.1.raw
  modified_base (229)..(229): a, c, t, g, unknown or other
  misc_feature (229)..(229): n is a, c, g, or t
  modified_base (273)..(284): a, c, t, g, unknown or other
  misc_feature (273)..(284): n is a, c, g, or t
tcagagtacgctatcacgaccggtgctcgatttagcagtactgcgttgggtttgggacagatttcactctcaccatcagcggcctccagtctgaagtattttgcactttatttctgtcaacactatggtgactggcctccgtactacttttggccaggggaccaaacgtggagatacaaacgactgtggctgacaccatctgttctcacttccgttcccgctatctagntgtcgagtcgtcgtggacgcgggctggacgaaggcgacaagtgnnnnnnnnnnnn

SEQ ID NO: 294931 - DNA, 333 bp, Homo sapiens
  misc_feature: GYAE6OF01C92J8.28.87.H10.1.454.CMB.1.raw
  modified_base (278)..(279): a, c, t, g, unknown or other
  misc_feature (278)..(279): n is a, c, g, or t
  modified_base (281)..(333): a, c, t, g, unknown or other
  misc_feature (281)..(333): n is a, c, g, or t
tcagagtacgctatcacgaccggtgctcgatttagcagtactgcgttgggtttgggacagatttcactctcaccatcagcggcctccagtctgaagattttgcatttttatttctgtcaacactatggtgactggccctccgtactacttttggccgaggggaccaaactggagatacgaaacgaactgtggctgcaccatctgtctcactcctccccgcccctcctcatacgcctacctctggacggcgggcgtgggacgaagggccggactagtgnngnnnnnnnnnnnnnnnnnnnnnnnnnnnnnnnnnnnnnnnnnnnnnnnnnnnnn

SEQ ID NO: 294932 - DNA, 257 bp, Homo sapiens
  misc_feature: GYAE6OF02GJRN6.28.87.H10.1.454.CMB.1.raw
  modified_base (256)..(257): a, c, t, g, unknown or other
  misc_feature (256)..(257): n is a, c, g, or t
tcagagtacgctatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccgccctcctcatagcgtactctgagcgggctggcaaggcgcatagnn

SEQ ID NO: 294933 - DNA, 258 bp, Homo sapiens
  misc_feature: GYAE6OF02F1MEQ.28.87.H10.1.454.CMB.1.raw
  modified_base (256)..(258): a, c, t, g, unknown or other
  misc_feature (256)..(258): n is a, c, g, or t
tcagagtacgctatcacgaccggtgctcgatttagcagtactgcgttgggtttgggacagatttcactctcaccatcagcggcctccagtctgaagattttgcactttatttctgtcaacactatggtgactggcctccgtacacttttggccaggggaccaaactggagatcaaacgaactgtggctgcaccatctgtcttcatcttcccaccctcctcatagcgtactctgagcgggctggcaaggcgcatagnnn

SEQ ID NO: 294934 - DNA, 296 bp, Homo sapiens
  misc_feature: GYAE6OF02H9KKC.28.87.H10.1.454.CMB.1.raw
  modified_base (263)..(264): a, c, t, g, unknown or other
  misc_feature (263)..(264): n is a, c, g, or t
  modified_base (266)..(296): a, c, t, g, unknown or other
  misc_feature (266)..(296): n is a, c, g, or t
tcagagtacgctatcacgaccggtgctcgatttagcagtactgcgttgggtttgggacagatttcactctcaccatcagcggcctccagtctgaagattttgcacttttatttctgtcaacactatggtgactggcctccgtacacttttggccagggaccaaactggagatcaaaacgaactgtggctgcaccatctgtcttcatccttcccgccctccctcatagtccgtactctgaggcgggctaggcaaggcgcatagnnannnnnnnnnnnnnnnnnnnnnnnnnnnnnnn

SEQ ID NO: 294935 - DNA, 256 bp, Homo sapiens
  misc_feature: GYAE6OF01BVCTJ.1.17.B06.1.454.CMB.1.raw
  modified_base (251)..(256): a, c, t, g, unknown or other
  misc_feature (251)..(256): n is a, c, g, or t
tcagacgagtgcgtcacgaccggtgctcgatttagtcgatagtgatcgcgggtctgggacagattacactctcactatcagcagcctgcagcctgaagattttgctaatttattactgtcaacagtattatagtaccctagtggacgttcggccagggaccaaggtggaagtcaaccgactgtggctgcacatctgtctcatcttccgcatctgaacgcactcgtctgagcgggctggcaaggcgcatagnnnnnn

SEQ ID NO: 294936 - DNA, 262 bp, Homo sapiens
  misc_feature: GYAE6OF01DJ4Y5.1.17.B06.1.454.CMB.1.raw
  modified_base (259)..(262): a, c, t, g, unknown or other
  misc_feature (259)..(262): n is a, c, g, or t
tcagacgagtgcgtcacgaccggtgctcgatttagtcgatagtgatcgcgggaagatgaagacagatttcactctcaccatcagcagcctgcagcctgaagattttgcaacttattactgtcaacagtattatagtacccctacgtggacgttcggccaggggaccaaggtggaagtcaaccgaactgtaggctgcaccatctgtcttcatctccgcatctgaacgcactcgtctgagcgggctggcaaggcgcatagnnnn

SEQ ID NO: 294937 - DNA, 283 bp, Homo sapiens
  misc_feature: GYAE6OF02GL5JH.1.17.B06.1.454.CMB.1.raw
  modified_base (279)..(283): a, c, t, g, unknown or other
  misc_feature (279)..(283): n is a, c, g, or t
tcagacgagtgcgtcacgaccggtgctcgatttagtcgatagtgatcgcgggcgtagactttgtgtttctcgtagtctgctttgctcagcgtcagggtgctgctgaggctgtaggtgctgtccttgctgtcctgctctgtgacactctcctgggagttacccgttcactttcggccctgggaccaaagtggatatcaaacgaactgtggctgcaccatctgtcttcatcttcccgccctcctcacgcactcgtctgagcgggctggcaaggcgcatagnnnnn

SEQ ID NO: 294938 - DNA, 290 bp, Homo sapiens
  misc_feature: GYAE6OF02FLNVR.1.17.B06.1.454.CMB.1.raw
  modified_base (279)..(290): a, c, t, g, unknown or other
  misc_feature (279)..(290): n is a, c, g, or t
tcagacgagtgcgtcacgaccggtgctcgatttagtcgatagtgatcgcgggcgtagactttgtgtttctcgtagtctgctttgctcagcgtcagggtgctgctgaggctgtaggtgctgtccttgctgtcctgctctgtgacactgtcctgggattaccccgttcacttcggccctgggaccaaaagtggatatcaaacgaactgtggctgcaccatctgtcttcatcttcccgccatctgaacgcactcgtctgagcgggctggcaaggcgcatagnnnnnnnnnnnn

SEQ ID NO: 294939 - DNA, 519 bp, Homo sapiens
  misc_feature: GYAE6OF01B90AV.11.57.F02.1.454.CMB.1.raw
  modified_base (397)..(397): a, c, t, g, unknown or other
  misc_feature (397)..(397): n is a, c, g, or t
  modified_base (509)..(509): a, c, t, g, unknown or other
  misc_feature (509)..(509): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctagaagtnttttgctagtttattactgtcagcagtataggtaagtggccgtctcacgtttcgggcggagggaccaagggtggagatcgagacgaacgtgtggctgcaccatctgtcttcntcctaccccg

SEQ ID NO: 294940 - DNA, 694 bp, Homo sapiens
  misc_feature: GYAE6OF01CW1J0.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtactacctacgtctcgttacgaacacgaaacctaaacgcgacgacgtcccgcccgtcctcctactactacgttagtggtacactaccaccgaacggcggcctgtcggtcccgtacccacggttacgtcgtagggtcggtcggggttggttcggtacggtacgtacggttcgtacctaccgttccacctactacgtacgagccgaccgtcgtagacgtacgttgtaacggaatttttcgttacgagttttaagtttaccttatcgtaagtacgacgttaagtttaaggtaacggttaagggtcccggtaccttacgtttacccggtttacgggttcggggaaccgggtaaccgtaaacggggtggtaggaaacttaccgaggaaacggtacccgtaagttggggtacgtcgtacgaacctacgttacgttgtacgtttacctcgtccgtttccccg

SEQ ID NO: 294941 - DNA, 540 bp, Homo sapiens
  misc_feature: GYAE6OF01A82CP.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacacttagcctggtaccagacaaaaacctggccaggctccccggctcctcatctatgtgcatccaccaggccgcgtcggtcgtcccacccaggttcagtggcggtggtcgtgggacagtgttcactctcaccatcagcagcctgctagtctagaagtattttgctagtttattacgtgtcagtcagtatagtaagtgcgctacacgtttcggcggagggaccgtaagggtggagatacgaggaacgtaacgtggtggacgtgccaacctagtctacgttcttactacttccgttccccg

SEQ ID NO: 294942 - DNA, 518 bp, Homo sapiens
  misc_feature: GYAE6OF01EN8XK.11.57.F02.1.454.CMB.1.raw
  modified_base (509)..(509): a, c, t, g, unknown or other
  misc_feature (509)..(509): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagcaaaaacctggccagctcccggctcctcatctatggtgcatccaccagggccgctggtcgtcccacccaggttcagtggcggtgggtctgggacagtgttcactctcaccatcagcagcctgcagtctgaagtattttgctagtttatactgtcagctagtatagtaagtgcgctctacgtttcgggacggagggaccaagggtggtaagatacgagacgtaatggtaggctgccacgatctgtcttcntccttcccg

SEQ ID NO: 294943 - DNA, 549 bp, Homo sapiens
  misc_feature: GYAE6OF01B40SM.11.57.F02.1.454.CMB.1.raw
  modified_base (207)..(207): a, c, t, g, unknown or other
  misc_feature (207)..(207): n is a, c, g, or t
  modified_base (267)..(267): a, c, t, g, unknown or other
  misc_feature (267)..(267): n is a, c, g, or t
  modified_base (386)..(386): a, c, t, g, unknown or other
  misc_feature (386)..(386): n is a, c, g, or t
  modified_base (405)..(405): a, c, t, g, unknown or other
  misc_feature (405)..(405): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtacaaaatattaacaactacttagcctggttaccaanagaaacctggccaggctcccaggctcctcatctatgatgactatttagggacggccactggcatcccacctaggttcagtgcaggtggtctgggacagtacttcattctcacatcccgnagcctagcgcctagaagtnttttgctagtttattactgtacaacagcgtagcagcaggcctcggcgaccgttcggaccgtaagggaccaagggtaggaacgtacgaacggcgtaacgtggtacggcgtagaccaccatctcgtcttcattccttcccgctacg

SEQ ID NO: 294944 - DNA, 531 bp, Homo sapiens
  misc_feature: GYAE6OF01DEG7C.11.57.F02.1.454.CMB.1.raw
  modified_base (427)..(427): a, c, t, g, unknown or other
  misc_feature (427)..(427): n is a, c, g, or t
  modified_base (506)..(506): a, c, t, g, unknown or other
  misc_feature (506)..(506): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcaggtgggtctgggacagtacttcattctcaccatccgcagcctagacgcctagaagtatttgctagtttatactgtcaagngcgtagcagcacggcctcggcgtacgttcggaccgaagggaccaagggtgaacgtcaagcgaacgtgtcggctgcaccntcgtgtcttcattccttcccgctac

SEQ ID NO: 294945 - DNA, 524 bp, Homo sapiens
  misc_feature: GYAE6OF01C8P0D.11.57.F02.1.454.CMB.1.raw
  modified_base (369)..(369): a, c, t, g, unknown or other
  misc_feature (369)..(369): n is a, c, g, or t
  modified_base (438)..(438): a, c, t, g, unknown or other
  misc_feature (438)..(438): n is a, c, g, or t
  modified_base (514)..(514): a, c, t, g, unknown or other
  misc_feature (514)..(514): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaactggccaggctcccggctcctcatctatggtgcatccaccgagggccgctggtcgtcccacccgaggttcagtggcggtgggtctgggacagtgttcactcncaccatcagcagcctgcagtctagaagtatttgctagtttattactgtcagcagtatagtaagtggccntctacgtttcggcggagggaccaagggtggaagagtacgaggtacgaacgtggtaggctgccacatctagtcttcntccgttcccg

SEQ ID NO: 294946 - DNA, 515 bp, Homo sapiens
  misc_feature: GYAE6OF01C1Z8D.11.57.F02.1.454.CMB.1.raw
  modified_base (439)..(439): a, c, t, g, unknown or other
  misc_feature (439)..(439): n is a, c, g, or t
  modified_base (499)..(499): a, c, t, g, unknown or other
  misc_feature (499)..(499): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagcaaaaacctggccaggctccccggctcctcatctatggtgcatccaccagggcccgctggtcgtccccacccaggttcaggtggcggtgggtctgggacagtgttcactctcacatcagcagcctgcagtctagaagtattttgctagtttatactgtcagcagtatagtaagtggccnctctacgtttcggcggagggaccaaggtggagatcgagaggactggtggctgcacatctntnttcnttccgtcccg

SEQ ID NO: 294947 - DNA, 541 bp, Homo sapiens
  misc_feature: GYAE6OF01DUFNC.11.57.F02.1.454.CMB.1.raw
  modified_base (151)..(151): a, c, t, g, unknown or other
  misc_feature (151)..(151): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (329)..(329): a, c, t, g, unknown or other
  misc_feature (329)..(329): n is a, c, g, or t
  modified_base (366)..(366): a, c, t, g, unknown or other
  misc_feature (366)..(366): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacggganacatagtgctgacgcagtctccagccacctgtctgtgtctcaggggacagacgcctcctctcctgcacggccgacgtcacgactattagttacacttacgctcggtacagcaaaacctaggcacggctccggctctccatctntgtgcncncacgcgcgcgtcgtcgcncgtcgtcgngcgtcgtcgtcgtcgcgtcgtgtctctctcacactcncncncgtctcgcgtacgtcgtagtatcgtgtcgtagtactactcgtctagtatacgtagtacgtacgtcgtcgtcgtcgtacgtacgtacgtacggtacgtacgtacgacgtacgacgacgtacgtacgtacgtagtacgtcgacgtacgtacgtacgtacgtatctcgtcgtcg

SEQ ID NO: 294948 - DNA, 532 bp, Homo sapiens
  misc_feature: GYAE6OF01AY6JA.11.57.F02.1.454.CMB.1.raw
  modified_base (400)..(400): a, c, t, g, unknown or other
  misc_feature (400)..(400): n is a, c, g, or t
  modified_base (508)..(508): a, c, t, g, unknown or other
  misc_feature (508)..(508): n is a, c, g, or t
  modified_base (520)..(520): a, c, t, g, unknown or other
  misc_feature (520)..(520): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccaccctctcctgcagggccagtcagactattagttacaccttagcctggtaccagcaaaaacctggccaggctccccggctcctcatctatggtgcatccaccagggccgctggtcgtccccacccaggttcaggtggcggtgggtctgggacagtgttcactctcaccatcagcagcctgcagtctgaagtnttttgctagtttattactgtcagctagtatagtaagtggccgctcacgtttcgggcgggagggaccaagggtggagagtcgaagacgtaagtcggtaggctcgcactntctgttacttcncttccgtacccg

SEQ ID NO: 294949 - DNA, 561 bp, Homo sapiens
  misc_feature: GYAE6OF01A2A9T.11.57.F02.1.454.CMB.1.raw
  modified_base (407)..(407): a, c, t, g, unknown or other
  misc_feature (407)..(407): n is a, c, g, or t
  modified_base (413)..(413): a, c, t, g, unknown or other
  misc_feature (413)..(413): n is a, c, g, or t
  modified_base (459)..(459): a, c, t, g, unknown or other
  misc_feature (459)..(459): n is a, c, g, or t
  modified_base (547)..(547): a, c, t, g, unknown or other
  misc_feature (547)..(547): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagactattacgttacaccttagcctggtaccagacaaaaacctggaccaggcctccccggctcctcactctatggtgcatcccaccgacgggccgcgtcggtcgtccccacccgtaggttcaggtggcggtgggtcgtgggacagtgttcactctcacatcagcacgctgcagtcngaagtntttgactagtttacttactgtacagctagtataggtaagtcggtcnctacgtacgttcgggacggagggtaccaagggtggaacgtagtacgaggacgtaacgtgggtagcgtcgcactacgtcttcgtattcngttccgttaccccg

SEQ ID NO: 294950 - DNA, 510 bp, Homo sapiens
  misc_feature: GYAE6OF01EOJM8.11.57.F02.1.454.CMB.1.raw
  modified_base (460)..(460): a, c, t, g, unknown or other
  misc_feature (460)..(460): n is a, c, g, or t
  modified_base (468)..(468): a, c, t, g, unknown or other
  misc_feature (468)..(468): n is a, c, g, or t
  modified_base (506)..(506): a, c, t, g, unknown or other
  misc_feature (506)..(506): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcagtggcggtgggtctgggacagtgttcactctcacatcagcagcctgcaggctgaagatgtggctagtttatactgtcagtcagtattgtgaagctccgctctacgtttcggcggagggccgnggtggagntcgaggacgtaagtggtggctgcctacatctgttcctntacg

SEQ ID NO: 294951 - DNA, 529 bp, Homo sapiens
  misc_feature: GYAE6OF01C1GYU.11.57.F02.1.454.CMB.1.raw
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (481)..(481): a, c, t, g, unknown or other
  misc_feature (481)..(481): n is a, c, g, or t
  modified_base (493)..(493): a, c, t, g, unknown or other
  misc_feature (493)..(493): n is a, c, g, or t
  modified_base (501)..(501): a, c, t, g, unknown or other
  misc_feature (501)..(501): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtggtctggggacagacttnatttcncaccatccgcagccctagagcctgaagattttgctagttttatacttgtacaacagcgtagcagcaggcctcggcgacgttccggccgaagggaccaaggtaggagtanaacgcgaactgnggctgacncactctgtcttacattcctcccgctacg

SEQ ID NO: 294952 - DNA, 620 bp, Homo sapiens
  misc_feature: GYAE6OF01CWIW2.11.57.F02.1.454.CMB.1.raw
  modified_base (265)..(265): a, c, t, g, unknown or other
  misc_feature (265)..(265): n is a, c, g, or t
  modified_base (368)..(368): a, c, t, g, unknown or other
  misc_feature (368)..(368): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggtaccaanagaaacctggccaggctccaggctcctcatctatgatgctatttaggagggccactggcatcccacccagttcagtgcagtggtctgggacagacttcattcncaccatccgcagcctaagcgacctagaagtattttgactagttttacttactacgtacaacgtagtacgtagcgtacgactaacggcccgtccggtaccgaaccggtttccgggacccgtaacgggaaccgtaaacgggtagggaacgtaccgaaacggtaccgtaaaccgttgggtacggtaccggtagacgtaacccgtaagttcccgtacgtttccgttacctacttacccgtttccccgtccttaacg

SEQ ID NO: 294953 - DNA, 532 bp, Homo sapiens
  misc_feature: GYAE6OF01AO5DL.11.57.F02.1.454.CMB.1.raw
  modified_base (375)..(375): a, c, t, g, unknown or other
  misc_feature (375)..(375): n is a, c, g, or t
  modified_base (409)..(409): a, c, t, g, unknown or other
  misc_feature (409)..(409): n is a, c, g, or t
  modified_base (500)..(500): a, c, t, g, unknown or other
  misc_feature (500)..(500): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcagtttaggaggccacgtggcatcccacccaggttcagtggcaggtgggtctgggacagtacttcattccncgaccagtccgacacgcctagacgcctagaagtntttgctagtttattactgtacaactgcgtagcagcaggcctcggcgacgttcggaccgaagggaccaagggtgaagtcaagcgaacgtggngctgacacatctgtcttacatcctccgctacg

SEQ ID NO: 294954 - DNA, 595 bp, Homo sapiens
  misc_feature: GYAE6OF01AIO68.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatccccacccaggttcagtggcaggtgggtctgggacaggacttcacttctcaccatcccgcagccctagagtcctagaacgtattttagctagtttacttactagttacaactagcgtagcagcacggccctccggcgacggttcggaccgtaacgggacctaagggtacggaagtccgaaggacgtaaacgtcggtacggcgttaggacctaccgaacgttccgttacggttacctttaccaatttcccgtttccccggtccctaaccg

SEQ ID NO: 294955 - DNA, 575 bp, Homo sapiens
  misc_feature: GYAE6OF01CS66Q.11.57.F02.1.454.CMB.1.raw
  modified_base (361)..(361): a, c, t, g, unknown or other
  misc_feature (361)..(361): n is a, c, g, or t
  modified_base (426)..(426): a, c, t, g, unknown or other
  misc_feature (426)..(426): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacggggagacatagtgctgacgcagtctccagccaccctgtctgtgtctccaggggacagagccaccctctcctgcagggccagtcagactattagttacacttagcctggtacagcaaaaactggccaggctcccggctcctcatctatggtgcatccaccaggccgctggtcgtcccaccaggttcaggtggcggtggtctggacagtgtcatcncacatcagcagcctgcagtctagaagtattttgctagtttattctgactagtcagtatagtaagngtcgtctacgtacgtttcgggcggacgggtaccaagggttcggaagtacgtacgaacggtacgtaaaccgttggtacgggtctcgggaccctaacccgtacgttaccgtttacggttaccctttacgaccgtttcccgtttaccccccg

SEQ ID NO: 294956 - DNA, 523 bp, Homo sapiens
  misc_feature: GYAE6OF01AYELA.11.57.F02.1.454.CMB.1.raw
  modified_base (442)..(442): a, c, t, g, unknown or other
  misc_feature (442)..(442): n is a, c, g, or t
  modified_base (511)..(511): a, c, t, g, unknown or other
  misc_feature (511)..(511): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggcccgctggtcgtccccacccaggttcagtggcggtgggtctggggacagtgttcactctcaccatcagcagcctgcagtctgaagtattttgctagtttattactgtcagctagtatagtaagtgccgntcacgtttcggcggagggaccaagggtgagatcgagacgaagtggtggctgaccactatctagtcttcnttccgttccccg

SEQ ID NO: 294957 - DNA, 514 bp, Homo sapiens
  misc_feature: GYAE6OF01EAXKN.11.57.F02.1.454.CMB.1.raw
  modified_base (506)..(506): a, c, t, g, unknown or other
  misc_feature (506)..(506): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggcccgctggtcgtccccacccaggttcaggtggcggtgggtctgggacagtgttcactctcaccatcagcagcctgcagtctgaagtattttgctagtttatactgtcagcagtatagtaagtggccgctcactttcgggcggtagggaccaagggtgagatcgagacgaagtgtggctgcacatctgtcttcntcctcccg

SEQ ID NO: 294958 - DNA, 616 bp, Homo sapiens
  misc_feature: GYAE6OF01BI1EQ.11.57.F02.1.454.CMB.1.raw
  modified_base (207)..(207): a, c, t, g, unknown or other
  misc_feature (207)..(207): n is a, c, g, or t
  modified_base (405)..(405): a, c, t, g, unknown or other
  misc_feature (405)..(405): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggaggccacgtggcatccccaccaggttcagtggcaggtgggtctggggacagacttcattctcaccatcccgcacgcctagacgcctagaagtnttttgctagtttattactgtacaacagtcgtagcagcacggccctcgggccgtaccggttcgggacccgtaacggggaccgaagggttaggaacggttacgaaacgggtccggtaaacgttgggttacgggccgttaggaccctacccgtacgttcccgttacggttccctttaccgtaccgtttccccgtttcccccggtcccttaaccg

SEQ ID NO: 294959 - DNA, 527 bp, Homo sapiens
  misc_feature: GYAE6OF01B28OK.11.57.F02.1.454.CMB.1.raw
  modified_base (513)..(513): a, c, t, g, unknown or other
  misc_feature (513)..(513): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaaacctggccaggcctccccggctcctcatctatggtgcatcccaccgaggggccgcgtggtcgtccccaccctaggttcaggtggcggtgggtctgggactaggtgttcactctcaccatcagcagcctgcagtctgaagtattttgcttagtttattactgtcagctagtatagtaagtcggccgctctacgtttcgggacgggtaggaccagggtgagatacgagacgagtgtgctgcacatctntnttcntcctcccg

SEQ ID NO: 294960 - DNA, 536 bp, Homo sapiens
  misc_feature: GYAE6OF01AGUEX.11.57.F02.1.454.CMB.1.raw
  modified_base (402)..(402): a, c, t, g, unknown or other
  misc_feature (402)..(402): n is a, c, g, or t
  modified_base (511)..(511): a, c, t, g, unknown or other
  misc_feature (511)..(511): n is a, c, g, or t
  modified_base (523)..(523): a, c, t, g, unknown or other
  misc_feature (523)..(523): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaacctggccaggctccccggctcctcatctatggtgcatccaccaggggcccgctcggtcgtccccacccaggttcagtgggcggtgggtctggggacagtgttcactctcaccatcagcagcctgcagtctgaagtnttttgctagtttattactgtcagctagtatagtaagtcggccgtctctacgtttcgggacgggtagggacaagggtgagtatcgagacgtaacgtggtggctcgccacntccttgtcttcncgttccgtacccg

SEQ ID NO: 294961 - DNA, 768 bp, Homo sapiens
  misc_feature: GYAE6OF01DY4EO.11.57.F02.1.454.CMB.1.raw
  modified_base (223)..(223): a, c, t, g, unknown or other
  misc_feature (223)..(223): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggcctcccgagggaccacgggagacatagtgctgacgcagtctccagcccaccctgtctgtgtctccgaggggacagacgcccaccctctccngcagggccagtcagtactattacgtacaccgtttacgcctaggtaccagaaccaaaaccgtggaccacggccgtaccccggtctcctcactctagtcggtcgccacgtacccgaccgacgggccgtcgttcggtccgtaccccgacccgtacgggtttacgagggtcggggcggggttgggtccggtaggggaactacgggttacttcccgaacttccgtaccgtaacctactacgacgaccgacgtcccgtgcgtacgttacgtagtaagtttacgtttgactttaacgtttattacgtgtacgtagtacgtaagttaagttacggttaacggtccgggtaccgttccgttaccgggttaccgggtttaccgggggaccgggttaacgggtaaccggtaaggggtacgggtaaagtaaccggtaccggtaaacggtaaccgggttaaaggttcggacggggtaccttaccggggaccctaaccggttaccgtttaccgtttaccgtttacccgtttaacttcccggttcccccgttacccccgg

SEQ ID NO: 294962 - DNA, 594 bp, Homo sapiens
  misc_feature: GYAE6OF01EGJX8.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagcagaaacctggccaggctccagctctcatctatggtgcatccaccagggccactggttcccagccaggttcagtggcagtgggtctgagacagagttcactctcaccatacaacgctgcagtctagaagtatttgctagtttattactgtcagtctaagttaataattaacgtcggtacccgtacggtaccggttaccggacccgaaaggggaacccgtaaagggtaggtaaacggtaccgaaaaccggtaaacgttcggtacggtacgttacggcctaacccgtaagttccgttacgttacctttacctaacgtttcccgttccccgtacccg

SEQ ID NO: 294963 - DNA, 544 bp, Homo sapiens
  misc_feature: GYAE6OF01DY5S0.11.57.F02.1.454.CMB.1.raw
  modified_base (519)..(519): a, c, t, g, unknown or other
  misc_feature (519)..(519): n is a, c, g, or t
  modified_base (533)..(533): a, c, t, g, unknown or other
  misc_feature (533)..(533): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcaggggccagtcagactattagttacaccttagcctggtaccagcaaaaacctggccaggcctccccggctcctcatctatggtgcatccaccagggccgctggtcgtcccacccaggttcaggtggcggtgggtctgggacagtgttcactctcacatcagcagcctgcagtctagaagtattttgacttagtttattactgtctagtctagttataggtaagtgggccgtctactcgtttccgggcgggtacgggacgaagggtgagatcgagacgaacgtggtaggctcgcctaccngttctagtccttcnttccttccccg

SEQ ID NO: 294964 - DNA, 523 bp, Homo sapiens
  misc_feature: GYAE6OF01BN450.11.57.F02.1.454.CMB.1.raw
  modified_base (512)..(512): a, c, t, g, unknown or other
  misc_feature (512)..(512): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtccccacccaggttcagtggcggtgggtctgggacagtgttcactctcaccatcagcagcctgcagtctgaagtattttgctagtttattactgtcagctagtatagtaagtggccgtctcacgtttcgggacggagggaccaagggtggagatcgagacgaacgtgtggctgaccacatctgtcttcnttccgtacccg

SEQ ID NO: 294965 - DNA, 679 bp, Homo sapiens
  misc_feature: GYAE6OF01BJ1MV.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacggggagacatagtgctgacgcagtctccagccaccctgtctgtgtctccgaggggacagacgcccaccctctcctgcgagggccagtcagacttattagtacaccttagcctaggtaccagaccaaaactcgaccaggcctcccggctcctcactctagtggtgcactcccaccgacgggccgcgtcgggtccgtaccccaacccgtaggttcgaggtcgggcgggttcggggtcgtggggactaggttcgttacacgttctaccaccatcgagcacgcctcgactacgttcgtagtaagttagttttcgacgttagttttaacttacgttcgtactaggtactaagttagttaaggttaacgggtcggtccgtcgttaccgtaccgtttcgggggaccgggtaacggggtaacctaaggggtcggtaacgtaacgtaccggaaagtaaccgggtaaacggtcggtaggtcgtcggaccgtaacccgtagtttcccggttcttaccctttcgtaccgttcccgtttaccccgg

SEQ ID NO: 294966 - DNA, 574 bp, Homo sapiens
  misc_feature: GYAE6OF01A5K40.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctatttaggacgggccacgtggccactccccaccgtaggttcagtggcaggtgggtctgggacagacttcattcctcaccatccgcacgcctagcgcctagaagtattttgcttagtttattactgtacaactagtcgtagcagcgacggcctccggcgtaccgttccggaccgtaacgggaccgaagggtacggaacgtacgaacggacgtaacgtggtcggctaggaccacctagtcttcgttccttactacttccttccccgctacg

SEQ ID NO: 294967 - DNA, 585 bp, Homo sapiens
  misc_feature: GYAE6OF01CEJ3K.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggcctccccggctcctcatctatggtgcatccaacgacgggccacgtcggccacccccagccaggttcagtggcctaggtgggtcgtgggacagacttcactctcaccatcagcagcctagacgcctagaggtattttgctagtttattactgtcagcagtctatcacgtggactcgtaccgttcggaccctaagggaccgacgaacgttaaggaaaacttaaacggaaacttcggtacggtactacgggccaaccgtacgttaccgttacggtttaccttactaacctttcccgtttcccccgtacccg

SEQ ID NO: 294968 - DNA, 652 bp, Homo sapiens
  misc_feature: GYAE6OF01CKG4Q.11.57.F02.1.454.CMB.1.raw
  modified_base (286)..(286): a, c, t, g, unknown or other
  misc_feature (286)..(286): n is a, c, g, or t
  modified_base (313)..(313): a, c, t, g, unknown or other
  misc_feature (313)..(313): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagactatagttacacttagcctgtacagacaaaactggcaggcctcccggctccncactctatggtgcatccacgacggccncgtggtcgtcccaccaggttcaggtcggcggttgggtctggggactagtcgttcactcctcaccatcagtcacgcctgctacgttcgtagaagttattttcgacgttaagttttacttaacgttcgttacgagtacgtaacgttaagttaacggtaaggtcgggtacccgtcttaccggttaccggttttcccggggacgggtaacgggtaacccggtaaggggtacgggtaacggtacgtaccgaaacgggtaacgttaaccggtggttacgggcttacgggacctaacccggtacttaccgtacggtttaccttcgtaaccgtttccgttacccccg

SEQ ID NO: 294969 - DNA, 642 bp, Homo sapiens
  misc_feature: GYAE6OF01DWO5E.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccaccctctcctgcagggccagtcagactattagttacaccttagcctggtaccagacaaaaacctggccaggcctccccggctcctcatctatggtgcactccaccgaggggcccgcgtcggtcgtaccccacccgtagggtttccaggtcgggcgggtcggggtcgtggggactaggttcgttcactctacaccatcagcacgcctgctagtcgtagtaagttagttttgacttaagttttacttacgttgtactagtactagttaataagttaacgtcgggcccgtcgtacgtacggtttccgggacgggtaacgggaccgtaagggtggaacgtacgtacgaacggtaacggtaacgttgggtacgggtacgtcggaccctaaccgtacgttccgttacgttaccctttactaccgttcccgttacccccgg

SEQ ID NO: 294970 - DNA, 746 bp, Homo sapiens
  misc_feature: GYAE6OF01BXHKO.11.57.F02.1.454.CMB.1.raw
  modified_base (393)..(393): a, c, t, g, unknown or other
  misc_feature (393)..(393): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtcaaaatattaaacaactacttagcctggttaccaacagaaacctggccaggctcccaggcctcctcatctatgatgctagtttagggacgggccacgtggacactccccaacccgaggttccaggtcggcagggtgggtctgggacagtacttcactttcncaaccctactcccgacacgtccctaaggaccgtacccgttaggtaaacggttagtttttacggacctttaaggtttttaactttaacgttacggttaacctaaaccgtacggtacggttacggacgacggtaccgaacgggtccccggttacccggggtccggtaaccgggtttcccggggaacccggtaaacggggtaaacccggtaaaggggttaccggggaaacggtaccgaaagggtaacccgggtaaacgttacgggtacgggtccgtacggaccccgtaacccgtaacgttcccgtttacgttaccctttaccgttaccgtttccccgtttccccggcccgttaacg

SEQ ID NO: 294971 - DNA, 583 bp, Homo sapiens
  misc_feature: GYAE6OF01A8AI3.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccacctgtctgtgtctccaggggacagacgccaccctctcctgcagggccagtcagactattagtacaccttagcctggtaccagacaaaacctggccaggcctccccggctcctcatctatggtgcactccaccgagggccgcgtcggtcgtccccacccgtaggttcaggtcgggcggtggggtctggggacaggtcgttcactctcaccatcagcagcctgcagtcagtaagtatttgacttagtttattacgtgtcagtctagtatagtaagtcggcgtctcgtacgtttcgggacgggtacgggtacgtaagggtggaacgacgtacgaacggtaacgtaacgtggtacggcttcggacctaccgtaacgttcttcggtacctttcacgttcccgttaccccg

SEQ ID NO: 294972 - DNA, 548 bp, Homo sapiens
  misc_feature: GYAE6OF01CIYJA.11.57.F02.1.454.CMB.1.raw
  modified_base (417)..(417): a, c, t, g, unknown or other
  misc_feature (417)..(417): n is a, c, g, or t
  modified_base (439)..(439): a, c, t, g, unknown or other
  misc_feature (439)..(439): n is a, c, g, or t
  modified_base (538)..(538): a, c, t, g, unknown or other
  misc_feature (538)..(538): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttaccacttagcctggtaccagacaaaaacctggccaggcctccccggctccctcactctatggtgcatccaccgagggcccgcgtcgggtcgtccccacccgtaggttcaggtcgggcggtgggtcgtggggactagtgttcactctcaccatcagcagcctgctagtctgtaagtnttttgcttagtttatactgtcngctagtatagtagtcgccgtctcgtacgtttcgggacggtagggaccgaaggtggagatacgagacgtaagtcggtagcgtgctaccatcctgtactcngttcctcccg

SEQ ID NO: 294973 - DNA, 536 bp, Homo sapiens
  misc_feature: GYAE6OF01D4SXO.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatgtgcatccaccagggccgctggtcgtcccacccaggttcagtggcggtgggtctgggacagtgttcacgtctcaccatcagcagcctgcagtctagaagtattttgctagtttatactgtcagtctagtactagtaagtgccgtctctacgtttcggcggaggaccaagggtcggagatacgagaacgtacgtggtaggctgacacctactctagttccttctacttcccgttaccccg

SEQ ID NO: 294974 - DNA, 572 bp, Homo sapiens
  misc_feature: GYAE6OF01CNRLL.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaaacctggccaggcctccccggctcctcatctatggtgcatcccaccgaggccgctggtcgtcccacccgaggttcaggtcgggcggttcgggtcgtggggactaggtcgttcactctcaccatcagcagcctgctagtctgaagtatttgactagtttattactgtacagtcagttatagtaagtggccgtctacgacgtttcgggacggacgggtacaagggtagagtatacgaggacgtaacgtggtaggtcgtcggacctaccacgttcctcggttactttccgtacgttcccgttaccccgg

SEQ ID NO: 294975 - DNA, 678 bp, Homo sapiens
  misc_feature: GYAE6OF01BABHS.11.57.F02.1.454.CMB.1.raw
  modified_base (207)..(207): a, c, t, g, unknown or other
  misc_feature (207)..(207): n is a, c, g, or t
  modified_base (265)..(265): a, c, t, g, unknown or other
  misc_feature (265)..(265): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaanagaacctgccaggcctcccaggctcctcatctatgatgctagtttagggagggccacgtggcactccccacccgagttcagtggctaggtgggtcgtgggacaggtaccttcacgtttctacgacccactcccgacacgtacctagacgtccgtagaagtagttttgacttagttttaactacttcgtaccaactaggtacgtagcgacgaccgtacggacccgtcgggaccgtacccggttaccgggaccggtaaacgggtaccggaaacggggttacgggaacggttaccgaaacgggtaccggaaaccggttcgggttacgggccgttacggacccggtaacccgtaacgttcccgtttaggttaccctttaccgtacctttccccgtttcccccggtaccttaacccgg

SEQ ID NO: 294976 - DNA, 195 bp, Homo sapiens
  misc_feature: GYAE6OF01DYTQO.11.57.F02.1.454.CMB.1.raw
  modified_base (174)..(195): a, c, t, g, unknown or other
  misc_feature (174)..(195): n is a, c, g, or t
tcagcgagagataccacgaccggtgctcgatttagctcgatatagttgggtttggggggaagaggaagactgacggtcccccaggagttcaggtgctgggcacagcggccctgggctgcctggtcaaggactacttccgtatctctcgctgagcgggctggcaaggcgcatagnnnnnnnnnnnnnnnnnnnnnn

SEQ ID NO: 294977 - DNA, 621 bp, Homo sapiens
  misc_feature: GYAE6OF01COS2C.11.57.F02.1.454.CMB.1.raw
  modified_base (435)..(435): a, c, t, g, unknown or other
  misc_feature (435)..(435): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagacgccaccctctcctgcagggccagtcagactattagttacaccttagcctgtaccagaccaaaaacctggccacggcctccccggctcctcactctagtggtgcactcccaccgacgggccgcgtggtccgtccccacccgtaggttcgaggtcgggcgggttcgggtcgtggggactggtcgttacactcctccaccatcgacgcacgcctgacctagtctagtaagttntttcgtctaagttttaactcttgtctagactaagttataggtaagtcggccgtcttacgtacgtttcgggacggtagggaccgaaggtggaagtacgtacgaagtacggtaacgtcggtaggtacgttcgacccgtaactacgttaccgttcggttactttacccacgtttccccgttaaccccgg

SEQ ID NO: 294978 - DNA, 663 bp, Homo sapiens
  misc_feature: GYAE6OF01EAV7V.11.57.F02.1.454.CMB.1.raw
  modified_base (209)..(209): a, c, t, g, unknown or other
  misc_feature (209)..(209): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcgaggccagtacaaaatattaacactacttagcctgtaccaacagaacctgcagctccagctcctcatctatgatgactagtttaggacgggtccacgtcggcactcccaccgtaggttcgagtcggctaggtcggggtctaggggactacgtacgttctacttcctcacctacgtccgacacgtccgtagacgtccgtaggaacgttagttttacgacgtttaagttttaacttacgttagtaaccaacgtacgtacggttacgacgtacgacgacgggtcccgtaccgggtccgtaccgggttccggaccgtaaacgggaccgtaagggtggtaacgtacgaacggtacgtaaacggtggtacgggccttacggacctaaaccgtcttaccgttcgttacccttacgttacctttccccgttcccgtaccgttaacg

SEQ ID NO: 294979 - DNA, 579 bp, Homo sapiens
  misc_feature: GYAE6OF01CQKD1.11.57.F02.1.454.CMB.1.raw
  modified_base (565)..(565): a, c, t, g, unknown or other
  misc_feature (565)..(565): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagacgccaccctctcctgcagggccagtcagactattagtacaccttagcctggtaccagaccaaaaacctggccaggcctccccggactccctcatcctagtggtgcctactcccaccgacgggccgtcgtcggtcgtccccgaccaggttcagtcgggcggtggtcgtgggactgtcgtcactctacaccatacacgcacgcctgctagtctagaagttgtttgctagtttatcgttgtacgtagtctagttatagtaaggtcggctcgtctacgtttcgggacggtacggacgtagggtgagtacgtacgacgtaggaacgtggtagggcctcggacctacgtactccgttacttcttacncgtttccctccccg

SEQ ID NO: 294980 - DNA, 661 bp, Homo sapiens
  misc_feature: GYAE6OF01BVXYG.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatataacaactacttagcctgtccaacagaacctgccaggctcccaggcctcctcatctatgatgctagtttagggacgggccacgtggccactaccccgacctaggttcaggtggcaggtgggtcgtgggacagtacttcattcctacaccatcccgcacgacctaggacgtctaggaagttacttttggacttaagttttaactttacgtacgttacaacgtggtacgttagcaaggtccgacggtcccgtacgggccgtaaccgggtttccggaacccgggtaaacggggtaccgtaaacggggttcggaaacgtaccggaaacggtaccggaaagttcgggttacggccttaggacccgtaacctagttcccgttacgttacccttacgtaccctttcccgtttccccggaccttaacg

SEQ ID NO: 294981 - DNA, 721 bp, Homo sapiens
  misc_feature: GYAE6OF01CYMEB.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctccgagggaccacgggagacatagtgctgacgcagtctccagccaccctgtctgtgtctccgaggggacagacgcccaccctctccgtgcgacgggccagtcagtactattacgttacaccttagtctaggtaccaagaccaaaaccgtggccgacggccgtcccggcctcctactacttctagtcggtcgacctactcccgaccgacgggcccgtcgtcggtccgtaccccaccgtacggttcgaggtcgggtcggtcgggtcgtggactaggtcgttacactcgtacaccgtactcgacgctacgtccgtgtacgtacgtcgtagtaagttgtttacgtacttaagttttacttacgttacgtacgtacgtacgtaagttaacgttaacggttaacgtccgggtacccgtacgttaccggttaccggtttacggggaaccgggtaaccgggtaccggtaaaggggtcggaacgtaacgtaccggaaacggtaaaccggtaacggtcgggtacggttccgtacggtaccgtaacccgtacgttaccgttacgttaccttaccgtaccgtttcccgttaacccccgg

SEQ ID NO: 294982 - DNA, 592 bp, Homo sapiens
  misc_feature: GYAE6OF01CIINC.11.57.F02.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaaacctggccaggcctccccggctcctcatctatggtcgcactcccgaccgaggggcccgtcgtcgggtcgtccccacccgtaggttcaggtcgggcgggttgggtcgtggggactaggtcgttacactctcacctatcagcacgcctgctagtctagaagtntttgnttagtttatactgtctagctagtatagtaagtcgacgtctacgtacggttacgggcggaacgggaccgtaagggtcggtaaggtatacgaggtacgtaacgttggtcggtacgtggacctactacgttccgttagttccttcctcttcccgttaccccg

SEQ ID NO: 294983 - DNA, 612 bp, Homo sapiens
  misc_feature: GYAE6OF01BMYPO.11.57.F02.1.454.CMB.1.raw
tcagcgagagataccacgaccggtgctcgatttagctcgatatagttgggtttgggggaggaactgctcagttaggacccagacgaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagacttattagtacacgttagcctggtaccagacaaaaacctggccaggctccccggctcctcatctagtggtgcatccaccagggccgctggtctccccgaccaggttcaggtcggcggtgggtctgggacaggttcgttcactcctacacatcagcagtcctgcagttctacgagttaagttttgactacgttttagttacgtgttcacgtctaagttaagttaacgtaaggtcgccgtcgttaccgtacggtttccggggacggtacgggaacctaggggtacgaacgtatccggaaacggtacgaacggttggtacggtcgtacgtacccgaacttacgttccgttcgttacctttcccacgtttccccgttaccccg

SEQ ID NO: 294984 - DNA, 771 bp, Homo sapiens
  misc_feature: GYAE6OF01BQ5AH.11.57.F02.1.454.CMB.1.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtgggaaacagtcaccctctcctgcaggccagtcaaaatataacaactacttagcctgtcaanagaacctgcagctccagctcnatctatgatgctagtttaggacggccagtggaccatccccaccgtaggttccaggtcggacaggttcgggtactaggggacacggtacttcaacgtttcctacaacccgattccccggacaacggtaccccgttaaggacggtacccgttaaggtaaacggtttagtttttacgaaccgtttagtttttaaacgttaccgtttaacggtaccgtaaaacgtacggtaccggttaagaccctaagggtcccgaacggggaccccgtttacccgggggaccgtttaacccgggtttaacccgggaacccgtaaaacccggggggaaccctaaaggggggttaaccggaaacggttacccggaaaacgggcccggttaaacgggttaacggtccggggtaacctaccggggaccctaaccccggtaattcccggttcggtttaccctttacccgtaaccgtttccccgtttaacccccgggcccttaaaccgg

SEQ ID NO: 294985 - DNA, 573 bp, Homo sapiens
  misc_feature: GYAE6OF01CJZTH.11.57.F02.1.454.CMB.1.raw
  modified_base (410)..(410): a, c, t, g, unknown or other
  misc_feature (410)..(410): n is a, c, g, or t
  modified_base (453)..(453): a, c, t, g, unknown or other
  misc_feature (453)..(453): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtacagacaaaaacctggccaggctccccggctcctcatctatggtgcatccaccgagggccgcgtgggtcgtaccccacccgagggttcaggtgggcgggtgggtcgtggggactaggtgttcactctcaccatcagcagcctgctagtctgaatntttgctagtttatactgtcagctagtaatagtaagtcggcctntcgacgtttcgggacggacgggtaccaagggtggagtagtacgaaggaaccgtaacgttcggtaggtcgtcggaccaacctacgtccttcggtacctttctacgttccccgttacccccg

SEQ ID NO: 294986 - DNA, 566 bp, Homo sapiens
  misc_feature: GYAE6OF01E5S2Z.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaaacctggccaggcctccccggctcctcatctatggtgcactccaccgagggccgctggtcgtccccacccgaggttcaggtggcggtgggtcgtgggacagtgttcactctcacatcagcagcctgcagtctagaagtattttgctagtttattactgtcagctagtatagtaagtcggcgtctcgtacgtttcgggacgggtaacgggaccgtaagggtcggagacgtacgaagacggtaacgtggtagggctcggaccactacgttcgttacgttaccttctacgttccgttaccccg

SEQ ID NO: 294987 - DNA, 587 bp, Homo sapiens
  misc_feature: GYAE6OF01E0UGK.11.57.F02.1.454.CMB.1.raw
  modified_base (401)..(401): a, c, t, g, unknown or other
  misc_feature (401)..(401): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagacaaaaacctggccaggcctccccggctcctcatctatggtgcatccaccagggcccgctggtcgtccccacccgaggttcagtggcggtgggtctgggacagtgttcactctcacatcagcagcctgcagtctagaagtnttttgactagtttattactgtcagtctagttataggtaagtggccgtctacgaccgtttcggggacggtaacggggacctaagggtcggaacgagtacgaacggaaccgtaaacggttggtagggaccttgggaccctaaccgtactccgttagttaccctttctaaccgttcccgttacccccgg

SEQ ID NO: 294988 - DNA, 539 bp, Homo sapiens
  misc_feature: GYAE6OF01DZVSM.11.57.F02.1.454.CMB.1.raw
  modified_base (527)..(527): a, c, t, g, unknown or other
  misc_feature (527)..(527): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagacaaaaacctggccaggcctcccggctcctcatctatggtgcatccaccgagggccgctggtcgtcccacccaggttcagtggcggtgggtcgtgggacagtcgttcactctcaccatcagcagcctgcagtctagaagtattttgctaagtttattacttgtcagactagtatagtaagtggccgtctctacgtttcgggcggtacgggacctaagggtggagatacgagacgaacgtgtggctcgacaccattcgtatcttacngttccgtacccg

SEQ ID NO: 294989 - DNA, 635 bp, Homo sapiens
  misc_feature: GYAE6OF01BDABY.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagacttattagtacaccttagcctggtaccagacaaaaacctggaccaggcctccccggctcctcatctatggtgcactcccaccgacgggccgcgtcggtcgtaccccaccgtaggttcaggtcgggcgggtgggtcgtggggactaggttcgttcacctctaccgaccatacgtagctacgcctgcgacgtcgtagtaagttatttgacttagtttacttacgtgtcagtactagttaataggtaacgtcggccgtctacgttaccggtttcgggaccgggtaagggtacccgtaaggggtacggtaagtacgtaccgaaggtaacggtaacgtcgggtacggtcgtcggacctaccgtacttacgttcgttaccttacgtacgttccccgttaaccccgg

SEQ ID NO: 294990 - DNA, 583 bp, Homo sapiens
  misc_feature: GYAE6OF01APPNZ.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattagttacaccttagcctggtaccagcaaaaacctggccaggcctcccggctcctcactctatggtgcactccaccacgggccgctggtcgtccccacccagggttccaggtcggcggtcggggtctgggactagtgttcacgtctcaccatcagcagccctagctagtctcgaagtattttgcttagtttacttactcgtacacgtctaagttagtaacgtagtacgggtccgcttcgtacgtttcggggacggtagggaaccgtagggtaggtaagtatcgaaggaaccgtagtggtagcgtcgaccaacgtctcgttcgttattccgtacttccgtaccccg

SEQ ID NO: 294991 - DNA, 650 bp, Homo sapiens
  misc_feature: GYAE6OF01C9DSN.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattagtacaccttagcctggtaccagacaaaaacctggccaggcctccccggctcctcatctatggtgcatccaccgagggccgcgtggtccgtccccacccgtaggttcgaggtcggcgggtgggtcgtaggggacaggttcgttacacttctcaccatcacgcacgccgtgcagtctaggtaagttagtttttcgacttaagttttaacgttacttgtaccgtagtaccgtaggttaagttaaggttaaggtcgggtcccgtacgttaccgttaacggttttccggggacggggtaccggggtaaccgtaaaggggtggaacggtacgtacgaacggacggtaacgtggtacgggtctacgccgtaaccgtacgttccgttagtttccttacgtcgtttccccgttcccgg

SEQ ID NO: 294992 - DNA, 608 bp, Homo sapiens
  misc_feature: GYAE6OF01EUVKI.11.57.F02.1.454.CMB.1.raw
  modified_base (303)..(303): a, c, t, g, unknown or other
  misc_feature (303)..(303): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctcgaggggacagacgccaccctctcctgcagggccagtcagactattagtacacttagcctgtaccagacaaaaaccgtggccaggcctcccggctcctacactctatggtncactccgaccgcggcccgcgtcggtcgtcccacccgtaggttcaggtgggcgggtggtcgtgggacaggttcgttcacgttctaccactactcagcacgtcctgcagtctgtaagttatttgacttaagttttacttacgtcgtacagtacgtaacgttaagtacgttaaggtcggaccgtcctacgtacgttcgggacgggacggtaacgaagggtaggagacgtacgaacggaacgtaacggtggtggacctcggacctaaccgtacgttcgtacgttacctttctaccgttccgttaccccg

SEQ ID NO: 294993 - DNA, 611 bp, Homo sapiens
  misc_feature: GYAE6OF01D058L.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagacgccaccctctcctgcagggccagtcagactattagttacaccttagcctggtaccagacaaaaacctggccaggcctcccggctcctcatctatggtgcactcccaccagggcccacgtggtcgtccccacccaggttcaggtcggcggtgggtctgggacagtcgttcactctcacatcagcagcctgactagtctagagtattttgcttagtttattactgtctagctaagtattaagtaacgtggtaccgtcgttaccgtaccgtttcggggaccggtaacggggaacccgtaaggggtcgaacggtagtacgaacgggtaaccgtaaacggtggttacggaccgttcgacctaaccgtacgttcgttacgttccctttaacgtcgttccccttacccccggg

SEQ ID NO: 294994 - DNA, 551 bp, Homo sapiens
  misc_feature: GYAE6OF01DN3SG.11.57.F02.1.454.CMB.1.raw
  modified_base (207)..(207): a, c, t, g, unknown or other
  misc_feature (207)..(207): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttaccaacagaaacctggccaggctccaggctcctcatctatgatgctatttagggaggccacgtggcactcccaccaggttcagtggcagtggtctgggacagacttcattctcaccatccgcagcctagacgcctgtaagtattttgactagtttacttactgtactaacagtacgtagcagcacggcctccgggcgtacgttcggaccgaagggaccgaaggtggacgtacgaacgacgacgtgaggtctggactaccattcgtgttccttctacttccttcccgctacg

SEQ ID NO: 294995 - DNA, 541 bp, Homo sapiens
  misc_feature: GYAE6OF01BOVRL.11.57.F02.1.454.CMB.1.raw
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
  modified_base (446)..(446): a, c, t, g, unknown or other
  misc_feature (446)..(446): n is a, c, g, or t
  modified_base (452)..(452): a, c, t, g, unknown or other
  misc_feature (452)..(452): n is a, c, g, or t
  modified_base (489)..(489): a, c, t, g, unknown or other
  misc_feature (489)..(489): n is a, c, g, or t
  modified_base (509)..(509): a, c, t, g, unknown or other
  misc_feature (509)..(509): n is a, c, g, or t
  modified_base (527)..(527): a, c, t, g, unknown or other
  misc_feature (527)..(527): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacacttagcctggtaccagacaaaactggccaggctcccggctcctacntctatggtgcatccaccgacgggccncgtggtctccccacccgaggttcagtcgggcggtggggtctggggacaggttcgtcactcctcaccctatcagcagcctgctagtctagaagttatttgactagtttatactgtcagctagtatagtaggngccgtntcgtacgtttcggacgggacggacgagggtgaagacncgaggacaacgtgacggtcngcactagtctcttacctntacgtcgtaccccg

SEQ ID NO: 294996 - DNA, 585 bp, Homo sapiens
  misc_feature: GYAE6OF01EVXF2.11.57.F02.1.454.CMB.1.raw
  modified_base (309)..(309): a, c, t, g, unknown or other
  misc_feature (309)..(309): n is a, c, g, or t
tcagcgagagataccacgaccggtgctcgatttagctcgatatagtttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattacgttacaccttagcctggtaccagacaaaaacctggaccaggcctcccggctcctcactctatggtncactccgaccgagggccgcgtcggtctccccacccgtaggttcaggtcgggcggtgggtcgtggggactggtcgtctactctcaccatcagcacgcctgcacgttctagtaagtatttgacttagtttattacgtgtacagtctaagtataagtacgtcgtaccgtcggtacgttcggacgtaacgggacgtaagggtacgaacgtacgaaacgtacgtggtacggctacgcacctcttcgtacgttcttacctacttcccgtcccgtctgtaccg

SEQ ID NO: 294997 - DNA, 530 bp, Homo sapiens
  misc_feature: GYAE6OF01DUFKX.11.57.F02.1.454.CMB.1.raw
  modified_base (512)..(512): a, c, t, g, unknown or other
  misc_feature (512)..(512): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagcaaaaacctggccaggcctccccggctcctcatctatggtgcatccaccgagggccgctggtcgtccccacccgaggttcagtggcggtgggtcgtgggacagtcgttcactctcaccatcagcagcctgcagtctagaagtattttgctaagtttatactgtcagcagtatagtaagtgccgtctcgtacgtttcgggcgggtaagggacctaagggtggagtatacgagtacgaagtggtggctgccacntctgtctctcgtctcccg

SEQ ID NO: 294998 - DNA, 775 bp, Homo sapiens
  misc_feature: GYAE6OF01AQ7ZX.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccagggaccacgggagacatagtgctgacgcagtcctccagcccaccctgtctgtcgtcctccgaggggacagacgcccaccctctcctgcgacgggccagtcaagtacttattacgtaccaccttacgcctaggtaccagaaccaaaaaccgtcggaccacggccgtccccggtctccctcactctagtggtgcactccgaccgacgggcccgtcgtcgggtccgtacccccgacccgtacgggtttccgagggttcggggccgggttcggggtccgtaggggaccgtaggttcggtttacctaccgttccgtaccaaccctaacgtccgaacggtccaacggtcccgttacggacctaggttacgtaggtaacgttgttttacgacgtttagttttaacttacgtcgtacgtagactaagttagtaacggttagtccggtaccgtcttaccgttacggtttcggggaccgggtaacgggtaaccggtaaggggtacggtaacggtacgtaccggtaaacgggtaaccggttaacggttcggggttacgggaccgttaccggtaccccgtaacccgttagttccccgtttacggtttaccctttacccgttaacccgtttcccccggtttaacccccg

SEQ ID NO: 294999 - DNA, 664 bp, Homo sapiens
  misc_feature: GYAE6OF01BWNOT.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtacaaaatattaacaactacttagcctggttccaacagaaacctggccaggctcccaggctcctcatctatgatgctagtttaggagggccacgtggcacgtccccacccgaggttccaggtggcaggtcggggtctaggggacaggtacttcactttcctcaccatccgcacgcctagacgtcctaggtaagtattttcgcttaaggttttaattacctgtaccaacgtagtaccggttagacctacggccacgggtccccgttaccgggaccggtaacccggtttccgggaacccgtaaaggggaccccggtaaaggggttacgggaaacgttaccgaaaacggtccggtaaaccgttgggtcgggtacgtccgaccgaacccgtagttccgttggttaccctttcaactttccccgttaccccggctaccg

SEQ ID NO: 295000 - DNA, 595 bp, Homo sapiens
  misc_feature: GYAE6OF01EK7WX.11.57.F02.1.454.CMB.1.raw
  modified_base (299)..(299): a, c, t, g, unknown or other
  misc_feature (299)..(299): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaaatattaaacaacttacttagcctggttaccaacagaaacctgccaggcctcccagctccnatctatgatgctagtttagggacgggccacgtggcactccccaccgtaggttcaagtggactaggtgggtctgggacagtacttcaattcctacaacctatcccgcaagcctaagcgactagaatagtttagacttagtttaacttactgtacaacgagtacgtagacagcgacgccgtccgggacgtaccggttcggaccgaaacgggacctaagggacggaagtcgaaggacgaacgtaggtcggcgtacgaccgtaccagtctcgttacttactacttacccttccgcctacg

SEQ ID NO: 295001 - DNA, 527 bp, Homo sapiens
  misc_feature: GYAE6OF01EP1WN.11.57.F02.1.454.CMB.1.raw
  modified_base (315)..(315): a, c, t, g, unknown or other
  misc_feature (315)..(315): n is a, c, g, or t
  modified_base (429)..(429): a, c, t, g, unknown or other
  misc_feature (429)..(429): n is a, c, g, or t
  modified_base (469)..(469): a, c, t, g, unknown or other
  misc_feature (469)..(469): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctcccggctcctcatctatggtgcatccaccagggccnctggtgtcccaccaggttcagtggcggtggtctgggacagtgtcacgtctcacatcagcagcctgcagtctgaagtattttgactagtttatactgtcagcagtatagtaacgngaccgctcacgtttcggacggtacgggaccgaaggtgganagtcgagtacgaacgtggtaggctgacaccatcttacgtactttcagtcccttacccg

SEQ ID NO: 295002 - DNA, 617 bp, Homo sapiens
  misc_feature: GYAE6OF01BHMBL.11.57.F02.1.454.CMB.1.raw
  modified_base (323)..(323): a, c, t, g, unknown or other
  misc_feature (323)..(323): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
  modified_base (386)..(386): a, c, t, g, unknown or other
  misc_feature (386)..(386): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagtactattacgttacacttagcctggtaccagacaaaaacctggccaggcctccccggctcctcatctatggtgcatccaccgacgggccncgtcgtcgtcccacccgtagtcaggtcggcggtggtcgngggacngtgtacgctcgtcacctntacgagcacgtctaggcagttcaggtaagtacttttgacttaagttattactgtactagtactaacgttataaggttacgtcggaccgtcgttccgtaccggtttcgggaccgggtaacggggacctaaggggttagggaacgtagccaaacgggaaccgtaacggtggttacggcgtaccgtacaacccgtacttcgttacgttactacccttcgttcccgttaccccgg

SEQ ID NO: 295003 - DNA, 709 bp, Homo sapiens
  misc_feature: GYAE6OF01CFTSN.11.57.F02.1.454.CMB.1.raw
  modified_base (151)..(151): a, c, t, g, unknown or other
  misc_feature (151)..(151): n is a, c, g, or t
  modified_base (220)..(220): a, c, t, g, unknown or other
  misc_feature (220)..(220): n is a, c, g, or t
tcagcgagagataccacgaccggtgctcgatttagctcgatatagttgggtttggggaggaactgctcagttaggacccagacggaaccatggaagccccagcgcagcttctcttcctcctgctactctggcctccgagggaccacggganacatagtgctgacgcagtctccagccacctgtctgtcgtcctcgagggacagacgcctaccctctccgngcgagggccagtcagtacttagttacgtaccaccttagccgtaggtaaccacgaacctaaaaccgtcggaccgaggtcccgtccccggctcctactacttcctagtcggtcgccacgtccgaccgacgggccgtcgttcggtccgtaccccgtaccgtacggttctacgggttcgggtcgggttacgggtcgtcgggaacgtacggttcgttacctacgtctaccaaccgtactacgaagtccgacgtccgtacggtcgtacgttacgtagtaagtttcgtttcgtacgtttaagttttaacttacgtagtaccgtagtacgttaagttacgtaggttaacggtccggccttcgttacgttacggttacgggacgggtaacggaaccgtagggtcgtaagacgttacggaaacgtaccgtaaggtcggtaggtcctacgacccgtaccgttacgttcgttacgttccttacctacgttcccgttacccg

SEQ ID NO: 295004 - DNA, 714 bp, Homo sapiens
  misc_feature: GYAE6OF01BMASH.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtccaccctctcctgcagggccagtacaaaatattaacaactacttagcctggtaccaacagaacctgccagcctcccaggcctcctcatctatgatgctagtttacggacgggtcctagtcggactactaccccgtaacccgacggtttacgaggttcggcggtaacggttcggggtcgttacgggggaactaggtacctttcgtactttccgtaccaaccctacgtcccgacacggtacccgttaggaccgtaccgtaggtaacgtttacgtttttcggacgtttacgttttaacttacgttagttaccaacgtacgttacggttaacgacgacggtaccgtcgggcccgttccgggaaccggtaccggtaccgggacccgtaaacggggtaccgtaacgggtacgggaagtaccggaagaccggtaaggtcggtacgggccttagaccgtaccgacgttccgttacgttacttacgtaaccctttccctccccgtacgttacg

SEQ ID NO: 295005 - DNA, 649 bp, Homo sapiens
  misc_feature: GYAE6OF01CNVV8.11.57.F02.1.454.CMB.1.raw
  modified_base (192)..(192): a, c, t, g, unknown or other
  misc_feature (192)..(192): n is a, c, g, or t
tcagcgagagataccacgaccggtgctcgatttagctcgatatagttggggtttgggggaggaactgctcagttaggacccagacggaaccatggaagcccagcgcagcttctcttcctcctgctactctggctcccagggaccacgggagacatagtgctgacgcagtctccagccaccctgtctgtgtcnccgagggggacagacgccaccctctcctgcgagggccagtcagtaactattagtacaccttagcctggacagacaaaactgcaggctcccggctctcatctatggtgacactcccgaaccgacggggccgcgtcggtccgtaccccacccgtagggttcgaggtggggacggtggggtcgtggggaacctagggtactttcaacttcctacaaccctatccgaagcaacggcctggcaggtctaggaaagttagtttagacttaagtttacgttatgtacgagacgtagtaataaggttaagtcgggccctcgtaccgtacgtttacggggacgggtaacgggaaccgtaaggggtagaaggtaattacgaacggtaaacgaaccgtggttcgggacttcggaccaacccgtagttaccgttaggttaccttacggtaattccccggttaacccccg

SEQ ID NO: 295006 - DNA, 610 bp, Homo sapiens
  misc_feature: GYAE6OF01EG9GD.11.57.F02.1.454.CMB.1.raw
  modified_base (376)..(376): a, c, t, g, unknown or other
  misc_feature (376)..(376): n is a, c, g, or t
  modified_base (382)..(382): a, c, t, g, unknown or other
  misc_feature (382)..(382): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattacgtacaccttagcctggtaccagacaaaaacctggccaggcctccccggctcctcatctagtggtgcactccgaccgagggcccgctcggtcgtccccacccgtagttcgaggtcgggcgggtggtctggggacngtgtcnctctcacatcagcacgcctgctagtctagaagtatttgacttagtttattactgtacagctagttatagttaaggtcggtaccgtcttaccgtacggtttcggggacggggtaaccgggtaaccggtaagggtacggaggtacgtacggaacggaacgtaacgtggtcgggtactcggaccctaactagttcccgttgttaccgtttactaccttcccgttacccccg

SEQ ID NO: 295007 - DNA, 635 bp, Homo sapiens
  misc_feature: GYAE6OF01CJF5C.11.57.F02.1.454.CMB.1.raw
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (431)..(431): a, c, t, g, unknown or other
  misc_feature (431)..(431): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccacctctcctgcagggccagtcagactattacgttacacttagcctggtacagacaaaaacctggaccaggcctcccggcctcctcacttctaagtggtcgctactcccacgacgggccgtcgtggtctaccctaccgtaggttcgaggtcgggcggtgggtcgtagggactaggtcgttactactctcaaccancagcngacctgcagtactgaagttatttnagtaagtttatactgtacagtatagttaataaggtaacgtcggtacctaccttacgtaccggtttacgggacgggtaacgggaacccgtagggacggtaagacgtaacgacgggtaacgtaacgttagggtacggtcgttacgacccgtaaccgtaacgttttccgtacggtttcccttaacgttccttaccccggttaccccg

SEQ ID NO: 295008 - DNA, 693 bp, Homo sapiens
  misc_feature: GYAE6OF01DN9QU.11.57.F02.1.454.CMB.1.raw
  modified_base (209)..(209): a, c, t, g, unknown or other
  misc_feature (209)..(209): n is a, c, g, or t
  modified_base (653)..(653): a, c, t, g, unknown or other
  misc_feature (653)..(653): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccaccctctcctgcagggccagtacaaaatattaaacaactacttagccttggtaccaacacgaaacctcggccaggcctcccgacggcctcctcatcctatgtactgacctagtttaggggaccggacctacgtcgggacaccgtaccccaacccgtacgggttcgaggttcggcgtacggttcggggtactggggaacaggtactttcattcccgacaacctcgttcccgactagacccttaggaccgtccgtagtaacgttagttttacaccgtttatttttaacgtacgttacgtaccgtaacgacgtacgtacgcgacgtacgaccggttccgtacccgggtcgtaaccgggttccgacccgggtaaacggggacgaaacggggttaggactaaccggaacggtccgaacgttggtcggcgttacgaccgtaacctnttccgtaccgttccttacgcctttccgtccccgcgttacg

SEQ ID NO: 295009 - DNA, 953 bp, Homo sapiens
  misc_feature: GYAE6OF01BXTZP.11.57.F02.1.454.CMB.1.raw
  modified_base (207)..(207): a, c, t, g, unknown or other
  misc_feature (207)..(207): n is a, c, g, or t
  modified_base (222)..(222): a, c, t, g, unknown or other
  misc_feature (222)..(222): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagactaccgaccggagaaattgtgttgacacagtctccggccacctgtctgctctccgtagggaacncgtccaccctctccngcgacggcctagtaactaaaattacttaaacctaacttacgttacgccttacggttaccaacgaacgtaaaccgtcggaccgacggtcctaccccgaaggccttccctacgtacttacgttaacggtcggtacgaccctacgttaccccgaaccggacggggtacccctaaggtccggtaaccctccccggtaacggtaccgtaacgggtttcgaacgggttcgggaccgttaggggttcggggtaccgttacggggaacctagggtacccgttacgtaacccttcccggtaactaaccctagttacccgacggaccgtaccgtacccggttacgtaccgttaacggttccgtttaaagggttaacgttttaacggtttttacggttaaccgttttttaagggtttttttacccgacgggtttaccgttaacgttaaccggtttaaaggttttaaaccggttaaccggtttaaaccgtttccgggttaaccccctttaaccgggttaacccgttttacgggtttaacccgggaaccccgggttaaacggggtaaaccttaaacgggtaaccttaaacgggtaaaacgttaaacccggtaaaaccgttaccgggttaacgggtttaccgggaccgttaaccctaccggttaacccgtaaccgttttaccccggttaacgttttacccgtaccgtttaccccggttaaccccttccccggtcctttaaaccgg

SEQ ID NO: 295010 - DNA, 671 bp, Homo sapiens
  misc_feature: GYAE6OF01D1UZM.11.57.F02.1.454.CMB.1.raw
  modified_base (317)..(317): a, c, t, g, unknown or other
  misc_feature (317)..(317): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggcctcccgagggaccacgggagacatagtgctgacgcagtctccagccaccctgtctgtgtctccgaggggacaggacgcccacccgtctcctgcgacggccagtcaagtactattacgtacacttagcctgtaccagacaaaaccgtcggccacggccgtcccggcctcctcactctagtggtcncactccaccgacgggccgcgtcggtccgtcccaccgtacggttcgaggtcgggtcgggttgggtcgtgggtacgtagttcgttaccacgtctaccacctacgtcgagcacgtccgtgccgtagtacgtagtaacgtttagttttacgagtttacgtttacttacgtcgtacgtacgtagtagttaagttacggttaacggtcgtaccgttcgtttaccgggttacgggtaccggggtaacgggtaaccggtaagggtacggacgtaagtacggtaacggaagttaacggtggtacggtgtaccggtctaacctagttccgtactttaccgtactccgttcccgtcccgttaccg

SEQ ID NO: 295011 - DNA, 1071 bp, Homo sapiens
  misc_feature: GYAE6OF01B5424.11.57.F02.1.454.CMB.1.raw
tcagcgagagataccacgaccggtgctcgatttagctcgatatagttggggtttgggggaggaactgctcagttaggacccagacggaaccatggaagcccagcgcagcttctcttcctcctgctactctggcctccgacgggaccgacgggagacatagtgctgacgcacgtcctccacgcccaccctgtctgtcgtccgtccggagggacgacgacgcccaccctcctccgtcgcggacgggttttttttttccgacgtacaacgtaacttacgtttaacgttaacctaaccgttacgtccgtacggtaacccgaacgaaaccgtaaaaaacccgttaccgggacccgaaccgggtaccccgttccccccgggtacccttccccttacctaaccgttaccgttaacggttccgggttacggtacctaaccgtacccccgaacccgggtaaccggggggtaccccgggttcccggttccggggttaccccggttacccccccgtaaaccccgggttaaccgggttttaccggtaacggggtttacgggggttaccggggggttacgggggtttccgggtacggggggtaaccggtaacgggtttacggtttaccgtacccgttacccgttacctaacccgtaccgtaaccgtacggtacccggtaaccggtacccggttacggaccttaacgggtttaacccttaaggggttaaaaccgttttcggttttttaaccggaactttttaacggttttttaaacttacccggtttagggtacccttaaacgggttaaccttaaagggtttaaactttaaacggggttaacggggttccccgggtacccggtttcctttacccgggtttaacggggtttaccccgggggaaagggggtaacccgggggttaaaccggaaagggggttaccgggtaaaggtacccgtaaacggttaaccggggtaaacggttaaccgttgggggttaacggtaccggttcggaacccctaacggtaaccgttttcgttaaacccggttttccgtttaccttccccgtttccccgggtaacccccg

SEQ ID NO: 295012 - DNA, 742 bp, Homo sapiens
  misc_feature: GYAE6OF01AXYVV.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccacctctcctgcagggccagtcagtactattagttacacttagcctggtaccagcaaaacctggccaggctccccgactcctcatctatggtgccatcccaccgacggggcccgtcgtcggtccgtccccgacccgtagggttcgaggtcgggtcgggttggggtcgtggggtacgtacggttgttcctacgttctactaccacttcgacggtaccgacgcccgttagacctacggttacgttacggtaaacgtttagtttttacggtaccgtttaaggtttttacctttaacgttcgtttacgtaacgtacgttaacgttaagtttaaaggttaacgggtccgggtacccgtcgtttaaccttacccgggtttaccggggtaaccgggtaacggggtaacccggtaaggggttacggtaacgtacggtaccgtaagggaaaccggtaaacggttgggtaccgggtccgttcggacccctaaccgttaccgttacgttcggttacctttacgtaccgtttcccgttaacccccgg

SEQ ID NO: 295013 - DNA, 752 bp, Homo sapiens
  misc_feature: GYAE6OF01B755F.11.57.F02.1.454.CMB.1.raw
  modified_base (315)..(315): a, c, t, g, unknown or other
  misc_feature (315)..(315): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccgagggaccacgggagacatagtgctgacgcagtctccagccaccctgtctgtgtctccgaggggacagacgcccaccctctcctgcagggccagtcagactattacgttacacctttagcctggtaaccacggacaaaaacctggaccaggcctccccggctccctcactctatggtncactccaccgaggccgcgtgtccgtcccgaaccctaggttcgaggtcgggtccgggttgggtcgtggggaacctagggttcgttacgacttcctaccgtaaccaattccgaagccgtaagccttgaccgtagtcgtagtaagttagttttcgacgtttaaggttttaactttacgtaggtacgaagtacctaaaggttaagtaacggttaaaggtcgggtacccggtactttacccggttaaccggttttacccgggggaccgggtaaacggggtaacccgttaaagggggtacggtaaacgtacgtaaccggtaaacgggtaacccggtaaacggttgggtaccgggtaccgtcggtaacccccgaaaccggttactttacccggttaacgtttacccgtttttacccaaacgtttcccggttttaacccccccgg

SEQ ID NO: 295014 - DNA, 685 bp, Homo sapiens
  misc_feature: GYAE6OF01D96WV.11.57.F02.1.454.CMB.1.raw
  modified_base (99)..(99): a, c, t, g, unknown or other
  misc_feature (99)..(99): n is a, c, g, or t
  modified_base (154)..(154): a, c, t, g, unknown or other
  misc_feature (154)..(154): n is a, c, g, or t
  modified_base (215)..(215): a, c, t, g, unknown or other
  misc_feature (215)..(215): n is a, c, g, or t
  modified_base (226)..(226): a, c, t, g, unknown or other
  misc_feature (226)..(226): n is a, c, g, or t
  modified_base (268)..(268): a, c, t, g, unknown or other
  misc_feature (268)..(268): n is a, c, g, or t
  modified_base (289)..(289): a, c, t, g, unknown or other
  misc_feature (289)..(289): n is a, c, g, or t
  modified_base (411)..(411): a, c, t, g, unknown or other
  misc_feature (411)..(411): n is a, c, g, or t
  modified_base (465)..(465): a, c, t, g, unknown or other
  misc_feature (465)..(465): n is a, c, g, or t
tcagcgagagataccacgaccggtgctcgatttagctcgatataggttggggttgggggaggaactgctcagttaggacccagacggaaccatggaacnccccagcgcagcttctcttcctcctgctactctggcctccgagggaccacggganacatagtgctgacgcagtcctccgacgccctacctgtctgtcgtccacggagggacagacncccacctctcngcacggccagtcagtactaattcgtacacttgccgtgaccanaactaaccgcgaccacgcccncccgctccactctctagtggcctacacctaccgaccggcggccgtacgtcggtcctaccccacggtcggtctagggtcgggtcgggtcgtcggtaggtacgtggtactccgactccactacncgactacgcgctcgtcgactaggtctaagtacgttagtttcacgtttattacgngttccgatagtacgttaagttaacgtgtaaccgggtctccgtaccgttaggttaccgggccgggtaacggaaccgggtagggtaagtacgggtaactaacgggcctaaacggggttaccacggggtttaccgggttcaaacgtttccccaaacccgttagtttacccgttcgttttaaacccggttcctttaacccggttaccctttcccccggaaccgg

SEQ ID NO: 295015 - DNA, 693 bp, Homo sapiens
  misc_feature: GYAE6OF01CJE6D.11.57.F02.1.454.CMB.1.raw
  modified_base (307)..(307): a, c, t, g, unknown or other
  misc_feature (307)..(307): n is a, c, g, or t
  modified_base (363)..(363): a, c, t, g, unknown or other
  misc_feature (363)..(363): n is a, c, g, or t
  modified_base (413)..(413): a, c, t, g, unknown or other
  misc_feature (413)..(413): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggcctccgagggaccacgggagacatagtgctgacgcagtctccagcccaccctgtctgtgtctccgaggggacaggacgcccacctctcctgcagggccagtcaagacttattacgtacacctgctggtaaccagacaaaactggccaggcctccccggctcctcactctagtggngcactcccgaccgacggccgtcgtcggtctaccccgaccgtaggtccgaggtcggnggggttcggtcgttgggactaggttcgttacgacttccgtaccaaccgtntacgacgtccgaacgttcccgagtacccgaagtttcgtaacggtaagtttactttttcggactttaacgtttaacggtttacttggtacgttaacgagtttaacgtttagtaaacgggttaagttccggtacggtaccgttaccgtttacgggttaccgggaccggggtaacggggaactaacggggtaggtaggaagttacgaacggagtaaccgtgggtcgacttcggacctaccggtattcccgtacgtttacctccttaattccccgggttaaccc

SEQ ID NO: 295016 - DNA, 717 bp, Homo sapiens
  misc_feature: GYAE6OF01CIQW4.11.57.F02.1.454.CMB.1.raw
  modified_base (153)..(153): a, c, t, g, unknown or other
  misc_feature (153)..(153): n is a, c, g, or t
  modified_base (474)..(474): a, c, t, g, unknown or other
  misc_feature (474)..(474): n is a, c, g, or t
  modified_base (478)..(478): a, c, t, g, unknown or other
  misc_feature (478)..(478): n is a, c, g, or t
tcagcgagagataccacgaccggtgctcgatttagctcgatatagttgggtttgggggagaactgctcagttaggacccagacggaaccatggaacgccccagcgcagccttctcttcctcctgctactctggcctccgagggaccacggganacagtagtgctggaacgctaagtcctccgagcccacccgttgtctggtcgtactccgggagggaccaggaccgccctaaccctcgtccctgaccgaacgggtccaagtccaacgtaacttacttaacgtacctaccgttgcccttaggtaaccacgtaaccgaaaaaccgtcggacccgacggcccgtacccggtacctcctactactaccgtatcggtcgctacctccgacggcggtccgcgtgtaccgtaccctacgtcgttcgaggtcgggtcggtggtcggtaggtacgtacggtacgttcgtactcgcaactcganacgntaccgctgaccgtagtacgtagtaagttattcgttaactaagtttataccgttcgtaacgtacggttaataagttaaggtaaacgtaacgggtccgtcgtacctttacgtaccgggtacgggtcgggtaaaccgggtaaagagggttacggaagtaaccgtagaacggtaacctagggtacgtggacctacgggtacccagtacgttccgttaatcgttaacctccttcccggtaaccc

SEQ ID NO: 295017 - DNA, 740 bp, Homo sapiens
  misc_feature: GYAE6OF01A5IK9.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagcccaccctctcctgcagggccagtcagactattagtacaccttagcctggtaccagacaaaaacctggccaggcctcccggctcctcatctatggtgacactcccgaccgacgggccgtcgtcggtccgtccccacccgtacggttacgaggttcgggccgggttggggtcgtaggggtacgtaggttcgtttaccgaccgttcctaccgaaccctactacgaacgccgacgtcccgttagccgtagtttaccgtaggtaaacgttagtttttacggacgtttaacgttttaacgtttaccgttcggttaccgtaaggtaccgtaaaggtttaagtttaacgggttaaacgggtcccgggtaaccgtccgtttacccgttaaccgggttttaccggggtaaccggggtaacgggtaaccggtaaggggtacggaaggttacgtaacgtaacggaacggttaaacgtgggttaacggcgtcgacctacccgtagttacccgttgttaccctttcgtaaccgttcccgttaccccg

SEQ ID NO: 295018 - DNA, 664 bp, Homo sapiens
  misc_feature: GYAE6OF01AXIS4.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagcccaccctgtctgtgtctccgaggggacagacgcccaccctctcctgcgagggccagtcagactattagtacacctagctcggtaccacgacaaaaccgtacgccgacgccgtccccgcctcctcactctagtggtgcacaccgaccgacgggccgcgtcggtccgtccccgacccgtacggttcgtacggtgggtccggggtcggggttcggttcggggacgtaacgggttcgtttaccgtaccgtccgttccaacccgtacgtcgtaacggaccgaaccggtcccgttacgacgtaacgtttaccggtagtaaggtttacttttgtacgttaattttaacgttactcgtaactaacgtaagttagtacggttagcggccgtctccgtacggttcggacggggacggaacgtaggtaggagtctaggacgacgtaggtcgtcggtacgtcgacctactgtcttcgtctactccgttcccgtcccgtac

SEQ ID NO: 295019 - DNA, 717 bp, Homo sapiens
  misc_feature: GYAE6OF01CHJ48.11.57.F02.1.454.CMB.1.raw
  modified_base (192)..(192): a, c, t, g, unknown or other
  misc_feature (192)..(192): n is a, c, g, or t
  modified_base (703)..(703): a, c, t, g, unknown or other
  misc_feature (703)..(703): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggcctcccagggaccacgggagacatagtgctgacgcagtcctccagcccaccctgtctgtntctccgaggggacagacgcccaccctctcctgcacgggccagtcagtactattagttaccaccttagcctaggaccacgacaaaaccgtcggccacggcctccccggctcctcactctagtcggtacgccactcccgaccgaccggggccgtccgttcgggtcctacccccgtacccgagggttaccgacgggttcgggtcgggttcggggtcggtggggaacctggtcggttcaccgttccgtccaccgtataccgacgaccgacgtccgtacgacctagttccgtaaggtaacgtttacgttttacgacgtttaacgtttttacgtttacgttacggttaacgtacgtaccgttaaaggttaacgttaaagggtttacgggtaccggtccggtaccttaccggtttaccggtttccgggggaacgggtaacgggttaaccgtaggggtagaacgtacgtagaacggtacgtacgttggtcggactcgaccacgtcttcgtcgtacttcncgttcccgtacccg

SEQ ID NO: 295020 - DNA, 619 bp, Homo sapiens
  misc_feature: GYAE6OF01EEMGG.11.57.F02.1.454.CMB.1.raw
  modified_base (429)..(429): a, c, t, g, unknown or other
  misc_feature (429)..(429): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattagtacacttagcctggtaccagacaaaacctggaccacggcctccccggtctcctcatctatggtgcactccgaccgacgggccgcgtcggtcgtccccaccgtaggttcaggtggcgggtgggtcgtggggactaggtcgttaccactctccaaccgatcgacgcacgcctgctagtctagtaagttntttagcttaagtttacttacgtgtactagacgtaagttaacgtaagttaaggtcggtccgtcttaccgtacggtttcgggacgggtacgggtaacgtaagggtaggaagacgtacgaaggacgtaacgtggtacggcgtacgaccgtacctacttccgttacgttaccttcgtccgttcccgttaccccg

SEQ ID NO: 295021 - DNA, 728 bp, Homo sapiens
  misc_feature: GYAE6OF01CGOGN.11.57.F02.1.454.CMB.1.raw
  modified_base (428)..(428): a, c, t, g, unknown or other
  misc_feature (428)..(428): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggcctcccagggaccacgggagacatagtgctgacgcagtcctccagcccaccctgtctgtgtctccgaggggacagacgcccaccctctcctgcgaggccagtcagtacttagttacgtacaccttagccgtagaccagaaccaaaaccgtcggaccgacggccgtccccggctccctctactcgtagtcggtgcctactcccgaccgacgggccgtacgtcgggtccgtaccccgaccgtacggttcgacggtcgggtcgggttcgggtcggtcgggacgtaggttccccccgttntacctcgtaccacctagtacgacgccgacgtccgtagaccgtacgtacgtaggttaagttacgttttacgtaacgtttacgttttaacgtttacgtcgttacgaacggtacgtaagtttaagttaaggtaacgggtccgtaccgttcttaccggttcgggtttaccggggacgggtaacgggtaaccgtaagggtcgtaaacggtcgtacggaaaccggaacggttacggtcggttcggaccgtcgtacccacgttacgttcgttccgttacccttacgttcccgttccccgttacccgg

SEQ ID NO: 295022 - DNA, 856 bp, Homo sapiens
  misc_feature: GYAE6OF01DDYT3.11.57.F02.1.454.CMB.1.raw
  modified_base (221)..(221): a, c, t, g, unknown or other
  misc_feature (221)..(221): n is a, c, g, or t
tcagcgagagataccacgaccggtgctcgatttagctcgatatagttgggtttgggggaggaggaactgctcagttaggacccagagggaaccatggaacgccccagctcagtcttctcttcctcctgctactctggctcccagactaccacggaagtaattgtgttgacacacgtccgtccggcctacccgtgtctggccgtcgtccggtaggggaaacncgtccctaccctctcctggaccgacggcctaagtaaaccaaaattaacttaaacctaaaccttacgttacgtccgttacggttaacccaaacgaacgtaaaccgtcggaacccgacggtcctacccgacggtcccttccctactacgttactacgttagacgttacgtaccggtttaaggttacggggaccggtacccgtacgtacggtaccctacccgtaccccgtacgggttacggttcgacggtcggacggtacgggtcgggtcgtacgggacttacgtacctttcgtaacttcctaacgaccctacgtcccgactaccgtaccgtacggtaccgtaccgttaaggttaactttcgtttacgtacctttttaagttttaccgttacgtcggttaaacaaccgggtaggtaccgttacggacggtaccggacccgggttaaccgggccccggtaccgggttacccggtaccggttaccgggaacccgggtaaacggggtaccgtaacggggtaacgtacggaaacgtaccggtacgggtaacggcggttacggtcctacgtaacctaaccgttcgttaccggtttactttacccggacctttaccgggttcccccctacggtcctttaccggg

SEQ ID NO: 295023 - DNA, 981 bp, Homo sapiens
  misc_feature: GYAE6OF01DBBUF.11.57.F02.1.454.CMB.1.raw
  modified_base (153)..(153): a, c, t, g, unknown or other
  misc_feature (153)..(153): n is a, c, g, or t
  modified_base (560)..(560): a, c, t, g, unknown or other
  misc_feature (560)..(560): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctcggcctccgagggaccacggganacatagtgctcgacgctacgtcctacccgacgccctacccgtggtccttggtcgtacccgtaccggagggggaaccacggaccgcccctacccttccgtccgtcggaccgacggggccctaggtacacgtaacttagttaacgtacctacttacggacctcggtaacccaacgaaaccaaaaccgtcggtaccgaccgggtcccgtccccggtcccttccgtactacgttcgtaacggttcgggtacgacctacctaccccggaaccggcccgggtccgtcgtaccggtcccgtaccccaccggtcgggttaccgtagggtcgggtccggggttggggtaccgggtaggtaacggttcggtttacgttacccaccgtttccgtaccctaacgtacctacgaaccggngttacccggcgtacggtccggtacggttctacgggttaaacgtttgtttaacgggttacctttttaggtttaaccgtttagtcgggtaacgttaccgggtaagttaaaggttaacggttaaacggggtttacggtacccgggttacccggtttcccgtttaacgggtttacccgggggtttaaccgggggaaccgggggttaaaccgggggttaaacggggttaaaccgggggaacgggtaaccggttacgggtaaacccggggtaaaccgttaacccgggggttaaaccgggtttcgggttaaccggggttaccccgtcggtaaaccccgggttaacccgtttaacggtttcccgggtttaccccgggttttaaccttttaccccccggttaccggtttaaccccccccggtttaccccg

SEQ ID NO: 295024 - DNA, 681 bp, Homo sapiens
  misc_feature: GYAE6OF01AIR7Z.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccagggaccacgggagacatagtgctgacgcagtctccagccaccctgtctgtgtctccgaggggacagacgcccacccttctcctgcgacgggccagtcagactattagttacaccttagccttggtaccagaccaaaactcggaccaggcctccccggctcctcactctatggtcgcactcccacgacgggccgctgggtcctaccccgacccgtaggttcgaggtcggcgggttcgggtcgtggggactacgggttgttccacgtcctacacctatccacgcacgcctggcctagtctaggtaacgttagttttacgacgtttagttttacttacgtaggtttacaggtcgtacgtacgttaactaccggtaacgtggtaactcccgtaaccgggttccgaaccggtaaacgggacctaacggtaacgtaaaggtaaaacttaaccggaacgttacggtacgggtcttacggacccgtaacgttacgttaccttcggtttacccttacgttaacccgtttcccctttacccgcgttaacccg

SEQ ID NO: 295025 - DNA, 788 bp, Homo sapiens
  misc_feature: GYAE6OF01DCCHJ.11.57.F02.1.454.CMB.1.raw
  modified_base (211)..(211): a, c, t, g, unknown or other
  misc_feature (211)..(211): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagactaccaccggagaaatttgtgttgacacagtcctccggccaccctgtctgcgtctcgtaggggaaacngtcaccctctcctgcgacgggccaagtactaaaaatattaaaccaaacttacgttacgaccgttggttacccaaacacggaaaacctcggacccgacggtcccgtaccgaacggtccttccctacctattaccgttaagttagacttcggaacgttaacgttttacggggaacgggtacctaacggttccgggaaccaccgttccccccgtaaccccgttaaggggttactacgggtacgggcgttacgggtacggggttcggtacggggaacctaaggttacctttacgtaacgttcctacctaccgtaactcccgaacgtacggtccctaaggcgaccgttagtacggttacttttacggatttacgtttattaacgttacgtacctaacgtacgtaccggttacgcggtaacgcggtacccggaccgttcggaacccggttaccggttacggaaccggtacggaaccggtaaggggttacggacgtacgaaacgtcgggtaactggtacggtcctacggtacacctacgttcgttaggttcccttacgttaccttcccgttcgtcccttaacgg

SEQ ID NO: 295026 - DNA, 885 bp, Homo sapiens
  misc_feature: GYAE6OF01CDYJX.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctccagataccaccggataaattgtgttgacacagtcctccggcctaccctgtctgcgtctccgtagggaactagtccaccctctccgtgcgacggccataactaaaatacttaaacactactacgccttacggtaccaacaacgtaaccgtcggaccgacggtcctacccgacggtccctacctctaacttaccttagtacgtacgtacggtacgtttaacgggtttaacgggaccgggtacccgtacggtcggtacctacccgttacccccgtaaaccggttacgggtttacgaccgggtacggtaccggtacggggtttacggggtccgtaacgggggtaactaacgggttaacctttaccgtaacgtttacctaacccgtaccgtaaccgtacccgtaccgtaccggtacctaacggtacggtacccgtacgttaacggtttaacgtttacgtactttaacgtttaactttaccgtacgtaacctaaccgtaaggtaccgttaagaccgttacggaccgtaccgggtccccggtaccgggtacccggtaccgggtacccgggtaaaccggtaaccgggtaaccgggtaacgggtaacgtaccggttaaaccggacgttaaccgggtaccggttacgggtacggttacccggtaccgaacccgttaacggtaccgtttacccgggttacgtttaccccgttaaccctttaccccggtttcccctttaccccggtacctttaacccgg

SEQ ID NO: 295027 - DNA, 760 bp, Homo sapiens
  misc_feature: GYAE6OF01DZ92G.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccgagggaccacgggagacataggtgctgaacgcagtctccagcccacctgtctgtcgtctccgaggggacaggacgccctaccctcgtcctgcgacgggtccagtcaagtacttaattacgtaccacttgcctagtaccaagaaccaaaccgtggaccacggtccctccccggcttcctcacgtactagtgatgacttaaggttacggaacggtccacgtcggacctaccgtccccgaaccgttacggtctacgggtcggaacgttgggtccggtacgttagggaaccgtacgttaacgttctacctaccgtacccgaacctaacggtcccgtaactaccggtaccttaaggaaccgtccttagggtaacgttagttttcgaacgtttaacgtttaagttccaagttacccgtaacgtacggtcgtaaccggtacgcggttacccgacggttccccgggtcgggacccggtttaccgggtaccggtaaacccggtaacggggaaccgtaggggtaacgaacggtaccggacgtaggttaacccgtggtaccggaacgtcccggaacccttaggttaccgttccggtttattaccccgtttaacgtcccgttccccggtacccg

SEQ ID NO: 295028 - DNA, 702 bp, Homo sapiens
  misc_feature: GYAE6OF01DUQ30.11.57.F02.1.454.CMB.1.raw
  modified_base (317)..(317): a, c, t, g, unknown or other
  misc_feature (317)..(317): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggcctcccgagggaccacgggagacatagtgctgacgcagtctccagcccacctgtctgtcgtctcgagggacagacgccaccctctccgtgccgagggcccagtcagtactacttagttacaccttcgctcggaccagaaccaaaactcggccaggcctacccggctccgactactctagtggcncactccacgacggcgtacgtcggtacctcccgacccgtaggttcgacggtgggtcgggttagggtccgtaggggacctagggtcgttacaccttccgtaccaacgtactacgcgtacacggcctacggacctacggttactaggaaacgtttggttttaccgtaagtttaacgtttttactaacgtttcggtactacgtactaaggtaacgttaacgtacggttacgggcccttcggttaccgttacggtttcggggaacggtaaccggggtacgtaacgggtagggaattacgtacgacggtaaggttaacctcggggtagtaccgtcggaccctacttaacggtttcgttacttaccgtttacctacggttccccttacccgg

SEQ ID NO: 295029 - DNA, 757 bp, Homo sapiens
  misc_feature: GYAE6OF01A097J.11.57.F02.1.454.CMB.1.raw
  modified_base (156)..(156): a, c, t, g, unknown or other
  misc_feature (156)..(156): n is a, c, g, or t
  modified_base (171)..(171): a, c, t, g, unknown or other
  misc_feature (171)..(171): n is a, c, g, or t
  modified_base (208)..(208): a, c, t, g, unknown or other
  misc_feature (208)..(208): n is a, c, g, or t
  modified_base (574)..(574): a, c, t, g, unknown or other
  misc_feature (574)..(574): n is a, c, g, or t
  modified_base (749)..(749): a, c, t, g, unknown or other
  misc_feature (749)..(749): n is a, c, g, or t
tcagcgagagataccacgaccggtgctcgatttagctcgatataggttgggtttgggggaggaggaactgctcagttaggacccagagggaaccatggaacgccccagctcagcttctcttcctcctgctactctgctcccagactaccgacgganaattgtgttgacacngtcctccggccaccgtgtctgcgtctcgtagggaacncgtccacctctccgtcgcgaggtaccagtacaaaagttacttaaccaacttactacgccttaggtaccaaacgaacgtaaccgtcgaccgtacggccttacccgaggtcctacctactacttcgtaactggtactcgtacgtagtttacgggacgggtaccacgtcggactaccgtaccccgtacgtacggttacgcggtgggaccgtaggtcggggtacgtacggggtaactacgttacgtactacgttccctaacaccgtacgtccggcaacgtaccgtaacgtaccgtactagtaacgttcgttttacggactttagtttaacgttaacgttacccgtagtaaccgtaacggtcggttaacgngttacccggacgttacccggtccggtacccgggtaacggtacccgggttaccgggaacccggtaaggggaccgaacggggtaaggtacggtaacggaggtaacggtaaccgtggtaacgggctaacggtacgcccttagggttcctacggttccgttactcccggttcctccgtnttacccgg

SEQ ID NO: 295030 - DNA, 731 bp, Homo sapiens
  misc_feature: GYAE6OF01CCI9Z.11.57.F02.1.454.CMB.1.raw
  modified_base (205)..(205): a, c, t, g, unknown or other
  misc_feature (205)..(205): n is a, c, g, or t
  modified_base (305)..(305): a, c, t, g, unknown or other
  misc_feature (305)..(305): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccacctgtctgtgtctcgaggggacagacnccaccctctcctgcagggcctagtcagactattagtacaccttagcctggtacagacaaaactggccaggcctcccggcttacctcactctaatgagtcncactaccgaaccgagggacccacgttcggaccctaaccccgaggaccctagggttccgtaacggtcggtcgaacgggtcgggggttcgtacgggggaactacggtaacctttaccgtaaccgttcccgtaccgaaccgtaacttacgaacggtacctaacggtacccgttaagggacgttaccccgtaagggtacgggtttaacgtttttacggacctttaacggttttttaacgtacccgtttaggtacgtacggacgtaacggtcgtaccttacggcgttaccggacttaccgtacccgtttccgggaaccgaacgggtaccaacggtaacgtacggttaaaacttaaaccggacgttacgggcggttacgtacggacctaaccgtacgttctacggttccttactaccgttccgtttaccccg

SEQ ID NO: 295031 - DNA, 675 bp, Homo sapiens
  misc_feature: GYAE6OF01B27ZK.11.57.F02.1.454.CMB.1.raw
  modified_base (619)..(619): a, c, t, g, unknown or other
  misc_feature (619)..(619): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggcccaccctgtctgcgtctccgtagggaacagtccacctctcctgcgaggccagtacaaatataacaactacgtagcctagtaccaacaacgaacctcggacacggccgtacccgaggcctcctcacgtctatgatacgctagtttacgggacgggcctacggtcggacctacctaccccgaccgtacgggttaccaggtcggtacgtaggtcggtcgtgggacgacgtacgttactacttacgtaccgaacctcgtaccgacgtaccgtacctagaccgtacgtacgtaagtttacgtttacgtacgtttagtttacttacgttaactaccgaacgtacggtacgtacgtacgacggaccgtaccggtaccgtacgacgtcggtaccgtccgggtaacggacggaaccgtagggtaacggacgtaacgaacgaccgtaagnggttcgacgtgaccgtacgtacgtccgtgttacgtcttaccgtccgtcccgtaccg

SEQ ID NO: 295032 - DNA, 764 bp, Homo sapiens
  misc_feature: GYAE6OF01BUJQJ.11.57.F02.1.454.CMB.1.raw
  modified_base (208)..(208): a, c, t, g, unknown or other
  misc_feature (208)..(208): n is a, c, g, or t
tcagcgagagataccacgaccggtgctcgatttagctcgatatagttggggtttgggggaggaggaactgctcagttaggacccagagggaaccatggaagccccagctcagcttctcttcctcctgctactctggctcccagataccacggagaaattgtgttgacacagtctccggccacctgtctgccgtctccgtaggggaacngtccacctctcctgcacgggcctagtactaaaatacttaaacaaccttacgttacgccttcggttaccaaacaacggtaaaccctcggacccgaacggcctcccgaggtcctacctcattctactagactcggtataggtttacgggacggacaacgttcgggaccaccgtccccgaaccgttacggttaccgtacggtcgggtacggtacgggttcgggtcggtaacgggaactacgggtaccttacggtactttcccgtaccgaccgttaccgcccgtacgtaaccgtccgtaacgtacgtaccgtaaggttaacgttcggtttacgtactttaacgttttacttaacgttagtaccgtaacgtacgtacgttacgcaacgggtcgtacccggccggtcccgggtccgggttaaccgggtccggaaccgggtaaaccggggtaaccggaaggggtaacgtacggacggtaaacgtaccggtacgtacgggtcggtaccgtcgacgtacctccgttacgttccgtacttccctaacgttccctacccgtgtaccg

SEQ ID NO: 295033 - DNA, 758 bp, Homo sapiens
  misc_feature: GYAE6OF01B2BQO.11.57.F02.1.454.CMB.1.raw
  modified_base (313)..(313): a, c, t, g, unknown or other
  misc_feature (313)..(313): n is a, c, g, or t
tcagcgagagataccacgaccggtgctcgatttagctcgatatagttgggtttgggggaggaggaactgctcagttagggacccagagggaaccatggaacgccccagctcagcttctcttcctcctgctactctggctcccagactaccaccggagaaattgtgttgacacagtctccggccaccctgtctgccgtctccgtaggggaaccagtccacccttctccgtgcgaggccagtacaaaatattaacaactacttagtccgtggttaccaacacgaaccgtggccgacggcctacccgaggcttccncatctatgatgactagttaaggcggacctcgtggccacctcccgaccgtagggttaccaggtcggcgtaacggttgggtcgtacggggaactacggtaccctttgtaacgttacccgtacctaaccgtaccgtaccggtaaccgtacgtaaccgttacggaccgtaccgttacggtaaacggtttacgttttacggtaactttaacgggttttaaccttaacgtttcgtaaacgtaaccgttacggtaaccggtaaggccgtaacgacccggtaacgggtcccttaccggggtacccggtaccggttaccgggaaccgtaaacggggtaccgaaggttaacgggaacgtacggtaacgggaacccgtagttacggtacggtaccgtaggaccacccggttatcgtttccgtacttcttaacccgttccttacccggtcctacggg

SEQ ID NO: 295034 - DNA, 747 bp, Homo sapiens
  misc_feature: GYAE6OF01C3VLH.11.57.F02.1.454.CMB.1.raw
  modified_base (157)..(157): a, c, t, g, unknown or other
  misc_feature (157)..(157): n is a, c, g, or t
  modified_base (562)..(562): a, c, t, g, unknown or other
  misc_feature (562)..(562): n is a, c, g, or t
  modified_base (596)..(596): a, c, t, g, unknown or other
  misc_feature (596)..(596): n is a, c, g, or t
tcagcgagagataccacgaccggtgctcgatttagctcgatatagttggggtttgggggaggaactgctcagttaggacccagacggaaccatggaagccccagcgcagcttctcttcctcctgcctactcgtggcctcccgagggaccacgggganacatagtgctgacgcagtctccagccctacctgtctgtcgtccgtacgaggggacagacgccctacccttctccgtgcgacgggtcctaaggtcaacgtaccttagtttaacgttacctaccgttacgccgttacggaacctaacgaaacctaaaaccggtcggaccgtaacggcccgttaccccggctcccttactaacgtcgttaacggtcggtaccgtactaaccgttcccgaccggacgggtcccgtaggtccggtcccgtaaccccgtacccggtaggtttaccgacgggtcggtcgggttggtaccggtacggtactggtttaccgtccgtaccgttaccgacgtacctagtccgaacgtcgtacggcccttagaccgtagttacgtagtaacggtttntttaggtacctttgtttaaacgtttcacgtaganacggtaagttagtaacggtcggcgtcgtccgttacgtaccgggtacggggacgtaacgggaaccttaggacggtaactacgacggtaactacggttggtactcggactcgaccgtaactcgttacctaggttccctactcgttcccctacg

SEQ ID NO: 295035 - DNA, 723 bp, Homo sapiens
  misc_feature: GYAE6OF01DVRBM.11.57.F02.1.454.CMB.1.raw
  modified_base (261)..(261): a, c, t, g, unknown or other
  misc_feature (261)..(261): n is a, c, g, or t
  modified_base (284)..(284): a, c, t, g, unknown or other
  misc_feature (284)..(284): n is a, c, g, or t
  modified_base (324)..(324): a, c, t, g, unknown or other
  misc_feature (324)..(324): n is a, c, g, or t
  modified_base (386)..(386): a, c, t, g, unknown or other
  misc_feature (386)..(386): n is a, c, g, or t
tcagcgagagataccacgaccggtgctcgatttagctcgatatagttgggtttgggggaggaactgctcagttaggacccagacggaaccatggaagcccagcgcagcttctcttcctcctgctactctggctccagggaccacgggagacatagtgctgacgcagtctcagccaccctgtctgtgtctccgaggggcagacgcccacctctctgcgacgggccaggtcagtacttagttagtaccacttagcctggacanacaaactcgcaggcctccgctcncatctatggcgacactccgacgacgggccgcgtcggtccncccgacgacggtcgaggtcggtgggtcgggtcgtagggacgtgtcgtcctacgtctcgaacncgttacgacgaccgtacgtcctacggtcgtacgttacggttaacggttaagtttacgttttcggtaacctttaaggtttttaactccgtttacgtacgtaacgttaccgtaaggtttaacgttaacgggttacggtacgggtccctggtttacccgttaccggggttaccgggggtaccggggaacgggttaaccggttaacgggggtggtaacggtaaccgtacgggtaaaccgggaacggttacgggttacggggtccgaggtttaccggacccgtaccgtaaggttttccgtaacggttttccttaccctttaaccggttcccgttaaccccgg

SEQ ID NO: 295036 - DNA, 873 bp, Homo sapiens
  misc_feature: GYAE6OF01ARIP0.11.57.F02.1.454.CMB.1.raw
  modified_base (213)..(213): a, c, t, g, unknown or other
  misc_feature (213)..(213): n is a, c, g, or t
tcagcgagagataccacgaccggtgctcgatttagctcgatataggttgggtttgggggaggaactgctcagttaggacccagacggaaccatggaagccccagcgcagcttctcttcctcctgctactctggcctcccgagggaccacgggagacagtagtgctagacgcagtctccgacgccaccctgtctgtcgtctcgagggacagacnccaccctcgtcctgaccgacgggccagtcagtacttattacgtaccaccgttacgccgtagtaccaagtaaccaaaaccgtggaccacggcctcccggctccgtactacgttacctagtcggtcactaccgtcccgaccggacgggccgtcggttcggtaccgtaccccgacccggttacggttccgtcgggtacgggtccgggttacggggtacggtcggggaacttcgggttacgttacccgtacttcccgtaccaaccgtacgaccacggaccgtaccggtaccgtacgacgttaacccggttgttaacggttaacggttttacgttttaacggaacgtttttaacggttttaacctttaacgttacggttaaccgtttacggacgtttaaaggtttaccgtttaaagggtacccggtttaccggttacccggttaacccgttacgggtttacccggggtttaacccggggacgggttaaaaccgggggtaaccgttacgggggtaaacgtaggttaaccggtacggtaaacgtaacccggttaaacggttccgggggtacttaccgggtaaaccgtacccgttaaaccccgttacggtttaccgttaacccgtttccgtttaaacccggttccccttttacccggtaacccccggg

SEQ ID NO: 295037 - DNA, 813 bp, Homo sapiens
  misc_feature: GYAE6OF01BREZO.11.57.F02.1.454.CMB.1.raw
tcagcgagagataccacgaccggtgctcgatttagctcgatataggttgggtttgggggaggaactgctcagttaggacccagacggaaccatggaagccccagcgcagcttctcttcctcctgctactctggcctcccgagggaccacgggagacgatagtgctcgacgcagtcctccacgccacccttgtctgtcgtcctaccggagggacacgacgccctacccctccgtccgtacgacggacggaccgtagtcaacgtaacgttacgtttaaccgttacctaaccgtttacgacccgttacggtaaacccaacgaaccgtaaaaacccggtcggacccgaaccggtccccttcccgggacccttacctacgtaacgttaccttgttacgggtacgtcctaccgttacccgaacccggtacggggtcccgtccgttaccgggttacccgtaccccccgtaaaccgtcggggttaccgtacggggttccgggtaccgggttacggggttcggttaacgggtaacgtacgggtttccgtttaaccccgtccgttaacccgtccggtaaacccctttacgaccggttacgaccccgtaaggtcctttacgtacgtacgttacgtagttaaccggttattttcgacgtttattacgttactacgtagtacgtacgtagtagtaacgtagtcgtcgtacgttccgtacgttccgggacggtacggaacgtacggtagtacgtacgtacgaagtccgtaacggtgtacgtacggctaccgtacctagttccgacgttcgttacctcgtacccgtcg

SEQ ID NO: 295038 - DNA, 816 bp, Homo sapiens
  misc_feature: GYAE6OF01ACVVS.11.57.F02.1.454.CMB.1.raw
  modified_base (307)..(307): a, c, t, g, unknown or other
  misc_feature (307)..(307): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtccccagccaccctgtctgtgtctccgaggggacagacgccacctctcctgcagggccagtcagactattagttacacttagcctggtaaccagacaaaaccgtggaccaggcctccccgactcctctatctagtggtncactccaccgacgggccgtcgtcgggtcgtccccgaccgtacggttcgacggtggggcgggttcgggtcgtacgggtacgtacggttacgttcgtacctttccttaccgaacctaacgtacctacggaccgtacgtcccgttacgaccgttaacggttccttaagggtaaacgttttacgtttttacggtaaccgtttaacgttttttaacgtttaacccgtttcgggttaaccaacgggttaccgtaaggttttaaacggttaaacgggttaacggtttcgggtaccccggttaccgtttacccggtttaacccgggtttttaccggggggaccgggggttaaacggggttaaccccgggtaaagggggtttacgggaacggtaaccgtaacggtaaaccgggtaaccggtaacggttcgggtaccgggtaccgtagggtacccctaaaccggtcttaacccgttcggttaccctttacgtaaccctttcccggtttccccgtaaccg

SEQ ID NO: 295039 - DNA, 764 bp, Homo sapiens
  misc_feature: GYAE6OF01EXXKX.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccgaggaccacgggagacatagtgcgtgacgcagtcctccgacgcccacccttgtctgtgtcgtaccgaggggacagacgcccaccctctccgtgcgacgggccagtcagtacttaattacgtacaccgttagccgtggaccaacgacctaaaaccgtggaccgacggccctaccccggtctccctactatctagttcggtgacctacgtccgaacccggcggggtacccgtcgttcgggtacccgtcccccgtaacccgtacgggttaccgtaggggttcggggtaccggggttcgggggttaccggtcgggggtaacttacgggtttcgttaccgtacccgttccgtacctaaccgtacgtaccgacggtaccgacggtcctacggtacgtacggtttacgtaaggtaacgtttcgtttacggtacgttaagtttaacgtttacgtacgtacgacgttacgtaaggttaagtacgtttaacggccggtaccgtacgtccgttaccggttccggggaacggtacggggtaacgtaacgggtaggtaacgtacgtaccggtaagaaccggtaggtcgtaggactcggactaacctgtccttacgttcttacctccgttcccgtccccg

SEQ ID NO: 295040 - DNA, 873 bp, Homo sapiens
  misc_feature: GYAE6OF01A7WF6.11.57.F02.1.454.CMB.1.raw
  modified_base (152)..(152): a, c, t, g, unknown or other
  misc_feature (152)..(152): n is a, c, g, or t
  modified_base (156)..(156): a, c, t, g, unknown or other
  misc_feature (156)..(156): n is a, c, g, or t
  modified_base (213)..(213): a, c, t, g, unknown or other
  misc_feature (213)..(213): n is a, c, g, or t
tcagcgagagataccacgaccggtgctcgatttagctcgatatagttgggtttggggaggaactgctcagttaggacccagacggaaccatggaacgccccagcgcagcttctcttcctcctgctactctggctcccgagggaccacggganactntacgtgctgacgctagtcctccagccacctgtctgtacgtcctccgagggacagacncccgaccttcgtccgtcgccgaaggggtcccaggtccaacggtaaccttaagtttaccggttactaccgttagccccgttaggtaaccaacgtaaccaaaaaccgttcggacccgtaacgggtccgtacccccggtcttccccgtacgtaacttcgttaacggtcgggtctactaacgttcccgaaccgtacgggtcccgcggttaccggttccggttacccccaacccggttaacgggttaccgtaaggggtttccggggtacccgggtttagggggttcccgtacggggtaaacgttacgggtttcgtaacgtacccgtaccttaccgaaccgtaagttccccgaaggttacccgtaacgtacccggttagtacgtacggtttaccgtaagtaacgggtttactttacgggtacgttaacggtttttctaaccggttcgtacccggtaattaacggtaacgtttaagtaggttaaccggtcggttaaccgtccgttaacgttaccgggtttaccggggacgggttaaccggaccggtaacggaggtcgtaaacgtccggaaaaggtaccgggttaaagtccggtttcggaacgttcccgggaactaccggttaccttccgttaacggtttccaccggtttccgttacccgttaccccg

SEQ ID NO: 295041 - DNA, 770 bp, Homo sapiens
  misc_feature: GYAE6OF01ATI7F.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattagtacacttgcctggtaccagacaaaaacctggaccacggcctaccccggctcctcatctatcggtgcactccaccgaggggcccgtcgtcggtcgtaccccacccgtacggttccgaaggtcgggtccgggttcgggtcgtacgggggactaaggttcgtttaccgacttcgtaccaacctacttcgacggacctacggtccttcgaccggtaacgttaccgttaggtaaacggtttatttttacggtaaccgttaaggttttttaaccttaaccggtttacggttacccgtaggtaaccgttaaacgttaagtttaaacgggttaacggttccggggtacccgttacgtttaacccgttaacccgggtttttccgggggaaccgggggttaaacggggtaacccggtaagggggtaacggtaaggtaacgttacgaaacgggtaacgggtaaacgttgggtaggtaccggtacgtaccaacccgtaacgttccgttacgttccgttacctcgtttccgttaacccccg

SEQ ID NO: 295042 - DNA, 950 bp, Homo sapiens
  misc_feature: GYAE6OF01CNYNO.11.57.F02.1.454.CMB.1.raw
  modified_base (300)..(300): a, c, t, g, unknown or other
  misc_feature (300)..(300): n is a, c, g, or t
  modified_base (313)..(313): a, c, t, g, unknown or other
  misc_feature (313)..(313): n is a, c, g, or t
tcagcgagagataccacgaccggtgctcgatttagctcgatataggttggggtttgggggaggaggaactgctcagttaggacccagagggaaccatggaagccccagctcagcttcctcttccctcctgctactctcggctcccagactacccaccggagtaaattgtgttagacacacgtcctaccggccacctgtctgccgtctaccgtagggaacagtccaccctctccgtcgtcggacggcctaagtactaaaatactaacctaaactcttagcctaggtaccacgtagtaaccncggaccaggtccnccgtacggtccttcctactactacgtactagacgtcacgttacggtttaggaccggtaccgtacgtcggacctaccgtaccccgaccgtacggttcgacggtcggaccgttaagggtcggggttaccggtcggggtaaactacgggtaacctttaccgttacgttaccgtacctaaccccgtacgttaccccggaccggtaacggtacccttaacgggttaaccggtaccgtttaccgggtaaacgttttaccggttttaggtaaccgttttaacgggttttaactttaaccggtttaacgttaaacccggtaacggtaaccgggtttaacgtaaccgggtaccgtaacggtaaccccggtacgggtacccccggtacggggtaacccggttaacccgggttaaccccgggtaaccgggggttaaaccgggaaccggggtaaacgggggttaaccgggtaacgtaaaccccggggttaaagtaaccggggtaccgggttaaacggttccggggaacccgtttaaccccggggtaaccttaaccccggggtttaccttacccggtttaccgggtttaaccctttaaccccggttacccggttttaccccgggaaccccctttacggggtttaacccgg

SEQ ID NO: 295043 - DNA, 779 bp, Homo sapiens
  misc_feature: GYAE6OF01EG5XH.11.57.F02.1.454.CMB.1.raw
  modified_base (154)..(154): a, c, t, g, unknown or other
  misc_feature (154)..(154): n is a, c, g, or t
  modified_base (578)..(578): a, c, t, g, unknown or other
  misc_feature (578)..(578): n is a, c, g, or t
  modified_base (685)..(685): a, c, t, g, unknown or other
  misc_feature (685)..(685): n is a, c, g, or t
  modified_base (767)..(767): a, c, t, g, unknown or other
  misc_feature (767)..(767): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagactaccacgganaaattgtgttgacacagtctccggccacctgtctgcgtctcgtagggaactacgtcctacctacctcctcgtacgacgggacggtactaaacgtaaactaaacgttaactaaaccgttaaaccttacgtaccgtaccgttttacggtaacctaaaccgtaaaccgttaccgttaccggaccggtaccggtaccccttaccggaccgttccttaccgtactacgtttactaggacgttctaacgtacgttaaggggttaccggggaccgtacgtaccggtacgacctacccgtaccccgtaccggttacgtacggtacgggtcggtaacgtgggggtccgacggggtaacgactaccgttacttcgttactccgactacgcctacgactacgtacgacgtacgtacgtagtattttaggtacttntttaactttaaccggtatacccaaacgtacgtcggtaactcggtaccgacgttaccggccgggccggttaccggaccggtttccggaacgggggaacgtaacccggnggttaagggacggttaacaaacggtcggtagtaacggttaggctacggactaccgtataccgtcgttaccctatagttcccncccgttacgtcg

SEQ ID NO: 295044 - DNA, 742 bp, Homo sapiens
  misc_feature: GYAE6OF01CIJCF.11.57.F02.1.454.CMB.1.raw
  modified_base (260)..(260): a, c, t, g, unknown or other
  misc_feature (260)..(260): n is a, c, g, or t
tcagcgagagataccacgaccggtgctcgatttagctcgatataggttggggtttgggggaggaactgctcagttaggacccagacggaaccatggaagccccagcgcagccttctcttcctcctgctactctggcctccgagggaccacgggagacatagtgactgacgcagtcctccacgcccacccgtgtctgtcgtcctccgaggggacagacgccacctctcctgcgacgggccagtcagtaactattacgtacnctagcgttaggaccagaaccaaaaccgtggaccaaggtcccgtacccggctccgtacacgtctagtcggtcacactaccgacgaccgggtccgtagtcgggtacctaccccaacggttcggttacgacgggtcgggcgggttcgggtacgttacggggaactcggggttctacgtacgttccgtacaccgtaatcgaacgtcgactcgtacgactagtacgtagtaacgtttcgtttatacgttaagtttaacgttacgtagtactaacgtagttaaagtttaacggtagtttaacgggcggtacccgtactttaaccggttccgggttaaccgggacggggttacgggaacccggttaagggtcgggaacttaacgggtcggtaaacggtaccggttacggtggttaccggcgttcccggaaaccctaaccgttggtttaccgacgttttccgaacccttaccggttcccgtttaaccccg

SEQ ID NO: 295045 - DNA, 681 bp, Homo sapiens
  misc_feature: GYAE6OF01EN9U3.11.57.F02.1.454.CMB.1.raw
  modified_base (306)..(306): a, c, t, g, unknown or other
  misc_feature (306)..(306): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggactcccagggaccacgggagacatagtgctgacgcagtctcagccacctgtctgtgtctccgaggggcagacgccacctctcctgccagggcctagtccagactattacgtacaccttgcctggtaccagaccaaaacctggccaggcctcccggctcctcactctatacggtnactagtccaccgacggccgcgtacggtctcccgtaccgtaggttaccgaggtcgggccggtgggtcgtacgggaccgtaggtcgtacacgttccgtcgaacctacgtaccgtaaggtcgtacgtacgtacgtaccgaacgttacgttaacgaagtttacgtttagacgtttaacgtttaacgtttaaccgtcgtacctaagacccgttaagtaccttaacggtaacgtcggtacccgtacttaccgggtaaccgttcccgggggtaacgggtaaccgggtacggtaacgggtaggtacgacgtaacggtacgaacgtaggtcgttacggcgtacggccctagtacgttccgttctacctctacgttcctacccgg

SEQ ID NO: 295046 - DNA, 252 bp, Homo sapiens
  misc_feature: GYAE6OF02I7NCW.11.57.F02.1.454.CMB.1.raw
  modified_base (251)..(252): a, c, t, g, unknown or other
  misc_feature (251)..(252): n is a, c, g, or t
tcagcgagagataccacgaccggtgctcgatttagctcgatatagttgggtttgggacagtgttcactctcaccatcagcagcctgcagtctgaagattttgcagtttattactgtcagcagtatagtaagtggccgctcactttcggcggagggaccaaggtggagatcagacgaactgtggctgcaccatctgtcttcatcttcccgccatcagtatctctcgctgagcgggctggcaaggcgcatagnn

SEQ ID NO: 295047 - DNA, 188 bp, Homo sapiens
  misc_feature: GYAE6OF02H2RIM.11.57.F02.1.454.CMB.1.raw
  modified_base (174)..(188): a, c, t, g, unknown or other
  misc_feature (174)..(188): n is a, c, g, or t
tcagcgagagataccacgaccggtgctcgatttagctcgatatagttgggtttgggggaagaggaagactgacggtcccccaggagttcaggtgctgggcacagcggccctgggctgcctggtcaaggactacttccgtatctctcgctgagcgggctggccaaggcgcatagnnnnnnnnnnnnnnn

SEQ ID NO: 295048 - DNA, 513 bp, Homo sapiens
  misc_feature: GYAE6OF02G8GX0.11.57.F02.1.454.CMB.1.raw
  modified_base (436)..(436): a, c, t, g, unknown or other
  misc_feature (436)..(436): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctgaagattttgctagtttattactgtcagcagtatagtaagtggccnctcactttcggcggtagggaccaagggtggaagtatcgagacgaacgtggtggctgcacatctgtcttcatctcccg

SEQ ID NO: 295049 - DNA, 921 bp, Homo sapiens
  misc_feature: GYAE6OF02HSXX3.11.57.F02.1.454.CMB.1.raw
  modified_base (241)..(241): a, c, t, g, unknown or other
  misc_feature (241)..(241): n is a, c, g, or t
  modified_base (276)..(276): a, c, t, g, unknown or other
  misc_feature (276)..(276): n is a, c, g, or t
tcagcgagagataccacgaccggtgctcgatttagctcgatatagttggggttttggggggacggacggaactgctacaagttaggacccaagagggaacccatgggtaagccccagctcaggcgttctcttcctccctgctacgtctggcctcccgagactaacccaccgggagaaagttggtcggttcgaccaccaggtctccggccctacccgtgtcctgccgtctcctggggaaacngtcaccctctccgtgcacggccagtaccaaaattntttaacaacttacggttagccgttcgggttccaaacgacgtaaaccctggggaccggacggtccgtaccctacggaccttccgtactaacttccttactcggaattggtcgtaagtttttacggaggggtacccaacgttcgggtacctacgttccccaaacccgtagggtttccaaggttcggaccaaggttcggggttccttcggggtaccgaacgtaaccgtttccaaacgtttcctaacctaacctaacgttttcccccgacgtaaacggcccttaagggtaacggtcccttagggtaaacggttaaccgttttttcggcccgttaaaggtttttaaactttaccggttacggttttaacctaaaaccgtagggttaccggtttaaggaccgtaacggccgtaacgggtacccctttaccgggtaccggttaaccggtttttccggggaacccgttaaacgggggttaacccgttaaacggggtaacgggtaaaaccggttacgaaacgggtacccgggtaaacggttcgggttaccggggtaccccgttacggggacccggtaaacccgtaacgtttcccgttacggttcccggtttaccccgttaacttttaccccgttttcccggaccccttaacccg

SEQ ID NO: 295050 - DNA, 509 bp, Homo sapiens
  misc_feature: GYAE6OF02FMN3F.11.57.F02.1.454.CMB.1.raw
  modified_base (484)..(484): a, c, t, g, unknown or other
  misc_feature (484)..(484): n is a, c, g, or t
  modified_base (493)..(493): a, c, t, g, unknown or other
  misc_feature (493)..(493): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctgggtcgtcccacccaggttccagtggcggtgggtctgggacagtgttcactctcaccatcagcagcctgcagtctgaagtattttgctagtttattactgtcagcagtatagtaagtggccgctcactttcggcggaggaccaaggtgagatcgagacgaacgtgnggctgcacntctgtctcatctcccg

SEQ ID NO: 295051 - DNA, 504 bp, Homo sapiens
  misc_feature: GYAE6OF02GBQAO.11.57.F02.1.454.CMB.1.raw
  modified_base (495)..(495): a, c, t, g, unknown or other
  misc_feature (495)..(495): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccaccaggttcagtggcggtggtctggggacagtgttcactctcaccatcagcagcctgcagtctgaagattttgctagtttatactgtcagcagtatagtagtggccgctcactttggcggagggaccaaggtggagatcagacgaacgtggtggctgcacatctgtctnattctcccg

SEQ ID NO: 295052 - DNA, 608 bp, Homo sapiens
  misc_feature: GYAE6OF02HIST4.11.57.F02.1.454.CMB.1.raw
  modified_base (380)..(380): a, c, t, g, unknown or other
  misc_feature (380)..(380): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcaggtggtctgggacagacttcattctcacatccgnacgccctagacgcctagaagtattttgctagtttattactgtcagtcagcgttagtccgactggactcgaccgttcggaccgtaagggccaacggaacttacgggaaaatttaaaaccgggaacttacggtacggtaccttacggaccgtaaccctaagttccgttacggttacctttaccgtaaccgttccccgtttacccccggtaccttacgttacccgttacgg

SEQ ID NO: 295053 - DNA, 537 bp, Homo sapiens
  misc_feature: GYAE6OF02HIT91.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcaccatcagcagcctgcagtctagaagtatttgctagtttattactgtcagcagtatagtagtcggcgtctactacgtttcggacggaggaccgtaagggtgagtacgtacgagacgtaacgtggtacggctagccaccgtattcgtgttcttactattccgttccccg

SEQ ID NO: 295054 - DNA, 514 bp, Homo sapiens
  misc_feature: GYAE6OF02IP32Z.11.57.F02.1.454.CMB.1.raw
  modified_base (439)..(439): a, c, t, g, unknown or other
  misc_feature (439)..(439): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagcccaccctctcctgcagggccagtcagactattagttacaccttagcctggtaccagcaaaaacctggccaggctccccggctcctcatctatggtgcatccaccagggccgctcggtgtcccacccaggttcagtggcggtgggtctgggacagtgttcactctcaccatcagcacgcctgcagtctgaagtattttgctagtttattactgtcagcagtatagtagtgccgntcacgtttcggcggagggaccgaaggtggagatcgagacgaactggtgctgcacatctgtcttctatccttcccg

SEQ ID NO: 295055 - DNA, 544 bp, Homo sapiens
  misc_feature: GYAE6OF02H51GB.11.57.F02.1.454.CMB.1.raw
  modified_base (316)..(316): a, c, t, g, unknown or other
  misc_feature (316)..(316): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccnctggtcgtcccaccaggttcagtggcggtgggtctgggacagtgttcactctcaccatcagcagcctgcagtctgaagtattttgctagtttattactgtcagtcagtattagtaagtggccgtctctacgtttcgggcggtacgggtaccaagggtggagtatcgagacgaacgtggtacggctcggaccaccgtagtccttggttcctttcacttccgttaccccg

SEQ ID NO: 295056 - DNA, 529 bp, Homo sapiens
  misc_feature: GYAE6OF02G5A4R.11.57.F02.1.454.CMB.1.raw
  modified_base (207)..(207): a, c, t, g, unknown or other
  misc_feature (207)..(207): n is a, c, g, or t
  modified_base (369)..(369): a, c, t, g, unknown or other
  misc_feature (369)..(369): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggagggccactggcatcccaccaggttcagtgcagtgggtctgggacagacttcattcncaccatccgcagcccttagacgcctgaagtattttgctagtttattactgtacaacagtcgtagcagcaggcctccggcgacgttcggccgaagggaccaaggtggaaagtcgaagcgacgtgtggctgcaccatcgtgtcttcattccttcccgctacg

SEQ ID NO: 295057 - DNA, 694 bp, Homo sapiens
  misc_feature: GYAE6OF02IXOLS.11.57.F02.1.454.CMB.1.raw
  modified_base (208)..(208): a, c, t, g, unknown or other
  misc_feature (208)..(208): n is a, c, g, or t
  modified_base (264)..(264): a, c, t, g, unknown or other
  misc_feature (264)..(264): n is a, c, g, or t
  modified_base (362)..(362): a, c, t, g, unknown or other
  misc_feature (362)..(362): n is a, c, g, or t
  modified_base (388)..(388): a, c, t, g, unknown or other
  misc_feature (388)..(388): n is a, c, g, or t
tcagcgagagataccacgaccggtgctcgatttagctcgatatagttgggtttgggggagggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctctgcaggccagtcaaaatattaacaactacttagcctggttccaanagaaacctggccaggcctccaggctcctcatctatgatgcatttaggacggccagtggcactcccaccaggttcagtgcagtggctgggacagacttnacttctcacatccgcacgcctaacgngtcctaggtaagtacttttggaccttaggtttaattacgttagtacctaaacgtaggtaccgttaacgcaacggtccgaaacgggtcccccgttaccggggtaccgttaacccggtttaccggaacccgggtaaaccggggtaacccgggtaaacgggtaaccgggggtaaagtaacccggtaagggacccggtaaccggttaggttacccggggtaccgtacggacccgtaacccgaacggtttacccgttacggtttacccggtaccttaccgtttaccccgtttccccggaacccgttaccgg

SEQ ID NO: 295058 - DNA, 510 bp, Homo sapiens
  misc_feature: GYAE6OF02IV9OM.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcagtggcggtggtctgggacagtgttcactctcaccatcagcagcctgcagtctgaagtatttgctagtttatactgtcagcagtatagtagtggccgctcactttcgggcggtagggaccaagggtggaagatcagacgaacgtgtaggctgcacatctgtctcatcttcccg

SEQ ID NO: 295059 - DNA, 568 bp, Homo sapiens
  misc_feature: GYAE6OF02JFX9I.11.57.F02.1.454.CMB.1.raw
  modified_base (205)..(205): a, c, t, g, unknown or other
  misc_feature (205)..(205): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagttctccagccaccctgtctgtgtctccgaggggaaanagcccaccctctcctgcagggccagtcagagtgttaggagcaacttagcctggtaccagcagaaacctggccaggctcccaggctcctcatctanggtncatccacaggccactggttcccagccaggttcagtggcagtcgggtctgggacagcttcactcgtcacatcagcagtcctagacgcctagaggtactttgcctagtttattacgttgtcagcgagtcgtatcgtactaggacttcaccgtttcggaccgtaacgggaccaacgtacgtacgtaagttaaaccgacgttaggtacggtactacggtacctaaccgtacgttacgttacgttccttacgtacttcccgttaccccg

SEQ ID NO: 295060 - DNA, 510 bp, Homo sapiens
  misc_feature: GYAE6OF02GRJFA.11.57.F02.1.454.CMB.1.raw
  modified_base (366)..(366): a, c, t, g, unknown or other
  misc_feature (366)..(366): n is a, c, g, or t
  modified_base (418)..(418): a, c, t, g, unknown or other
  misc_feature (418)..(418): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggaggccatggcatcccaccaggttcagtgcagtggtctgggacagacttcattcncaccatcccgcagcctagcgcctgaagattttgctagtttatactgtcaacngcgtagcagcaggcctccggcgaccggttcggccaagggaccaagggtgaagtcaagcgatgnggctgcacntctgtctcatcttccgctac

SEQ ID NO: 295061 - DNA, 532 bp, Homo sapiens
  misc_feature: GYAE6OF02H3M1M.11.57.F02.1.454.CMB.1.raw
  modified_base (238)..(238): a, c, t, g, unknown or other
  misc_feature (238)..(238): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatnttaacaactacttagcctggttccaacagaaacctggccaggctcccaggctcctcatctatgatgcatttaggagggccactggcactcccaccaggttcagtggcagtggtctgggacagacttcattctcaccatccgcacgcctagacgctgaagtattttgctagtttattactgtcaacagcgtagcagcaggcctcggcgtacgttccggaccgaacgggaccgaagggtcggaagtcgaagacgacgtggtggctagcaccatcgtgtcttcacttctcccgctac

SEQ ID NO: 295062 - DNA, 516 bp, Homo sapiens
  misc_feature: GYAE6OF02I9W3I.11.57.F02.1.454.CMB.1.raw
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
  modified_base (499)..(499): a, c, t, g, unknown or other
  misc_feature (499)..(499): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtccccacccaggttcagtggcggtgggtctggggacagtgttcactctcaccatcagcagcctgcagtctgaagtnttttgctagtttatactgtcagcagtatagtaagtggccgntcacgtttcggcggtagggaccaagggtggaagatcgagacgaacgtggtggctgcacgntctgtctcatcttcccg

SEQ ID NO: 295063 - DNA, 616 bp, Homo sapiens
  misc_feature: GYAE6OF02HDTI1.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctccctcatctatggtgcatccaccagggccgctggtcgtcccacccaggttcaggtggcggtgggtctgggacagtgttcactctcaccatcgagcgacgcctcgcagtcgtagtaaagttagttttgactttaagtttacttacgttgtacgagtactaagttaagttaagttaaggtcggtccgtcgttaccgttaccgtttccggggacggggtaacgggtaaaccggtaaggggtacgaagtacgtacgacggtaacgtaacgtggtacggtcgtacggacctaccgtacgtccgttacgttccttacgtacttcccgttaccccg

SEQ ID NO: 295064 - DNA, 509 bp, Homo sapiens
  misc_feature: GYAE6OF02GSCON.11.57.F02.1.454.CMB.1.raw
  modified_base (395)..(395): a, c, t, g, unknown or other
  misc_feature (395)..(395): n is a, c, g, or t
  modified_base (435)..(435): a, c, t, g, unknown or other
  misc_feature (435)..(435): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtggtctgggacagtgttcactctcaccatcagcagcctgcagtctgaagtntttgctagtttatactgtcagcagtatagtaagtggccgntcactttcgggcggagggaccaagggtgaagatcgagacgaacgtgtggctgcacatctgtctctatcttcccg

SEQ ID NO: 295065 - DNA, 510 bp, Homo sapiens
  misc_feature: GYAE6OF02H2Q28.11.57.F02.1.454.CMB.1.raw
  modified_base (395)..(395): a, c, t, g, unknown or other
  misc_feature (395)..(395): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcacatcagcagcctgcagtctgaagtntttgctagtttttactgtcagcagtatagtactggcctcgtactactttggccagggaccagctaagaatacaaacgactgtggctgcaccatctgtcttcatccttccgcctac

SEQ ID NO: 295066 - DNA, 792 bp, Homo sapiens
  misc_feature: GYAE6OF02J0098.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgactagtttaggacgggcctacgtcgggcacttccccgacccgtagggttccgaaggtcgggacctagggttcgggggtcctagggggaacctacggtaccgttttacctacgttttccctaccgtaaccctaacgttccccggacgtaacggtccccgtttaaggaccggtcccgttacgggtaaacggttaacgttttttacggaccgtttaaacggtttttaacgtttaaccgttagggttaccctaaaccggtaacggtacggttaacggtccgtaacggtaccgtaaccgggtccccggttacccggggacccggttaacccgggttacccggggtaacccggaaacgggggtaacccgtaaagggggttaacgggtaaacggtaacgaacggtaccggtaacggttaggttcgggacgttacggacctacccgtacgtccgttacgttaccgttacgtaccttcccgttacccgacccttacg

SEQ ID NO: 295067 - DNA, 535 bp, Homo sapiens
  misc_feature: GYAE6OF02HTPKP.11.57.F02.1.454.CMB.1.raw
  modified_base (207)..(207): a, c, t, g, unknown or other
  misc_feature (207)..(207): n is a, c, g, or t
  modified_base (510)..(510): a, c, t, g, unknown or other
  misc_feature (510)..(510): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgctagtttaggagggccacgtggcactccccaccaggttcagtggcaggtggtctggggacagacttcattctcaccatccgcagcctagacgcctgaagtattttgctagtttattactgtacaacagcgtagcagcaggcctcggcgtacgttccggaccgaagggaccgaagggtggaacgtcgaagcgacgtgtggctgcacntctgtcttcactccttcccgctacg

SEQ ID NO: 295068 - DNA, 617 bp, Homo sapiens
  misc_feature: GYAE6OF02GTKZ4.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccaggctcctcatctatgatgcatttaggaggccactggcactcccaccaggttcagtcggcaggtgggtctgggacagacttcgattctcacctatccgcacgcctaagcgcctagaagtattttgatagtttattacgttgtacaacagtacgtacgcgtagacacggtcctccgggacgtaccggttcggaccgaacgggaccgaaagggtacgggaaacggtacgaacgggtacgaacgttacggtacggcgttacggacccgtaacccgtaagttccgttacggtttcctttaccgaacgttttcccgtttaccccggtcccttaaccgg

SEQ ID NO: 295069 - DNA, 525 bp, Homo sapiens
  misc_feature: GYAE6OF02HO8U7.11.57.F02.1.454.CMB.1.raw
  modified_base (315)..(315): a, c, t, g, unknown or other
  misc_feature (315)..(315): n is a, c, g, or t
  modified_base (371)..(371): a, c, t, g, unknown or other
  misc_feature (371)..(371): n is a, c, g, or t
  modified_base (436)..(436): a, c, t, g, unknown or other
  misc_feature (436)..(436): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaactggccaggctccccggctcctcatctatggtgcatccaccagggccnctggtcgtcccaccaggttcagtggcggtgggtctgggacagtgtcactctcaccntcagcagcctgcagtctgaagtattttgctagtttattactgtcagcagtatagtaagtggaccnctcactttcgggacggtagggaccaagggtggagtatacagacgtaacgtggtaggctggacaccgatcgtgttcttctatccttcccg

SEQ ID NO: 295070 - DNA, 551 bp, Homo sapiens
  misc_feature: GYAE6OF02F8LB5.11.57.F02.1.454.CMB.1.raw
  modified_base (207)..(207): a, c, t, g, unknown or other
  misc_feature (207)..(207): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcacctctcctgcagggccagtcaaaatattaacaactacttagcctggttaccaacagaaacctggccaggctcccaggctcctcatctatgatgcatttaggagggccactggcactccccaccaggttccagtggcaggtgggtctggggacagacttcactctcaccatcagcagcctagacgctgagattttgctagtttattactgtacagtcagtcgtatcgactggatcgaccttcggaccaagggaccacgactaggtaaacttaaacgactgtacggctcgacctacctacttacttcgttaccttacacgtttcccttaccccgctattccg

SEQ ID NO: 295071 - DNA, 577 bp, Homo sapiens
  misc_feature: GYAE6OF02GEWS9.11.57.F02.1.454.CMB.1.raw
  modified_base (317)..(317): a, c, t, g, unknown or other
  misc_feature (317)..(317): n is a, c, g, or t
  modified_base (444)..(444): a, c, t, g, unknown or other
  misc_feature (444)..(444): n is a, c, g, or t
tcagcgagagataccacgaccggtgctcgatttagctcgatatagttgggtttgggggagggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccnctggtcgtcccacccgagttcaggtggcggtgggtctggggacagtgttcactctcacatcagcagcctgcagtctgaagtattttgctagtttattactgttacagctagtataagtagtgggccnctactacgtttcggcgggtaacgggtaccgaaaggttgggaagtagtcgaagaacggtaaaccgttggtacgggtcttaggcctaaccgtattccgttagttcccgtttacgtaccgttccgtttacccccgg

SEQ ID NO: 295072 - DNA, 510 bp, Homo sapiens
  misc_feature: GYAE6OF02GKBMO.11.57.F02.1.454.CMB.1.raw
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcagtggcggtgggtctgggacagtgttcactctcaccatcagcagcctgcagtctgaagtntttgctagtttattactgtcagcagtatagtaagtggccgtntcgtacgtttcggcggagggaccaaggtggagatcagacgaagtgtggctgcacatctgtctcatctcccg

SEQ ID NO: 295073 - DNA, 550 bp, Homo sapiens
  misc_feature: GYAE6OF02J2LJX.11.57.F02.1.454.CMB.1.raw
  modified_base (314)..(314): a, c, t, g, unknown or other
  misc_feature (314)..(314): n is a, c, g, or t
  modified_base (416)..(416): a, c, t, g, unknown or other
  misc_feature (416)..(416): n is a, c, g, or t
  modified_base (440)..(440): a, c, t, g, unknown or other
  misc_feature (440)..(440): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacacttagcctggtaccagcaaaaacctggccaggctccccggctcctcatctatggtgcatccacagggccnctggtctcccaccgaggttcaggttggcggtgggtctgggacagtgttcactctcacatcagcagcctgcagtctgaagtatttgctagtttatactgtacngctagttatagtaagtcggccgtntacgacgttttcgggacgggtaagggtacccgtaaagggtggaagtctacgacgaggtaacgttggtggactgccaacctgttctggttctccgtattcccgttaccccg

SEQ ID NO: 295074 - DNA, 509 bp, Homo sapiens
  misc_feature: GYAE6OF02IP8IW.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctcccggctcctcatctatggtgcatccaccagggccgctggtcgtcccacccaggttcagtggcggtggtctgggacagtgttcactctcaccatcagcagcctgcagtctgaagattttgctagtttatactgtcagtcagtatagtaagtgccgctcactttcggcggaggaccaagggtgaagatcgagacgaactggtcggctgcacatcgtgtcttcatcttaccg

SEQ ID NO: 295075 - DNA, 627 bp, Homo sapiens
  misc_feature: GYAE6OF02J1UWY.11.57.F02.1.454.CMB.1.raw
  modified_base (494)..(494): a, c, t, g, unknown or other
  misc_feature (494)..(494): n is a, c, g, or t
  modified_base (548)..(548): a, c, t, g, unknown or other
  misc_feature (548)..(548): n is a, c, g, or t
  modified_base (580)..(580): a, c, t, g, unknown or other
  misc_feature (580)..(580): n is a, c, g, or t
tcagcgagagataccacgaccggtgctcgatttagctcgatatagttgggtttgggggagggaacgtgctcagttaggacccagacggaaccatggaagccccagcgcagcttctcttcctcctgctactctggctcccagggaccacgggagacatagtgctgacgcagtctccagccaccctgtctgtgtctccaggggtacagacgcccaccctctcctgcagggccagtcagactattagttacaccttagcctggtaccagacaaaacctggccaggcctccccggctccgtcactctatcggtgcactccaccgacgggccgtctgggtccgtcccacccgtacggttcacggtggacggttgggtcgtcgggtacgaggttcgttcacgttcctccaaccgtatccacgcacgtcctcggacctagtcctaggtaaacgtatttgtacctagtttacttacgtgtctagtacagttatagttacggnggtaccctctacgttacgtttccgggacgggtacggtaaccgtaagggtacggngtaacgtcgaacggacgtaacggtggtacggntcgacctaccgtacttcgtacgttccgttactccgttccgtaccccg

SEQ ID NO: 295076 - DNA, 571 bp, Homo sapiens
  misc_feature: GYAE6OF02F9F3L.11.57.F02.1.454.CMB.1.raw
  modified_base (207)..(207): a, c, t, g, unknown or other
  misc_feature (207)..(207): n is a, c, g, or t
  modified_base (371)..(371): a, c, t, g, unknown or other
  misc_feature (371)..(371): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctcctcatctatgatgcatttaggaggccacgtggcatcccaccaggttcagtggcagtgggtctgggacaggacttcattcncaccatccgcagcctagacgcctagaagtattttcgctagtttattactgtcaacagtcgtagcagcgacggcctccggcgtacgttccggaccgaacgggtaccgtaagggttacggaaacggtacgaacggtacgacgtggtcggcgtagaccaccgtacgtcgttcgttccttactactttcccgttcccgacctac

SEQ ID NO: 295077 - DNA, 755 bp, Homo sapiens
  misc_feature: GYAE6OF02HQL4S.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaaacagtcaccctctcctgcagggccagtacaaaatattaaacaactactagcctgtaccaacagaaacctggaccaggcctccaggctcctcatctatgatgactagtttagggacgggaccacgtggacctactccccaacccgtaggttcaggtcggcgtagggtcgggtacgtacggggactaacggtaccgtttactaacgtttcctaccgaacctaacgttccccggacaccggtacccttaacggacgtacccgtaggtaaacgtttacgtttttacggactttaaaggtttttaactttaacgtcggttaaccaaaccggtaggtaaccggttagaccgtaaggccgtaacgggtccccggttacccgggtaccggttaacccgggttccgggaacccgtaaacggggtaacccgtaaggggttaacgggtaaacgtaacgaaacgggtaccgtaacggttcggtacggtccgtacggaacctaccgtaacgttaccgttcgttaccgttaccgtaccgttaccccgtttacccgaccttacgg

SEQ ID NO: 295078 - DNA, 578 bp, Homo sapiens
  misc_feature: GYAE6OF02HGVEP.11.57.F02.1.454.CMB.1.raw
  modified_base (318)..(318): a, c, t, g, unknown or other
  misc_feature (318)..(318): n is a, c, g, or t
  modified_base (413)..(413): a, c, t, g, unknown or other
  misc_feature (413)..(413): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagtacaccttagcctggtaccagacaaaaacctggaccaggcctccccggctcctcatctatggtgcatccaccagggccnctcggtcgtccccaccctaggttcaggtcggcgggtggggtcgtggggactaggtgttcactctcaccatcagcacgcctgctagtctgaaagtnttttgctagtttatactgtacagtctaagttataagtaagtcggaccgtcttacgtacgtttcgggcgggaacgggtaaccgagggtacggagacgtacgaggacgtaacgtggtaggcgttcgacctacctaagttcctgttcctacgtacttcccttaccccg

SEQ ID NO: 295079 - DNA, 514 bp, Homo sapiens
  misc_feature: GYAE6OF02GCW6A.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtgtcccacccaggttcagtggcggtgggtctgggacagtgttcactctcacatcagcagcctgcagtctgaagtattttgctagtttatactgtcagctagtatagtaagtggccgtctctacgtttcggcggagggaccaaggtcggagatcgagacgaacgtggtgctgcacatcgtgtctctatcttcccg

SEQ ID NO: 295080 - DNA, 771 bp, Homo sapiens
  misc_feature: GYAE6OF02IWGNC.11.57.F02.1.454.CMB.1.raw
  modified_base (153)..(153): a, c, t, g, unknown or other
  misc_feature (153)..(153): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
tcagcgagagataccacgaccggtgctcgatttagctcgatatagttgggtttgggggagggaggaactgctcagttaggacccagagggaaccatggaagccccagctcagcttctcttcctcctgctactctgctccagataccaccgganaaattgtgttgacacagtctccggccaccctgtctgccgtctccgtaggggaacagtccaccctctcctgcgacggccagtacaaatattaacaactactagcctaggttaccaaactactaaactcggccaacacctaccacggcctcctcatctanagactnctactaccgaacgacggaccacgtcggaccacccgacgccgtacgtcgaggtcggacgtaggtacggtcgtacggggactaacgtaccgtttaccgacttaccgtaaccacccgtactaccgacggaccaaccggtacccgtaacgacgtaccgtacggtaacggttacgtttacggtacgttaacggtttactttaaccgttacgttaccgaacgttacgtaacggtaccgttacgttaccggtaccggttacggttacgttacccgtaacccgggtttaccggaaacccggtaaaccggggtaacccgtaaaccggtaaacggttaaaacgggtaaaaccgtttaaaccggaaccgtttaacgggtacgggtaccgtaaccggacctaaccgtacttccggttacgttacccgtttaccgttacgttaccccgtttacccgtacccttaacg

SEQ ID NO: 295081 - DNA, 675 bp, Homo sapiens
  misc_feature: GYAE6OF02JANB2.11.57.F02.1.454.CMB.1.raw
  modified_base (439)..(439): a, c, t, g, unknown or other
  misc_feature (439)..(439): n is a, c, g, or t
  modified_base (521)..(521): a, c, t, g, unknown or other
  misc_feature (521)..(521): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctcgcgtctccgtaggggaaacagtccacccctctccgtgcacgggccaagtacaaaatattaaacaactaacttagcctggtaccaacaacgaaacctcggaccacggcctcccaggcctacctcatctatagactgactagttacggacgggtaccacgtggcacgtccccaccgtagttaccgaggtacggacgaggtcgggttcgtaggggttaaccacggtaactttcgtacttacctccaacctancccgtacaacggtcctaacgacgtacctaggtaaacgtatttacgacttagtttaacttacgtagtactaacgtagacgtanaccgagccgaacggtccgtccggtcgtaaccggttacggaccgaacgggtaccgaaggttaacgggaacgtacgaacgacgacgttggtacggctacgacgtaacctagttccgttacgttccttacctacttcccgttaccccgtactaaccg

SEQ ID NO: 295082 - DNA, 531 bp, Homo sapiens
  misc_feature: GYAE6OF02H0CRG.11.57.F02.1.454.CMB.1.raw
  modified_base (316)..(316): a, c, t, g, unknown or other
  misc_feature (316)..(316): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccnctggtcgtcccaccaggttcagtggcggtgggtctgggacagtgttcactctcaccatcagcagcctgcagtctgaagtattttgctagtttattactgtcagcagttatagtaagtcggcgtctactacgttttcgggcggaagggaccgtaagggtggaagatacgagacgaagtggtggctgcaccgattctgttcttcacttcttaccccg

SEQ ID NO: 295083 - DNA, 524 bp, Homo sapiens
  misc_feature: GYAE6OF02G6X0V.11.57.F02.1.454.CMB.1.raw
  modified_base (397)..(397): a, c, t, g, unknown or other
  misc_feature (397)..(397): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccgactcctcatctatggtgcatccaccagggccgctggtcgtcccacccaggttcagtggcggtggtcgtgggacagtgttcactctcacatcagcagcctgcagtctagaagtntttgctagtttattactgtcagtcagtatagtaagtggcctctctacgtttcggcggaggaccgaagggtgagtatcgagacgaacgtggtggctgacctaccgatcgtgttccttcacttctcccg

SEQ ID NO: 295084 - DNA, 736 bp, Homo sapiens
  misc_feature: GYAE6OF02JED7W.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgctaagtttaggacgggcccacgtgggccacttcccccaaccccgtagggtttccaaggtcggcctaagggttcggggtcgtaggggaccaggtacctttcatttccgtaccaacccgtagttccccggactaacggtcccctttaaggacggtacccgttaggtaaacggttaagtttttcggacgttaaggttttactttaaccgttcgttaacctaaaccgtaggttaccgttaacggacgaacggtaccgtaacgggccccgttacccggggtaccggtacccggtttccgggacccgtaaacggggaacccgtaaggggtacggaaacggtaccgaacggtaccgacgttagggtacggtacgtcggtaccgtaacccgtacgttccgttacgtccgttaccgtacttcccgttacccgaccttaacg

SEQ ID NO: 295085 - DNA, 544 bp, Homo sapiens
  misc_feature: GYAE6OF02F6LZD.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgcgtggtcgtcccacccaggttcagtggcggtgggtctgggacagtgttcactctcaccatcagcacgcctgcagtctgaagtattttgctagtttattactgtcagctagtatagtaagtggccgtctactacgtttcggcggtagggaccaagggtggaagtactacgagtacgaacgttggtcgggtctcgcacctagttctgttcttcgtacttcccttaccccg

SEQ ID NO: 295086 - DNA, 204 bp, Homo sapiens
  misc_feature: GYAE6OF02G9XNI.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacaga

SEQ ID NO: 295087 - DNA, 515 bp, Homo sapiens
  misc_feature: GYAE6OF02JDIV7.11.57.F02.1.454.CMB.1.raw
  modified_base (438)..(438): a, c, t, g, unknown or other
  misc_feature (438)..(438): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcagtggcggtgggtctgggacagtgttcactctcaccatcagcagcctgcagtctgaatattttgctagtttatactgtcagctagtatagtaagtggccgntcacgtttcggcggaggaccaagggtgagtatcgagacgaacgtgtggctgacacgattctgtcttcgatcttcccg

SEQ ID NO: 295088 - DNA, 698 bp, Homo sapiens
  misc_feature: GYAE6OF02HA70W.11.57.F02.1.454.CMB.1.raw
  modified_base (208)..(208): a, c, t, g, unknown or other
  misc_feature (208)..(208): n is a, c, g, or t
  modified_base (402)..(402): a, c, t, g, unknown or other
  misc_feature (402)..(402): n is a, c, g, or t
tcagcgagagataccacgaccggtgctcgatttagctcgatatagttgggtttggggaggaggaactgctcagttaggacccagagggaaccatggaagccccagctcagcttctcttcctcctgctactctggctcccagataccaccggagaaattgtgttgacacagtctccggccaccctgtctgcgtctccgtaggggaaacngtccacccgtctccgtgcacgggtccagtacaaaatattaaaccaacttacttacgccttggttaccaaacacgaaacctcggccaggccttcccgaaggtcctacctacatcctaatgaatcgactaagtttacgggacggaccacgtcgacgactacccgaccgtaggttcaggtcgacgtaggtcggtacngggacagtactatagttacacacactcgacacgtcctagacgcctagtaacgttacttttgacgttagtttacgttacgtacgtacgaaagtacggtcgttaagactacgtacgtacggcccgtacccggggtaaccgtaccgggttaccggaacccgggttaaacgggaaccgtaaacggggtaacggttaaacgccgggtaaacggacggtaacgtacgggttacggaaccgtacgtacctaacgtcgttacgttccgttcgttaccgaccgtttccgttcccggacttacccg

SEQ ID NO: 295089 - DNA, 650 bp, Homo sapiens
  misc_feature: GYAE6OF02F2TIE.11.57.F02.1.454.CMB.1.raw
  modified_base (430)..(430): a, c, t, g, unknown or other
  misc_feature (430)..(430): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccaccctctcctgcagggccagtcagactattagttacaccttagcctggtaccagacaaaaacctggccaggcctccccggctccctcactctatggtcgcactccaccgacggggccgcgtcggtcgtccccaccgtaggttcaggtcggcgggtggggtcgtgggacaggttcgttcactctcaccatcagcacgccgtgcgtacgtctaggtaacgttnttttcgacttagtttactacttgtacagtctaagttagttaaggttaacggtcgggaccctcgttaccgttaccggttttcgggggaccgggtaacggggtaaccgtaaaggggtacggtaagtacgtacggaaccggtaacggtaaccgttgggtccggtacgtcggaaccgtaccctaagttccgtttcgttaccgtttcctacgttcccgtaccccg

SEQ ID NO: 295090 - DNA, 594 bp, Homo sapiens
  misc_feature: GYAE6OF02GRFO3.11.57.F02.1.454.CMB.1.raw
  modified_base (206)..(206): a, c, t, g, unknown or other
  misc_feature (206)..(206): n is a, c, g, or t
  modified_base (379)..(379): a, c, t, g, unknown or other
  misc_feature (379)..(379): n is a, c, g, or t
  modified_base (441)..(441): a, c, t, g, unknown or other
  misc_feature (441)..(441): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggcaccctgtctgcgtctcctggggaaacngtcaccctctcctgcagggccagtcaaaatattaacaactacttagcctggttaccaacagaacctggccaggctcccaggctcctcatctatgatgctagtttagggacgggtccacgtggcatccccacccgtaggttcagtggctagtgggtctgggacagcttcattcncaccatccgcacgtcctaagcgcctagaacgtattttgcttagtttattacgtgtaccaacngtacgtagacagcacggccgtccgggcgtaccggttcggaccgtaaacggggaccgaagggtcgggaaacgtcgaaacggcgaacgttggtacggtccttaccgaccgtacttcgtacgttcttctaccgttccctttacccgcctattccgg

SEQ ID NO: 295091 - DNA, 595 bp, Homo sapiens
  misc_feature: GYAE6OF02FYPKA.11.57.F02.1.454.CMB.1.raw
  modified_base (311)..(311): a, c, t, g, unknown or other
  misc_feature (311)..(311): n is a, c, g, or t
  modified_base (404)..(404): a, c, t, g, unknown or other
  misc_feature (404)..(404): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtcgtctccgaggggacagacgccaccctctcctgcgagggccagtcagactattagttacaccttagcctggtaccagacaaaaaccgtggaccgaggcctcccggctcctcactctagtggtncactccgaccgacgggccgtcgtcggtccgtaccccaccgtacgggttcaggtcggcgggttcggggtcgtacggggactaggttcgttaccncgtctcaccactcagcacgctcgctagtcagtaacgtatttgactttagtttacttacgtgtacagtactaaggttattaaggtacgtcggccgtctcgttacgttcgggacgggtaacggtacgaggtaggagacacgagacgtacgtggacgtacgcgtacactctcgtacttctactactccctaccg

SEQ ID NO: 295092 - DNA, 562 bp, Homo sapiens
  misc_feature: GYAE6OF02F2BL2.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcaggtggcggtgggtctggggacaggtgttcacgtctcaccatcagcacgcctgcagtctagaagtatttgctagtttattactgtcagctagtatagtagtggcctctctacgtttcggcgggacgggtaccaagggtgaagtactacgagaccggtaacgttggtacggtctacggaccaacccgttagttcgtcgttacctttctaccttcccgttaaccccg

SEQ ID NO: 295093 - DNA, 640 bp, Homo sapiens
  misc_feature: GYAE6OF02I5AVS.11.57.F02.1.454.CMB.1.raw
  modified_base (152)..(152): a, c, t, g, unknown or other
  misc_feature (152)..(152): n is a, c, g, or t
  modified_base (425)..(425): a, c, t, g, unknown or other
  misc_feature (425)..(425): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggganacatagtgctgacgcagtctccagcccaccctgtctgtcgtctccgaggggacagacgccaccctctcctgcagggccagtcagactatagtacacttagcctgtaccagacaaaacctgccaggcctccccggctcctcatctactgtgcatccaccgacgggcgctcggtcgtcccacccgaggttccaggtcggtcggtggtccgtgggactaggtgttcactcgtaccaccacgtcacgcacggacctgcgacgtcgtagtaaacggtntttcgtacgtaactttagttactcgtactagacgttaagtataaggtaagttcggccgtacttccgtaacgtttccggggaccgggtaacgggaccgggtaaacgggtggaacgtacgtacgtaacgggaccgtaacggttggttaccggtcgtaccgaccgttaaccgcgtttaccgttacgttacccttacgttacccttcccgttacccccg

SEQ ID NO: 295094 - DNA, 643 bp, Homo sapiens
  misc_feature: GYAE6OF02HLDBB.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctcagccaccctgtctgtgtctccgaggggacagagccaccctctcctgcagggccagtcagactattagttacaccttagcctggtaccagacaaaaacctggccaggcctccccggctccctcatctatggtgcactccaccgagggcccgcgtggtcgtccccacccgtaggttcaggtcgggtcgggtggggtcgtaggggactagttcgttcacttctcaccatcagcagcctgctacgtctagtaacgtagttttcgacgttagttttacttacgttggtacaggtctaagttaattaaggttaagtccgggtaccgtcttaccgtaccggtttcggggaccgggtaacgggaaccgtaaggggtggaaggtacgtacggacggtaacggtaacgttgggtacggtccgtagcccgtaaccgttacgtacgtttcggttcctttaccgtaccgtttcccgttaccccg

SEQ ID NO: 295095 - DNA, 707 bp, Homo sapiens
  misc_feature: GYAE6OF02G4K0P.11.57.F02.1.454.CMB.1.raw
  modified_base (207)..(207): a, c, t, g, unknown or other
  misc_feature (207)..(207): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctaggttccaacagaaacctggccaggcctcccaggctcctcactctatgaattgactattttagggacggggccacgtggcactccccaccctaggttcaggtcggcagggtggggtctagggggacagtaccgtttcatttccgtccaaccacgttcccgacagtccctaaggacgtacctaggaaacgtttatttttcggcttaacgtttttaattacgttacgtacctaaacgaggtaccggtaagccgtaacgaccgtaacgggtccccgttcccgggaccggtaccgggtttaccgggaacccgtaaacggggaaccccgaagggggttacggaaaacggttaccgaaacgggtaccgtaacgttgggtaccgggacttcggaaccgtaaccgagtttaccgcggtttacctttccgactttacccgtttcccccggaccttaaccg

SEQ ID NO: 295096 - DNA, 656 bp, Homo sapiens
  misc_feature: GYAE6OF02FJ53G.11.57.F02.1.454.CMB.1.raw
  modified_base (342)..(342): a, c, t, g, unknown or other
  misc_feature (342)..(342): n is a, c, g, or t
  modified_base (456)..(456): a, c, t, g, unknown or other
  misc_feature (456)..(456): n is a, c, g, or t
tcagcgagagataccacgaccggtgctcgatttagctcgatatagttgggtttgggggaggaggaactgctcagttaggacccagagggaaccatggaagccccagcgcagcttctcttcctcctgctactctggctcccagggaccacgggagacatagtgctgacgcagtctccagcccaccctgtctgtgtctccgaggggacagacgcccaccctctcctgcagggccagtcagactattagttaccacctttagccctggtacccagacaaaaccctggcccaggcctccccccgggctccctccacttcctatggtcgcactccaccgagggcccncgtcggtcgtccccaccccacggtttccagtgggtccggttgggtctcggggacaggttcgttccacgtcctcaccactcacggcacgtccctagccagttcaggtaaacgttnttttacgccgttaagttttacttaccgttggtaccagtctaagtacttaaggtaacggttcgggccctcttaccgtaccgtttaccggggacgggtaacgggaccctaaagggtggacgtataccgaagaccggtaaacgttggtacggtcttcgacccgtaaccgtacgtccgttagtccctttactaccgttaccccg

SEQ ID NO: 295097 - DNA, 700 bp, Homo sapiens
  misc_feature: GYAE6OF02HQGXI.11.57.F02.1.454.CMB.1.raw
  modified_base (245)..(245): a, c, t, g, unknown or other
  misc_feature (245)..(245): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagacgccaccctctcctgcagggccagtcagactattagttacnccttagcctggtaccagacaaaaacctggccaggcctccccggctcctcatctatggtgcactccaccgaggggcccgcgtcggtcgtaccccaccccgtagggttccaaggttcgggcgggttggggttcgttgggggaactaggttcggtttacaccgttcgtccaaccctagttccaacgtccgaacgtcccgttaggccgtaacggttccgttaaggtaaagttacgtttttgacgtttaaggttttactttaacgttggttactaggtacctaaggttaatagggttaaggtcggtccgtaccttaccgtacggttttccggggacgggtaacggggtaacccgtaaaggggtcggaaggtactaccggaggtaaccgtaacgttgggtacggtcgtacggacctaaccgtacgttctcgtttacctttacgtacctttcccgttccccg

SEQ ID NO: 295098 - DNA, 665 bp, Homo sapiens
  misc_feature: GYAE6OF02IX1D9.11.57.F02.1.454.CMB.1.raw
  modified_base (207)..(207): a, c, t, g, unknown or other
  misc_feature (207)..(207): n is a, c, g, or t
  modified_base (216)..(216): a, c, t, g, unknown or other
  misc_feature (216)..(216): n is a, c, g, or t
  modified_base (237)..(237): a, c, t, g, unknown or other
  misc_feature (237)..(237): n is a, c, g, or t
  modified_base (262)..(262): a, c, t, g, unknown or other
  misc_feature (262)..(262): n is a, c, g, or t
  modified_base (310)..(310): a, c, t, g, unknown or other
  misc_feature (310)..(310): n is a, c, g, or t
  modified_base (462)..(462): a, c, t, g, unknown or other
  misc_feature (462)..(462): n is a, c, g, or t
  modified_base (480)..(480): a, c, t, g, unknown or other
  misc_feature (480)..(480): n is a, c, g, or t
tcagcgagagataccacgaccggtgctcgatttagctcgatatagttgggtttgggggtaggaggaacgtgctcagttaggacccagaggaaccgatggaagccccagctcagcttctcttcctctgctactctggctccagataccaccggagaaattgtagttgacacagtctccggccaccctgtctgctctcctggggaaacngtcaccctntcctgcaggccagtcaaaatnttaacaactactagcctgtaccaanacgaaacctggaccaggtcctaccgaggccttcctcatctatgacttnctaagttaggacggccacgtgcacgtcccaacgtagttcacgtgccaggttcgggctggggaacagtaccgttcaacttcgtaccaacgtctccgcaggtaccctagtaaccgctaaggaaactttgtttaacggctaggtttaattacgtntacctaagcgtaacgtanacgacacggtacgtccgtaccggtgtaacccgttcgaccggtaaacggtacccggtaagtaaggtaccggtaccaagggtaccgtaacggtacggtaacggtccgtaccggtaaccgtaccttaacggttacgtcccggttttaaacgtccttaacccgtcccgttccccggttaacctaccggg

SEQ ID NO: 295099 - DNA, 803 bp, Homo sapiens
  misc_feature: GYAE6OF02GL4ZY.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctccgagctcctcatctatgatgctagttaggacgggccacgtggccacgttccccgacccgggttacaggttcggcgacggttcgggtcgtaggggaacaagggtaccttcctaacgttttccctacgtaaccctacgttacccgccgtaaccgtacccgtaacggtaccgtacccgtttaggtaacgttaagtttttacggtacctttaaggtttttaactttaccgttagttaccgtaaaacgtcggtaaccggttacgtaccgtaacggtaccgaaccgggtccccggttacccgggaccggttaaccgggtttacccgggaacccggtaacgggggtaaacccgtaacgggggttacgggtaaaaccggttaccgaaaacggggaccgggttaaaccgttaggggttacgggtacccgttacgggaaccctaaccccgtaacgtttaccggtttaccgttacccgttttccggtaaccctttcccccggttttaccccgtacccgtacgtttacccgg

SEQ ID NO: 295100 - DNA, 639 bp, Homo sapiens
  misc_feature: GYAE6OF02H4ESU.11.57.F02.1.454.CMB.1.raw
  modified_base (381)..(381): a, c, t, g, unknown or other
  misc_feature (381)..(381): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctccgtaggggaacagtccaccctctcctgcaggccagtacaaaatattaacaactacttagcctggttaccaacagaaacctggaccaggcctcccaggaccttccgacattactatgatcgactagtttacgggaggccacgtggacactccccaccgaggttacaggtgcgagtggtctgggacngtactctacttctcacctatccgcagcccgtagtaccgcgtagtaacgttattttcgacttagttttaatcgtgttaaccaacgtaaggcgttagacaggtaccgacggtcccgtcgggacggttaccgtacgaccggtaaacggaccgtagggacgaaacgttaccgaacgtacgtaacgttcggagggtccttagccccgtaaacgtcttccgtacgtttccttacgttacgtttccccgttaccccgacttaccg

SEQ ID NO: 295101 - DNA, 635 bp, Homo sapiens
  misc_feature: GYAE6OF02GZAGK.11.57.F02.1.454.CMB.1.raw
  modified_base (306)..(306): a, c, t, g, unknown or other
  misc_feature (306)..(306): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagcccaccctctcctgcgagggccagtcagactattagttacaccttagcctggtaccagacaaaaacctggccaggcctccccggctcctcatctagtggtncactcccaccgacgggcccgtcgtcggtccgtccccacccgtaggttcgaggtcgggcgggtgggttccgtggggactaggttcgttctactcctaccacctatcacgtcacgtcctgactacgtcgtagtaagttacgtttcgacgttagtttacttacgttgtactacgtctaagttataaggtacggtcgccgtcttaccgtacggttcgggacgggaacggtacgaagggtagaacgtacgtacgaggtaacggtaccgtggtaccggtcgtacgaccgtactacgttcgttcgttaccgtttacgtaccttacccgttacccgg

SEQ ID NO: 295102 - DNA, 785 bp, Homo sapiens
  misc_feature: GYAE6OF02H593L.11.57.F02.1.454.CMB.1.raw
  modified_base (323)..(323): a, c, t, g, unknown or other
  misc_feature (323)..(323): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctgggaacagtcacctctcctgcagggccagtacaaaaattattaaaccaacttacttaacgccttcggttaccaacgagaaacctcggaccacggcctcccgaggcctcctctactcttatagatncctaagtttaggacgggtaccacgtggacactccccgaccgtacggttacgacggtcggcgtaggtcgggttcgtacggggactacggtacttactacttcgtactaccgtacgtcccgacgtacgaccgtttaacggaccggtaccgttagggtaactttaacgttttggtaccgttaagttttacgttaacgttcgttacgtacgtacgttaacgtttaagttaaggttaaacggtcccgggtacttacccggttaccgtttacggttttacccgggggtaacggggtaaccgggggtaaccggtaacgggggttaccgggttaaaggtacgtaacggtaaacggtaaccgggttaaccggttcggtaccggggttccgttaccggtacctaaaccggtcgttaacccggttcgttttaccgtttacgttacccgtttcccgtttacccgtccggttacc

SEQ ID NO: 295103 - DNA, 555 bp, Homo sapiens
  misc_feature: GYAE6OF02G0HRS.11.57.F02.1.454.CMB.1.raw
  modified_base (207)..(207): a, c, t, g, unknown or other
  misc_feature (207)..(207): n is a, c, g, or t
  modified_base (293)..(293): a, c, t, g, unknown or other
  misc_feature (293)..(293): n is a, c, g, or t
  modified_base (376)..(376): a, c, t, g, unknown or other
  misc_feature (376)..(376): n is a, c, g, or t
  modified_base (432)..(432): a, c, t, g, unknown or other
  misc_feature (432)..(432): n is a, c, g, or t
  modified_base (513)..(513): a, c, t, g, unknown or other
  misc_feature (513)..(513): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacngtcaccctctcctgcagggccagtcaaaatattaacaactacttagcctggttccaacagaaacctggccaggctcccaggctccncatctatgatgctatttaggaggccacgtggcactccccaccaggttcagtggctaggtgggtctggggacagacttcattcncaccatccgcagcctagacgcctagaagtattttgcttagtttatactgtacaacngacgtagcagcacggcctcggcgtacgttcggacccgaagggaccgaagggtcggaaggtcgaacgcgtacgtggtcggcncgccaccagtccttcgttccttcacttccgttccccgctacg

SEQ ID NO: 295104 - DNA, 704 bp, Homo sapiens
  misc_feature: GYAE6OF02JKO9D.11.57.F02.1.454.CMB.1.raw
tcagcgagagataccacgaccggtgctcgatttagctcgatatagttgggtttgggggtagggaacgtgctcagttaggacccagacggaaccatggaagccccagcgcagcttctcttcctcctgctactctggctcccaggaccacggagacatagtgctgacgcagtctccagccaccctgtctgtgtctccaggggcagagccaccctctcctgcagggtcccagtcagactattagttacaccttagcctggtaccagcaaaacctgaccaggacctcccggctcctcatctatggagcacgtccaccgaggcccgcgtcggtcgtcccgaaccctaggttcctaggtcggccggtaggggtcgtacggggacgtacggtgtttccgactcgttccacctagtctacggccaggtcccctgggtacctacggttaccgtaggaaagttacgttttaggtacccttaagtttacttaaccgttgttacctagaccgtagttaacttaggtaacggttggtcccgtaccgtacttaccgttttaccggggtaccgggtacgggtaacccgaaggggttaaaccggtacggtaacgttaccgacggtaacggtaaacgttcgggttaccggtcgtaccgtacgtacctaacggttccgttaaccgttaccgtttccttaaccggttccctttaacccccggg

SEQ ID NO: 295105 - DNA, 732 bp, Homo sapiens
  misc_feature: GYAE6OF02JBLI9.11.57.F02.1.454.CMB.1.raw
  modified_base (294)..(294): a, c, t, g, unknown or other
  misc_feature (294)..(294): n is a, c, g, or t
  modified_base (365)..(365): a, c, t, g, unknown or other
  misc_feature (365)..(365): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccaccctctcctgcagggccagtcagactattacgttacacttagcctggtaccagacaaaaaccgtggaccaggcctcccggctccncatctatcggtgcatccaccagggccgcgtggtcgtcccaccaggttcgagtgggcggtggtcgtgggacngtgtcactctcacatcacgtcacgccttgacgtagtcgtaggtaaagttactttttaggtacgtttaagttttaactttaacgtcggtttaacgtaacggttctaaacgggtttaaattaaagggttaaacggttacgggtacccggttacgttaccgtttaacccggtttttacgggggaccggggttaaaccgggggtaaaccgtaaaacgggggttagggtaaacggtaacgttaccggaaccggttaaccgggaaaccggtttaggggttccgggaaacggttaccggtaacccgtaaccgtaacgtttccgtttaccgggtttccctttaacgttaaccctttccccggtttaaccccccgg

SEQ ID NO: 295106 - DNA, 553 bp, Homo sapiens
  misc_feature: GYAE6OF02GKWEF.11.57.F02.1.454.CMB.1.raw
  modified_base (495)..(495): a, c, t, g, unknown or other
  misc_feature (495)..(495): n is a, c, g, or t
  modified_base (526)..(526): a, c, t, g, unknown or other
  misc_feature (526)..(526): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccacctctcctgcagggccagtcagactattagttacaccttagcctggtaccagacaaaacctggccaggcctccccggctcctcatctatggtgcactccaccagggccgcgtaggtcgttaccccacccgtagggttccagtgggcgggtgggtcgtagggctagtgttcactctcacgatcagcagcctgcagtctgaagtattttcgacttagtttacttacgtgttacagctagttactagtacgtggctgtctacgtttcgacggtaggaccaggtggagtanctaggacacgtggtaggacgtcaaccgtacnctactcgttctctacttcccggttccc

SEQ ID NO: 295107 - DNA, 594 bp, Homo sapiens
  misc_feature: GYAE6OF02FTSG9.11.57.F02.1.454.CMB.1.raw
  modified_base (416)..(416): a, c, t, g, unknown or other
  misc_feature (416)..(416): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaaactacttagcctggttccaacagaaacctggccaggctcccaggctcctcatctatgatgctatttaggacgggccacgtggccatccccacccgtaggttccagtggcaggtgggtcctggggacagacttcattcctcaccatcccgcacgcctagacgcctagaagtnttttcgacttagtttattacgttgtaccaactaggcgtagactagcacggtcctacgggccgtacgttcggccgaaacgggacgtaagggtaggaacggttacgaacggtaccgaacgttggtcgggctacggcaaccctagtccgttagttccttcacgtttcccttccccgctacg

SEQ ID NO: 295108 - DNA, 733 bp, Homo sapiens
  misc_feature: GYAE6OF02HPTBH.11.57.F02.1.454.CMB.1.raw
  modified_base (268)..(268): a, c, t, g, unknown or other
  misc_feature (268)..(268): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgctgacgcagtctccagccaccctgtctgtcgtctccgaggggacagacgcccaccctctcctgcacgggccagtcagacttattagttacacttagcctaggtaccanaccaaaactcggacaggcctcccgctcctacactctagtgtcgctactcccgaccgacgggccgcgtcgggtacctccccgaaccgtacggtttcgacggtcgggccgggttcggggtcgtcggggaaccgtaggttcggttaccacgttccgacgtaacctataccgacgccgaacggtccgtagtccacggttacgtacggtaaagtttacgttttacgtacgtttaaagttttacgtttaacggttacgttacgtaacggttactaaagtttaagtaacggttaaacggtcggtaacccgtacgtttaaaccggtttcggggaaccgggtaacgggtaaaccggaagggttacggaaggtaacgtacgtaacggtaaccgtaacggtagggtcggcgttaacggaaccgttaaccgtaacgttcgttacgttaccgttactaaccgttccgttaacccgtcc

SEQ ID NO: 295109 - DNA, 566 bp, Homo sapiens
  misc_feature: GYAE6OF02HP0VB.11.57.F02.1.454.CMB.1.raw
  modified_base (303)..(303): a, c, t, g, unknown or other
  misc_feature (303)..(303): n is a, c, g, or t
  modified_base (412)..(412): a, c, t, g, unknown or other
  misc_feature (412)..(412): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactatagttacaccttagcctggtaccagacaaaaacctggaccaggctcccccggctcctcatctatggtncatccaccgacgggccgcgtcggtcgtccccacccgtaggttcaggtcgggcggtgggtcgtgggactgtgttcacgtctacaccatcagcagctgcagtctagaagtntttgctagtttatactgcagtctagtataagtaagtcggcgctccgtacgtttcgggacggagggaccgaagggtcgaagtatacgaggtacgaacgtggtaggtctacggtccaaccgtagtcccttagttctttacctattcccttaccccg

SEQ ID NO: 295110 - DNA, 856 bp, Homo sapiens
  misc_feature: GYAE6OF02H819I.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagactattagttacaccttagcctggtaccagacaaaaacgtggcaggcctcccggctccacatctatgtgcactccgaccgacgggccgcgtcggtcgtaccccgaccgtaggttcgaggtcgggtacgggtgggtcgtacggggactaggttcgttcaccgttcgaccaaccctagtaccgacggtacccgaacgtccccgttaggaccgtaacggtttaccgttaacgggttaaacgtttaccggttttttaacggtacgtttaacgggttttttaaaccgttttaacgttacggttacccgttaaacggttaccgtttaaagggtttaaaacgtttaagggttaaaaccgggttaccgggttaccccgttacccgttttaacccggtttaccgggttttttaacccgggggacccgggggttaaaccgggggtaaacccgggttaaaacgggggtacgggttaaaacgggttaaccggtaaccggttaaacgggtaacccggttaaaacggttcggggttaaacggtcccgttaacgggtaaccctaacccgttacgtttaacccggttacggttttacccgtttaccgtttaacccgtttccccggttttaaccccccgg

SEQ ID NO: 295111 - DNA, 693 bp, Homo sapiens
  misc_feature: GYAE6OF02FPWTZ.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagagccaccctctcctgcagggccagtcagactattagttacaccttagcctggtaccagacaaaacctggaccaggcctccccggctcctcattctagtggtgctactcccacgacgggccgcgttgggtccgtaccccgacccgtaggttccgacggttcgggcggggttcggggttcggtgggggacctagggttcgttacctacgttcctaccacctactcgaagccacgtcctgacgtacgtctagaaagtttgttttacgactttaaggttttacttaccgttcgttacgtagtacgttaagttacgttaaggttaacgggtccgggtaccgttccgttaccgttaccgggttttcgggaaccggggtaacgggtaaccggtaagggtacggaacgtagtacggacgaacggtaaggttcgggtaacggtcgtaacgaccgtaactcgtttacgttcgttactttacctacgttccccttacccg

SEQ ID NO: 295112 - DNA, 709 bp, Homo sapiens
  misc_feature: GYAE6OF02F89KN.11.57.F02.1.454.CMB.1.raw
  modified_base (294)..(294): a, c, t, g, unknown or other
  misc_feature (294)..(294): n is a, c, g, or t
  modified_base (374)..(374): a, c, t, g, unknown or other
  misc_feature (374)..(374): n is a, c, g, or t
tcagcgagagataccacgaccggtgctcgatttagctcgatatagttgggtttgggggaggaggaactgctcagttaggacccagagggaaccatggaagacccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctnatctatgatgacatttaggaggccactggcactccccaccgaggttccaggtcggcaggtgggtctggggacagaccttnacttctcacctatcccgcacgtccctaggacgtccttagaaacgttacttttggacttaacgttttaacttacgttacgtaccaaacgtcggtacgttaacgacgtacggaccgtaacgggtcccgttaccgggtaccggtacccgggtttacccgggaccgtaaaacggggtaacccgtaaagggggtttacggaaacggttaccggaaacggtacccggtaaccgttgggtacgggtaccgtacggtacccgtaaacccgttacgttacccggttacggtttaccctttaccgtaacccgtttccccgtttaccccggtaccccgttaaccgg

SEQ ID NO: 295113 - DNA, 817 bp, Homo sapiens
  misc_feature: GYAE6OF02H23C0.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcacgggccagtacaaaattacttaaacaacttactagcctggttaccaacagaacctcggccaggcctcccgaggctcctcatctatgatgactagttacgggacggccacgtcggcacctccccaccgtacggttcaggttggactaggtgggtccgtgggaacctaggtacttcgtaacttcctacaccctacgtcccgactacgcccgtaaggtaccgcccgtaggtaacgttacgtttttcggacgttaaggtttttaacttaaccgttacggtttaacccgtaaaacgtaccgggttaacggttaacggccgtaacgggtaccgtaacccggggtaccccggttcccggggtaacccggttaacccggggtttacccggggtaaccccggtaaaaccgggggtaaccccggttaaacgggggtaacggggtaaaaccggttaccggaaaacgggtaccccgggtaaagttccggggtacggtcccgggtaaccgggtacccgttaaacccgtaccgtttcccggttacggttttacccgtttccgttaaacccggttttcccccgtttacccccggtacccctttaacgg

SEQ ID NO: 295114 - DNA, 810 bp, Homo sapiens
  misc_feature: GYAE6OF02GEI4C.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctcaggggacagagccaccctctcctgcagggccagtcagactattacgttacaccttagcctggtaccagacaaaaactggccaggcctccccggctcctcatctatggtgcactccaccgacgggccgcgtgggtccgtccccgaacccgtacgggttccgtaggtcgggtcggggttacgggggtccggttggggtaaccgtaaggtttcggtttacccgtacttccgttcctaacccgtagtttaccgacggtaccgacggtcccgttcggtccgtaacggttccttaagggtaaagtttacgtttttaggtacgtttaacgggtttttaactttaacccgttacggttaccgtaacgtaccgttaaagttaacggttaaacgggttaaacgggttccggggtacccgttccgttacccggtttaaccgggtttttcccgggggaaccgggggtaaccggggtaaacccgggttaaaggggttacgggtaaacggtaacgttacggaacgggtaaccggtaaacggttcgggttaaccgggtccgttaccggacccgtaacccgtacgttccgttaccggtttacctttaccgttccgttaccccgtttacccccg

SEQ ID NO: 295115 - DNA, 681 bp, Homo sapiens
  misc_feature: GYAE6OF02GCF0D.11.57.F02.1.454.CMB.1.raw
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatataacaactacttagcctggttaccaacagaaacctggccaggctcccaggcctcctcatctatcgatgcagtttaggagggccacgtggacatcccaacccgtaggtttaccaggttaggctagggttcgggtacgttagggactacggtactttacacgtttctacctaacctaagtcccgacaggtccctacgacgcctaggtaacgttagttttgccttaagttttacttacgtacgtaccaacgtacggtacgtagaccgtagacgacggtcccgtacgggtaccggtaccggtttaccggggacccggtaaacgggtaacccggtaaacggggttacggaaacggaccgaaacgggtacgtaacgtcggtacggtaccgtcggaccgtaccgacgttacgtcgtttccgttaccgtactcccgttaccccacttaccg

SEQ ID NO: 295116 - DNA, 767 bp, Homo sapiens
  misc_feature: GYAE6OF02GX9K7.11.57.F02.1.454.CMB.1.raw
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgcccaccctctcctgcagggccagtcagactattagttacaccttagcctggtaccagacaaaaacctggaccaggcctccccggctcctcatctagtgtgcatccaccgacgggccgcgtggtccgtcccacccgtacggttcgaggtgggtcgggtggggttcggtggggactaggttcgttacacttcctaccaccactacgacgactaccgcctcgacgtacgttcgtacggtaaacgtagtttttacgacgtttaagttttaacgtttactaggtacctaaggtaccgtaaagggtttaaagttaaacggttaacgggtcgggtacccgttaccgttacccgtttaaccgggttttccgggggaccggggttaaaccgggggtaaacccgttaaagggggtttacgggaaaccgtaacggttaaccgaacggggtaaacccggtaacgggttcgggttaacggggaccttaaccgggtacccttaacccggttaacgtttccggtttaccggtttaccctttacggttaacccgtttacccgtttaaccccccgg

SEQ ID NO: 295117 - DNA, 601 bp, Homo sapiens
  misc_feature: GYAE6OF02IUW8C.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccagggaccacgggagacatagtgctgacgcagtctccagccaccctgtctgtgtctccaggggacagacgccaccctctcctgcagggccagtcagactattagttacaccttagcctggtaccagcaaaaacctggccaaggctccccggctcctcatctatggtgcattccaccagggccgctggtgtccccaccctaggttccacggtggcggtgggtcgtggggacaggtgttcactcgtcacctatccagccagcccttgccgtagtccgtagaaagttcttttacgcctaagtttacttaactgtcaaggtccagttactagtaagtcgggtaccgctctaccggtttcggcggtagggtaaccctaagggtggaacgagttacgaggtaaccgaagtcggtacggtactacggacctacctagtccttacggttccttctacgttcccgttaccccg

SEQ ID NO: 295118 - DNA, 763 bp, Homo sapiens
  misc_feature: GYAE6OF02JFPYC.11.57.F02.1.454.CMB.1.raw
  modified_base (204)..(204): a, c, t, g, unknown or other
  misc_feature (204)..(204): n is a, c, g, or t
tcagcgagagataccacgaccggtgctcgatttagctcgatatagttgggtttggggaggagaactgctcagttaggaccagagggaaccatggaagccccagctcagcttctcttcctcctgctactctggctcccagactaccaccggagaaattgtgttgacacagtctccggccaccctgtctgcgtctcctgggaaacngtcacctctcctgcagggcagtcaaaatataacaactacttagcctgttaccaactacgaaacctggaccaggcctccccgaggacctcctcactcctatgatcgtctaagtttaggacggccactcggactaacctccccgaacccgttaggttccagggttccggacgtacggtcggggttcgtacggggaacgtacggtacctttcgtaatttcctacctaccgtaacgttcccggcgtacgtaccgtagaccggtacccttaaggtaacgtttacgttttcgacgtttaaacgttttaattaccgttggtaaaccctaaacggttcggtacggttaacggccaaacgggtccgttaaacggcccgtttacccggggcgttaaacccggggtttccggaaccccggttaaaaggggaccccgtaaaggggttcggaaaaccggttacgaacgggtaaccggtaactcgggggtaacgtaccggttacggaccctaccgtacgtttacggttcttaccgtttaccgaaccgttttccccggttcccgtaaccctacg

SEQ ID NO: 295119 - DNA, 699 bp, Homo sapiens
  misc_feature: GYAE6OF02JXB1J.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccgaggggacagacgccaccctctcctgcagggccagtcagactattagttacacgttagctgtacagacaaaacctggccaggcctcccggctcctctactctagtggtcgcactccaccgtacgggccgtcgtcggtccgtccccgaccgtaggttccaggtcgggcgggttcgggtcggtacggggacgtaggttcgttaccaccgtcgtccaaccgtacgtccgaacgtccgacgtccgtacgaccgtacggtcgtaaggtaacggttattttacgacgtttaagtttacgtacgttcgttacgtacgttacgtaagtttacgtaacgggttagtccgggtacctaccgttacgttaccggtttaccggggaccgggtaacgggtaacccgttaaggggtacggaacgtacgtacggtacgtaacggtaacgtgggtacgtaccggtaccgtaccgtaacgttactcggttacgttaccgttcgtaccttcccgttaacccgg

SEQ ID NO: 295120 - DNA, 809 bp, Homo sapiens
  misc_feature: GYAE6OF02H2OSA.11.57.F02.1.454.CMB.1.raw
tcagcgagagataccacgaccggtgctcgatttagctcgatatagttggggtttgggggaggaggaactgctcagttaggacccagagggaaccatggaagccccagctcagcttctcttcctcctgctactctggctccagataccaccggagaaattgtgttgacacagtctccggccaccctgtctgcgtctccgtaggggaacagtccaccctctccgtacgcgacggccaggtactaaaatacttaacaacgtacttacgccttcggttaccaacgaacgaaccgtcggaccgacggtcctaccccggaggtcctccttacacttacgtatcgagtgtacgtacgtttaggggacggacctacgtcggtctacctacccgtaccgtacggttcagggtacgacgtggtcgggtcggtacgggacgtacgtaccgtttactacgtttccacgtacctacgtacccgacgtaccgtaccgttacgacggttaccgtagtaaacgtttggttttcgtaacgtttaacgtttttaacgttaccgttacgtaccgtaaacgtacggttaaccgttacgtaaccggtacgtaacccgggtccgggttcccgggttacccggtacccgggttaacccgggttaccgggtaacccggaaacccgggggtaacgtaacgggtaccgggtaaaaccgggttaacgaacggttaccggaacggttcgggtacggtaccgtacggaccgtaaccgttaacgttcggtttaccttaccggttactcccggtttaccccgtttcccggtcttaaccgg

SEQ ID NO: 295121 - DNA, 655 bp, Homo sapiens
  misc_feature: GYAE6OF02HHCD8.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctcagccaccctgtctgtgtctccaggggacagacgccacctctcctgcagggccagtcagactagttagttacaccttagcctggtaccagacaaaaacctggaccaggcctaccccggctcctcactcgtacgtggtcgcactccgaccgacgggccgcgttcggtcgtacccctaccgtaggttcaggtgggacggtgggtcgtgggtacgtagtcgttacactctacactatcacgctacgtccgtcgacagtctagtaaacgttattttcgacgtttaagtttagttaccgtagttcgaagtcgtaagttacgtaaagttacgtcggaccgtcgttacgtaacggtttcggggaacgggtaacggtaccggtaaagggttaggaacgttaacacggtaacgtaccggtaaacgttcgggtacggtcgtaccgacgtaaccgttacttcgtacgttcctacgttaccgttcccgttaccccg

SEQ ID NO: 295122 - DNA, 795 bp, Homo sapiens
  misc_feature: GYAE6OF02JE823.11.57.F02.1.454.CMB.1.raw
  modified_base (214)..(214): a, c, t, g, unknown or other
  misc_feature (214)..(214): n is a, c, g, or t
  modified_base (557)..(557): a, c, t, g, unknown or other
  misc_feature (557)..(557): n is a, c, g, or t
  modified_base (575)..(575): a, c, t, g, unknown or other
  misc_feature (575)..(575): n is a, c, g, or t
tcagcgagagataccacgaccggtgctcgatttagctcgatatagttggggtttgggggaggaggaactgctcagttaggaccagagggaaccatggaagccccagctcagcttctcttcctcctgctacctctggctcccagactaccaccggagaaattgtgttgacacgagtctccggccaccctgtctgccgtcgtccgtaggggaaacncggtccaccctcgtcctgcgacggcagtacaaatactaacaactactacgccttacggtaccaacgtaacgaaccgtcggaccacggcctaccgaggtcctacctcgacttactagtcgtatcgtactaggttacgggacggaccctacggtcgactacctaccccgacgtacgtacgtacggtcgacgtcggtacggtcggtacgggaacaacggtcctttccgacttccgtaaccgtaccgtacgtacccggaccgtacgtaccgtacggtacggtacccgttagtaaacggttttcgttttacgaccgtttaattttacggaacgttcaaaccgtaaacnggttaaccgtgtaaaccncggtactaacccgggccgtacccggtaccggtacgggtacccggtaaccggaacgggttaaccgtacgggttaaaccggggaaacttaccgggaaaccgggtacgggttaacggtaccgggggtttacgaaccccgtacggtaacccgtacccgaggtttccctaaccggggtttctaaccccggttccggttttaaccccctcccgggtaacgttaccc

SEQ ID NO: 295123 - DNA, 777 bp, Homo sapiens
  misc_feature: GYAE6OF02I88D9.11.57.F02.1.454.CMB.1.raw
  modified_base (218)..(218): a, c, t, g, unknown or other
  misc_feature (218)..(218): n is a, c, g, or t
  modified_base (324)..(324): a, c, t, g, unknown or other
  misc_feature (324)..(324): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctccagggaccacgggagacatagtgctgacgcagtctccagccaccgtggctgtgtctccgaggggacagacgcccacctctccngcgagggccagtcagtacttattacgttacacctttagccttaggtaccagaccaaaaccgtcggaccacggcctccccggcttcccgtcactctacgttggtacnctactccgaccgtacgggcctcgtggtccgtacccaaccgtggtccaggtcggcgggtggtcgtcgggacgtagttacgttcgtactcacgtaaccacgttacacgactacgtcgtacgtcgtaacgttccggtaagtaagtttacgttttacggtacgttaaacgtttttaacggtactttacgggtaccgtagtaacgttaagttaaacggttacggtaaacggtccgggtcccgttaacttacccggtttacgggttaccggggtaccggggttaaacgggtaacccggttaaagggggtacccggtaagttaacccggtacgggtaaccgttaaaccggggtaaccgttcggggtttacggaaccggttacccggtaaccgtaacccgtttaagtcccggtttaaccggtttcccttaaccgtttacccggttacccctttaaccccgg

SEQ ID NO: 295124 - DNA, 684 bp, Homo sapiens
  misc_feature: GYAE6OF02JLH35.11.57.F02.1.454.CMB.1.raw
  modified_base (171)..(171): a, c, t, g, unknown or other
  misc_feature (171)..(171): n is a, c, g, or t
  modified_base (202)..(202): a, c, t, g, unknown or other
  misc_feature (202)..(202): n is a, c, g, or t
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
  modified_base (339)..(339): a, c, t, g, unknown or other
  misc_feature (339)..(339): n is a, c, g, or t
  modified_base (644)..(644): a, c, t, g, unknown or other
  misc_feature (644)..(644): n is a, c, g, or t
  modified_base (660)..(660): a, c, t, g, unknown or other
  misc_feature (660)..(660): n is a, c, g, or t
  modified_base (665)..(665): a, c, t, g, unknown or other
  misc_feature (665)..(665): n is a, c, g, or t
tcagcgagagataccacgaccggtgctcgatttagctcgatatagttgggtttgggggaggaactgctcagttaggacccagacggaaccatggaagccccagcgcagcttctcttctcctgctactctggctccaggaccaggagacagtagtgctgacgcagtctccancccaccctgtctgtctctccgagggacagcnccncctctcctgcgaggccagtcaggtacttagttacgtaccaccttaggccttaggtaaccaaaccaaaacgtcggacccacggcctaccccggctaccgtctacgtacctgtaggtcgcactccaccgnggcccngtggtcctaccgaccgtagttcgacggttcgggacgggtttcggtaccgtagggaaccttagggttcgtaccgtacgtttcaacgtaccgtacgtacgtaccggacctacgggtccttacgggtacacggtacgttcggaaacgtttcgttttacgtacgttaagttttacgttaccgttacgcgttaaggtaactagggttaaacttagggttaacggtacctccggtcgttacccggttacgtttccggggcgtaacgggtacccgtaaggtcgggagttacgacgaagtaccgagtgtacgngttcgaactcgtacgntcgtnttaccacttcctcccgtac

SEQ ID NO: 295125 - DNA, 705 bp, Homo sapiens
  misc_feature: GYAE6OF02GINKY.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgcctactctggctcccagggaccacgggagacatagtgctgacgcagtctcagccaccctgtctgtgtctccgaggggacagacgccaccctctcctgcagggccagtcagtactagttacgtacaccttagccgtaggtaccagaccaaaacctggaccaggcctacccccgctccctacactactagtcgtagactactcccaccgacgggccgtcgtcggtcctaccccaccgtaggttccgaggtcggcgggttcggtcggtacggggtacctaggttcgttacgaccgttcctacccgtacctacgtaccgacgacccgaccggtacctggaccctagtccgtagtaaacgtttacgtttcgacgtttagttacttaacgtgttacgagtacagttagtaagggtacgtggccgttcctcgtacgtttcgggacggtacggtacccgtaggtacggaagtagttacccggaggtaacccggtagttacgggtaccggttccgtacgaaccgttaacccgttacgtttaccggttacccgtttaacccttccgttaacccgttccccgtttacccccgg

SEQ ID NO: 295126 - DNA, 819 bp, Homo sapiens
  misc_feature: GYAE6OF02GIJSO.11.57.F02.1.454.CMB.1.raw
  modified_base (757)..(757): a, c, t, g, unknown or other
  misc_feature (757)..(757): n is a, c, g, or t
tcagcgagagataccacgaccggtgctcgatttagctcgatatagttgggtttggggggaggaggaactgctcagttaggacccagagggaaccatggaagccccagctcagcttctcttcctcctgctactctggctcccagataccaccggagaaattgtgttgacacagtctccggccaccctgtctgcgtctccgtggggaacagtccaccctctcctgcgagggccagtacaaaatattaacaactacttacgcctaggttccaacacgaaaccgtggccaggcctacccaggcctcctacatcctatgtatgactaagtttagggacgggtccaacgttcgggacacctacccccgaacccgttacggttaccgtacggtcggccgtagggttcggggttccggtagggggacgtaaccggttaccgttaccttacgtttccttaccgaacccgtaccgttcccggtacctaacgtacccgtttaacggaccggtaccgttaaaggtaacggtttacgtttttaacgtccgtttaacgtttttaacgtttacttacggtaaccctaacggtacggttacggtaacgtaccgacgggtaccgaccgggtacccggttcccgggacccgggttaaccgggttaccggggtaacccggtaaaccggggtaacccggtaacgggggttaacggaacgggttaacgaacgggaaccgttacggtgggtccgggacgttacggacccaacccggttnttaccggttacgtttaccgttcccgttaaccgtttccccgtttaccccggtacttaacccgg

SEQ ID NO: 295127 - DNA, 741 bp, Homo sapiens
  misc_feature: GYAE6OF02JA1XC.11.57.F02.1.454.CMB.1.raw
  modified_base (207)..(207): a, c, t, g, unknown or other
  misc_feature (207)..(207): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgctcctcctggggaaacngtcaccctctcctgcaggcctagtacaaaatattaacaacttacttacgccttggtacccaaacacgaaaaccgtggaccaggcctacccgaggcctcctcatctatcgatgctaaggttacggacgggtccacgtcggacactaccccaaccgtaggttcacggtagggtcctagggttcggggtcgtacgggaacgtacgtacgttaccattaccgtaccaccgtacttcccggactaccgacccgtaacggtaccggtaccgttacggtaaacgtttacgttttacgaccgtttaagttttaagtttaccgttacgggtaaacctaaaccggtaacgttacggttaccgacgttaaccgaaccgggtaaccggtcccggtacccgggaaccggttacccggttacgggacccgtaaacggggtaccgtaaacggggtacggtaaacggtaaccgaagtccgaagttcggtacggtcgtacgaccgaactacggttctacgttcttactacgttcccgtaccgtaccctacg

SEQ ID NO: 295128 - DNA, 599 bp, Homo sapiens
  misc_feature: GYAE6OF02F6TQM.11.57.F02.1.454.CMB.1.raw
  modified_base (461)..(461): a, c, t, g, unknown or other
  misc_feature (461)..(461): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagcccaccctctcctgcagggccagtcagactattagtacaccttagcctggtacagacaaaacctggccaggctccccggctcctcatctatggtgcatccacgagggccgctggtctcccgacccgaggttcaggtgggcgggtgggtcgtcgggacgtggttgttcactctcaccatacagcagtcctgactagtacgtagaagttagtttgcttagtttatacgttgtctagactagtagtagtagtgggaccnctacgttacgttacgggcgggagggtaccgtaagggtacggagtaacgtgacggaacggtaacgtcgggtacggtccggtagaccgtaacccgtacgttccgttacgttcctttaccgtacttcccgtttacccccgg

SEQ ID NO: 295129 - DNA, 716 bp, Homo sapiens
  misc_feature: GYAE6OF02HCA13.11.57.F02.1.454.CMB.1.raw
  modified_base (170)..(170): a, c, t, g, unknown or other
  misc_feature (170)..(170): n is a, c, g, or t
  modified_base (205)..(205): a, c, t, g, unknown or other
  misc_feature (205)..(205): n is a, c, g, or t
  modified_base (671)..(671): a, c, t, g, unknown or other
  misc_feature (671)..(671): n is a, c, g, or t
tcagcgagagataccacgaccggtgctcgatttagctcgatatagttgggtttgggggaggaggaactgctcagttaggacccagagggaaccatggaagcccagctcagcttctcttcctcctgctactctggctcccagactaccaccggagaattgtgttgaccacngtctccgccacctgtctgcgtctccgtgggaaacngtccaccctctcctgcgacggacctagtacctaaaatacgttaaactaaacgttacttacgacccgttacggttaccaaactaacgtaaaaccctggaccctaagggtcccttacccggacggtacctaccgtacaacttcccgttaataggacttcggtacgtaagttttaacgggacgggtacctacggtccgggacctaaccgtcccccgtaaccgtacggttcgaacggttagggtaccctggggttcggttaccggtaggggaacctcggtacttactcgtacttccgaacctccgtcccgactagtccgtagtacgaccgtaagtacttcgttttaacggacgttttaagttaactcggttaagtaccaacggtagttactaggccaagcccgtacgtccgcgtaccggtcgtacggacctaaggcccgaggtacggacgcgacgagtagacggtcgacncggtacaaccgtctacgtcgtactcctacgtcccgtaccacttag

SEQ ID NO: 295130 - DNA, 724 bp, Homo sapiens
  misc_feature: GYAE6OF02FXHVW.11.57.F02.1.454.CMB.1.raw
  modified_base (187)..(187): a, c, t, g, unknown or other
  misc_feature (187)..(187): n is a, c, g, or t
  modified_base (213)..(213): a, c, t, g, unknown or other
  misc_feature (213)..(213): n is a, c, g, or t
  modified_base (335)..(335): a, c, t, g, unknown or other
  misc_feature (335)..(335): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctccagggaccacgggagacatagtgctgacgcagtctcagccaccctgtctgtntctccaggggacagagccctaccctntacctgccgagggccaggtcagactattagttacaccttagcctggtaccagtacaaaaacctggaccacggcctaccccggctccgtacactctactggtcgcactcccacgacgggtccncgtggtcgcccctaccgcggttcagtggtcgggtaggtcgtacggggactaggttcgttacgacgtctacaccgtaatccgaacgcgacgtcccgtacggtacctacggttcctaagggtaacgtttacgttttgaccgtttagtttaaccgtttactacggttacagggttaccaaggtttataaagggtagttacggccgtacgttaccggttacggtttccgggaacgggttacggggaaacccgtaagggttagggtaacgtacgtaaccgggtagtaaaccgggtaaccggttaggtaccgggtacccgtacgttaaccctaacccggtatttcccggttttaaaccgtccggtttaacttaccgtttcccccgttaacccccg

SEQ ID NO: 295131 - DNA, 736 bp, Homo sapiens
  misc_feature: GYAE6OF02GEL3S.11.57.F02.1.454.CMB.1.raw
  modified_base (208)..(208): a, c, t, g, unknown or other
  misc_feature (208)..(208): n is a, c, g, or t
  modified_base (300)..(300): a, c, t, g, unknown or other
  misc_feature (300)..(300): n is a, c, g, or t
  modified_base (585)..(585): a, c, t, g, unknown or other
  misc_feature (585)..(585): n is a, c, g, or t
tcagcgagagataccacgaccggtgctcgatttagctcgatatagttggggtttgggggaggaggaactgctcagttaggacccagagggaaccatggaagccccagctcagcttctcttcctcctgctactctggctcccagactaccaccggagaaattgtgttgacacagtctccggccacctgtctgcgtctcgtaggggaacncgtcacctctcctgcgaggccagacaaaataactaacaactacttagcctcggtacaactacgaaacctcgccaggctacccgagcctaccntatctatgtatgtacgtaagttagggacggcctaacgtggacctacgtacccccgaccgtaggttacgtaacggtcggacgtacgggttcggggtaccgtacgggtaactaacggttacttacctaagttccctaaccgaaccgtaccgtcccgtaccgtaaacgcccgttaacgacgtccgtaagtaaacgttcttttacgggaactttaaccgttttaaggttaacctagtaacgaactaccggttagaactcgacgtaaccgccggtacccgttacccgggngttaaccgggttccgaaccgggtaaacgggacccggtaagttaaccggaacgtacgaaacggccggttaagacggtccgggtcgtaccgacgtaacccgttagttaccgttacgttcctaccgtacgttaccccgtcccggtaataaccgg

SEQ ID NO: 295132 - DNA, 659 bp, Homo sapiens
  misc_feature: GYAE6OF02GVVO4.11.57.F02.1.454.CMB.1.raw
  modified_base (203)..(203): a, c, t, g, unknown or other
  misc_feature (203)..(203): n is a, c, g, or t
  modified_base (316)..(316): a, c, t, g, unknown or other
  misc_feature (316)..(316): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
  modified_base (410)..(410): a, c, t, g, unknown or other
  misc_feature (410)..(410): n is a, c, g, or t
  modified_base (416)..(416): a, c, t, g, unknown or other
  misc_feature (416)..(416): n is a, c, g, or t
  modified_base (454)..(454): a, c, t, g, unknown or other
  misc_feature (454)..(454): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctgctccagataccaccggataattgtgtgacacagtcctccggccaccctgtctgcgtctcgtagggaacngtcacctctcctgcgtacgggcagactaaaatattaaccaactacttacgccgtacggtaccaacaacggaaccgtcggaccacggaccctccgagtcctacctcattcgtancgtatgctacaccgaacgacgggtcccnggaccnccacccngtccgtagttcgaggcgtcgaggtcggtnacggtanacgtacttcaccgttcncgtacncgtcacgtccgaagcctagaccgtcgtacgtaggtttnttacggttacttaggttacttccggtataccgtacgtacgttacgtacgtcgtcgtacggtcgtaccgtccgtaccggtacgacgaacgtaccggtaactaacgggttaaagtaacttaaccggtcgtaggtaccgtaggtaccgtattaaccgtcgttacttaccggtttccttacgttacccgttccgtaccctccgttaagg

SEQ ID NO: 295133 - DNA, 762 bp, Homo sapiens
  misc_feature: GYAE6OF02F82RP.11.57.F02.1.454.CMB.1.raw
  modified_base (263)..(263): a, c, t, g, unknown or other
  misc_feature (263)..(263): n is a, c, g, or t
  modified_base (485)..(485): a, c, t, g, unknown or other
  misc_feature (485)..(485): n is a, c, g, or t
tcagcgagagataccacgaccggtgctcgatttagctcgatatagttggggtttgggggaggaactgctcagttaggacccaggacggaaccatggaacgccccagcgcagcttctcttcctctgctactctggcctcccagggaccacgggagacagtagtgctgacgcagtctccagcctacctgtctgtcgtctccgaggggaccagacgcccacctctccgtgcgtagggccaggtcagacttattacgtacacgttancctaggtaccagacaaaaccgtcgtccacggtccgtcccggctcccgtcacgttcctagtggtcgcactccgaccgacgggtccgcgttggtccgtcccaccgtacggttaccgtacggtcggcgggtcgggtcgtaggggtactacggttcggtttacgtactcgtaccgaacctactacgaacgccacgtcctcgacgaacgttcgtacgtaaacggttnttttacggtacgtttacggtttaacttaccggttggtaacgtacggtacctagggtttaacgttaacggtacggttacggtcccggtccgtttaaccgtacccggttttaccggggacggggtaacccgggtaaccggtaacggggttacggtaacggttacgtaaacggacggtaaaccgggtaacgttcggggttaaccggcggtaaaacgtccgtaaacccgttacgttaccgtttaccggttaccttaccgttaccgttaccccgttaccccg

SEQ ID NO: 295134 - DNA, 606 bp, Homo sapiens
  misc_feature: GYAE6OF02FRMUN.11.57.F02.1.454.CMB.1.raw
  modified_base (307)..(307): a, c, t, g, unknown or other
  misc_feature (307)..(307): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtccaccctctcctgcagggcccagtcagagtagttaacagctacttagcctggtaccaacagaaacctggaccagacctcccaggctccctctatctangactgcaatccaaccgagggcccacgtcgggaccaacccccgaacgcctacgggttcacggtggaccgaggtcggggtctcggggacaggacctttacacctctacgaccctagtccagtacacgacctaggacgaccgtggaggtagttttcgtctaagtttaacgttaacgttcgtcgagcgtagtcgtatacgtacgtggtatctaccgttcggaccgaagggactacgacgtagtaaacgtaaacagtatcggtacgtcgactacgactctcgttcttacgtctaccttaccccg

SEQ ID NO: 295135 - DNA, 679 bp, Homo sapiens
  misc_feature: GYAE6OF02IV56N.11.57.F02.1.454.CMB.1.raw
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (189)..(189): a, c, t, g, unknown or other
  misc_feature (189)..(189): n is a, c, g, or t
  modified_base (316)..(316): a, c, t, g, unknown or other
  misc_feature (316)..(316): n is a, c, g, or t
  modified_base (453)..(453): a, c, t, g, unknown or other
  misc_feature (453)..(453): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgntgacgnagtctccagcaccctgtctgtntctccaggggacagacgcccaaccctctcctgcacgggccaagtcaacgtactattagttacaccttagcctggtaccagacaaaaaccgtgccaggacctcccggctccctactactctaatggtnctactccaaccgtaacggccgcgtgtcgtacccacccacggttcaggtacggcggtaggtcgtaggggacgtagtaggttcactactccaacctactacgagctaacgccgtacgacacgtactagaacgtatttanacgtagtttaacttacgtagtacaacgtcgaacgttaagtaacgttaagacggtccgtacgttaccgtaccggttttacggccgggtaaacgggtaacccggtaagggtaggtaacgtagtaccgtaacggtaacggttaaaccgtggttacggtacctaaggtaccctaaaccgtaacgttccggtttacgttaacgtttaccggtaccttaccggttacccccg

SEQ ID NO: 295136 - DNA, 768 bp, Homo sapiens
  misc_feature: GYAE6OF02IPWB9.11.57.F02.1.454.CMB.1.raw
  modified_base (289)..(289): a, c, t, g, unknown or other
  misc_feature (289)..(289): n is a, c, g, or t
  modified_base (297)..(297): a, c, t, g, unknown or other
  misc_feature (297)..(297): n is a, c, g, or t
tcagcgagagataccacgaccggtgctcgatttagctcgatatagttggggtttgggggaggaggaactgctcagttaggacccagagggaaccatggaagccccagctcagcttctcttcctcctgctactctggctcccagataccgaccggagaaattgtgttgacacagtctccggccacctgtctgcgtctccgtaggggaaacagtccaccctctcctgcgacgggcagtacaaaatattaaacaacttactagccttggtccaacacgaaccgtgccagccnccgagccnctacatctatgatgactagttggacgggcctacgtggaccacgtacccctaaccgtacggttaccgaggttacggacgtacgggttgggtcgtacggggaactacgtaccgttactccttacgtaccaaccgtagttccccgagtacggtaccgtaacggacgtaccgtaaggtaactttaggttttcgacttaggttttaactacgttacgtaacgtaacgtaacggtacgttaccgacgtaccgtacggaaccgggtcccgtaccccgggtacgggttaacccggttacccgggaaccgggttaaaaccgggtaccggtaaacgggttaacggggtaaaccgtacgggtaaacgttaacccggggtacgtttaacgggtccggtaaaccgttcgggaaccctaaccggtttacgtcgtttacccgttacgttaccgttacccggtttccctttacccccggattaaccg

SEQ ID NO: 295137 - DNA, 829 bp, Homo sapiens
  misc_feature: GYAE6OF02GPQRN.11.57.F02.1.454.CMB.1.raw
  modified_base (155)..(155): a, c, t, g, unknown or other
  misc_feature (155)..(155): n is a, c, g, or t
  modified_base (170)..(170): a, c, t, g, unknown or other
  misc_feature (170)..(170): n is a, c, g, or t
  modified_base (176)..(176): a, c, t, g, unknown or other
  misc_feature (176)..(176): n is a, c, g, or t
  modified_base (208)..(208): a, c, t, g, unknown or other
  misc_feature (208)..(208): n is a, c, g, or t
  modified_base (222)..(222): a, c, t, g, unknown or other
  misc_feature (222)..(222): n is a, c, g, or t
tcagcgagagataccacgaccggtgctcgatttagctcgatatagttggggtttgggggagaactgctcagttaggacccagacggaaccatgggaagccccagcgcagcttctcttcctcctgctactctggacctcccgagggaccacggganacatagtgctgacgnagtccncacgcctacctgtctgtcgtcaccgagggacngacgccacctctcngcgacggaccagtcaagtactatttagtaaccacgttacgccgttcgaaccgtaacgaaccgtaaaaccgtcggaaccgacgggtacccctcccgggacttacccttagtacctagttacgttgggtctaacgtaccgtaccgaaccggtaacgggcccgtacgtcgggtaacctaccccggaccgttacgggttcgtaaggggtcgggtaccgggttggtacggtacgggggtaaccttagggttaacgttcctaaaccggtttacacccgtaaacgttacgtaccggagttacccggtaaccggtcgttaccggacgtttccgtaacgttaagttaacgggtttaaatttcgtaaccgttaacgttttaacgttaacccgtagttaccgttacgtaacgttaaggttaagttaaccgggttaccggtaacgggtcctaacggttaccggtttaaccgggtcgggttaaccggggacggtaaacgggtaacgggtttacgaaggtacgtaacgtacccgggtaaggttaccgttaacgggttaccggcgtaccgtaaccgtaccgtaattccgtttacttacggttaaccttaccgtacctacccg

SEQ ID NO: 295138 - DNA, 690 bp, Homo sapiens
  misc_feature: GYAE6OF02IZFEP.11.57.F02.1.454.CMB.1.raw
  modified_base (420)..(420): a, c, t, g, unknown or other
  misc_feature (420)..(420): n is a, c, g, or t
  modified_base (444)..(444): a, c, t, g, unknown or other
  misc_feature (444)..(444): n is a, c, g, or t
  modified_base (508)..(508): a, c, t, g, unknown or other
  misc_feature (508)..(508): n is a, c, g, or t
  modified_base (513)..(513): a, c, t, g, unknown or other
  misc_feature (513)..(513): n is a, c, g, or t
  modified_base (532)..(532): a, c, t, g, unknown or other
  misc_feature (532)..(532): n is a, c, g, or t
  modified_base (559)..(559): a, c, t, g, unknown or other
  misc_feature (559)..(559): n is a, c, g, or t
tcagcgagagataccacgaccggtgctcgatttagctcgatatagttgggtttgggggaggaactgctcagttaggacccagacggaaccagtggaagccccagcgcgagcttcgtcttcctccctgctactctcggctacccagggaccacgggtagaacatacggtgacttggacgacctaggtcctccaacgcctaacccctggttctggtactacccgtacggacgggacacgaccgcccacccttcgtctacgcgtacgggcctacgtcgaacggtattacgttaacgtttacactttaccggcttacgaaccgactacgtaaaaaccgtcggaccgaccgtccgtaccccggcctaccctcgtactacctagtacggtgacgacctccgaccgtaacgccgtaccgtcggtccnccgaacctcgtaccgaggtaccgnggggtaccgttcggtccgaggtctcggttactctactccgaacgtacacgtgacgtacgcgtanccgtntacgtgaactttcgtagtnttacttagtcctaggcacgataccgtnaacgtccaagcgttcgtccgtaccgttcgaacgaacgtaccgaacgtaacgggaaattaacgtaaagtcgggtaactaggctaccggtacaactacgtacgtacgtcttaccggatccctaccgttactcg

SEQ ID NO: 295139 - DNA, 713 bp, Homo sapiens
  misc_feature: GYAE6OF02FJ63E.11.57.F02.1.454.CMB.1.raw
  modified_base (246)..(246): a, c, t, g, unknown or other
  misc_feature (246)..(246): n is a, c, g, or t
  modified_base (361)..(361): a, c, t, g, unknown or other
  misc_feature (361)..(361): n is a, c, g, or t
tcagcgagagataccacgaccggtgctcgatttagctcgatatagttggggtttgggggaggaactgctcagttaggacccagacggaaccatggaagccccagcgcagcttctcttcctcctgctactctggctcccagggaccacgggagacatagtgctgacgcagtctccagccaccctgtctgtgtctccaggggacagagccacctctcctgcagggccagtcagactatagtacactancctggtaccagacaaaactgaccagcctcccggctcctcatctatggtgcactcccaaccgacgggccctctggtcgtcccaccgtaggttcaggtcggcggtggtctgggaccnggttcgttacgactcgtactaccgtaacgttaccgagcccaacgggtcccgtacgccgtacggttaccgttagggtaaacgttacgttttcggaccgtttaaggtttaaccttaacgtacggttacgtacgaccgttaaggttaagttaacggttaaacggtcgggtacccgttacgttacccgtaccggtttttacggggaccgggttaacggggtaaccgtaaacggggtacggtaacgtagtacccggtaaggtaaccggtaacgtttgggtaaccggacttacggaccccgtaagtaccgttaccgttacggttacccgttttaccgtactttaccccgttaccccgg

SEQ ID NO: 295140 - DNA, 750 bp, Homo sapiens
  misc_feature: GYAE6OF02HY2PK.11.57.F02.1.454.CMB.1.raw
  modified_base (208)..(208): a, c, t, g, unknown or other
  misc_feature (208)..(208): n is a, c, g, or t
tcagcgagagataccacgaccggtgctcgatttagctcgatatagttgggtttgggggaggaggaactgctcagttaggacccagagggaaccatggaagccccagctcagcttctcttcctcctgctactctggctcccagactaccaccggaagaaattgtgttgacacagtctccgccaccctgtctgctctccgtaggggaacncgtacctacccgtctcctgcgcgggccagtaacaaaatacttaacaactacttacgcttcggtaccaacaacgaactcgaccgacgcctacccgacggtcctcctacactctatagataggccttaaggttaacgggacggtaccacggtcgaccacctacccccaccgtacggttacgtacggtacggtacgtaggttcggggttacgtagggaacctagtaccgttactacgttacctaccacctaccgtcccgaccacgtaccctacgaccgtcgttaacggtaacgtttagtttacgtaacgttttacgttttaccttaacgttccgtaacctaacggtaccgttacggtacgtacgactacgggaccggtcccggtacccgggtcggttaccgttacccgggaaccggaaaccgggtaacggacgggttaagggaacgtaaccgaacggtaccgttaaggtcgggttaccgcggttaccgaccgtaaccgtacgttcttacgttcccttattacccggttccctacccgtcgtaacg

SEQ ID NO: 295141 - DNA, 864 bp, Homo sapiens
  misc_feature: GYAE6OF02GRYEO.11.57.F02.1.454.CMB.1.raw
tcagcgagagataccacgaccggtgctcgatttagctcgatatagttgggtttgggggaggaggaactgctcagttaggacccagagggaccatggaagccccagctcagcttctcttcctcctgctactctggctcccagataccaccggagaattgtgttgacacagtctccggcaccctgtctgacgtctccgtggggaactagtcaccctctcctgcgacgggccagtaccaaaattattaaccaactacgttacgccttacggttacccaacgacgtaaaccctgggacccgtagggcctacccctagggcccttcccgtactaacttcgtaacgtcggtaactacggcaacttcccgtaaaacgaccgggtacccgtaccgttacgggacccctaaccccgagtacccggtaacgggttaccaagggttccgggtacgaccggggttcggggttacccgttagggggaaccctacgggttaacccttacggtaaccttacccgtaactaaccccgtaacgttaccggaacgtaccgacgtacccgttaaggaccgtacccgttggtaaacgggtttattttaccggtacgtttaacgttttaaccgtttccgtagggttacaacggtaccgaaggttacgttaccgttaccggtaagtacgggtacctttacccgtaccgggtttacccggtaaccggtaacggggtaacccgaaaccgggttaaccggttaaaggggttaaaaaccttaaccgggtaaccgtttgggtaccggttaaccgaccggtaacctacccggttacgttccgtttagggttacccctttcgtaaccctttccctttacccggacccgttacg

SEQ ID NO: 295142 - DNA, 758 bp, Homo sapiens
  misc_feature: GYAE6OF02JMN5E.11.57.F02.1.454.CMB.1.raw
tcagcgagagataccacgaccggtgctcgatttagctcgatatagttgggtttgggggaggaactgctcagttaggacccagacggaaccatggaagccccagcgcagcttctcttcctcctgctactctggcctcccgagggaccgacgggagacatagtgctgacgcagtctccagccaccctgtctgtcgtctccgaggggacagacgcccacctctcctgcgacggccagtcagtacttattacgtactaccttgcctggtaaccagaaccaaaacctcggacccgacggtccccgtaccccggccttccctacgtactacctaggttcggtacgcctacctaccgtaccggaccgggcccgtccggttacggtccgtaccccctaaccgttcgggttaccgtacggttccggggtcgggttcggggtcgttaccgggggaacttacggttcggttacctaccgttaccctccggtaaccctaagttccgaacgtccgtaccgtccgtacggtactacggtacgtagtaacggtttacgttttacggtactttaacggtttaagtacgttacggtagtaacgtacttaaggttaacttaacggtacgggtaccgtcgtaacgttaccttacgggttacgggacgggttaaccggcggttaagggtacgagaccgtacggacgtaacggacgtcggttagccggtcgaaccaccggttagtccgttcgttactccgttaccgtcccgttaacccg

SEQ ID NO: 295143 - DNA, 788 bp, Homo sapiens
  misc_feature: GYAE6OF02G9N12.11.57.F02.1.454.CMB.1.raw
  modified_base (224)..(224): a, c, t, g, unknown or other
  misc_feature (224)..(224): n is a, c, g, or t
tcagcgagagataccacgaccggtgctcgatttagctcgatatagttgggtttgggggaggaactgctcagttaggacccagacggaaccatggaagccccagcgcagcttctcttcctcctgctactctggctcccgagggaccacgggagacatagtgctgacgcagtctccagcccaccctgtctgtgtcctccgaggggacaggacgcccaccctctccngcgacgggccagtcagtacttattagttaccacgttacgccgtaggtaccacgaaccaaaaccgtggaccgacggccctccccgtctcccgtcacttctagtggtgtccgactcccgaccgtacgggcccgtacgtcgggtcccgtaccccgacccgtacgggttcgaggtcggggtccgggtgggttccggtaggggtaacctaggttcggtttacctaccgtaccgtacctaaccgtatccacggtcctaacggccttacggacctacggttcctagggtaaatttcggtttacgtcgtttaacgtttaacgttacgtacggtacgtacgtaccggttaagttaaccgttagggttaacggccgggtcccgtacccggtttaccgttaaccgggtttaccgggggacccggggtaaccgggtaaccggttaaagggggttacggaagttaacccgggttcggaacggtaaaccggtacgttaccgggtacgggttacgacccgttccgaaccgtttgtcccgtttaccgtttcgtacccgttacgtttcccccgtaccccgg

SEQ ID NO: 295144 - DNA, 572 bp, Homo sapiens
  misc_feature: GYAE6OF01B7CGF.11.2.A02.1.454.CMB.1.raw
  modified_base (509)..(509): a, c, t, g, unknown or other
  misc_feature (509)..(509): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaactggtggagtctgggggaggcttggtccagccgtcggggggcccctgagactgtcctgtgaagcctctggtttcagtctttagtaaacgttttggatgaggttcgggtccgccagcctccgaggggaaggggcgtgggaggtgggtcggaccaagtagtaaaaggaaggagtggaagtgaaggtaacgttagacgggctcgtggtaggaaggggcgtattcaccatcctccagacgacaacgaccaagacgactcactgtatctgcagatagaacagcctgacgagtacgaacggacaccgattatattattacgngcgacgagtatctacaacgaagtaacttcccgactaacttattaattagtaggtaagtacggg

SEQ ID NO: 295145 - DNA, 671 bp, Homo sapiens
  misc_feature: GYAE6OF01BQVGW.11.2.A02.1.454.CMB.1.raw
tcagcgagagataccacgaccggtgctcgatttagactcatctacagggggtctcagagaggagccttagccctggactccaaggcctttccacttggtgatcagcactgagcacagaggactcaccatggaattgggctgagctgggttttccttgtcgctattttagcaggtgtccggtctgacgtgcaactggtggagtcgtggggggaggcgttggtccgaggcccgtcgggggggccccctggacgacgtgtccctggtgaagcctctggtttcagtctttagtaacgtttggagtggtaggttcggtccgccacgccgtaccggaggggaacgggcgtgggaggtgggtacggaccgtaagtaagtaaaaggaagggagtagggaagtaggaaggtaacgttagtacgggtactacgtaggtacggaaggggtcgtaacgttccaaccgtactacctaccgaacggaacgaaccgaaacggacccgaaaggacgtacctacgtaacgttagtactcgtaggacctaagaagtacgaacgcgacgtagagtaacggcggaacgaccacccgattaataattatacgtgacggacgtaagtactcctacaaacgtaaagtacccttccgtacccttaattacttaatagtacggtaagtaaccgggg

SEQ ID NO: 295146 - DNA, 837 bp, Homo sapiens
  misc_feature: GYAE6OF01DL4U0.11.2.A02.1.454.CMB.1.raw
  modified_base (673)..(673): a, c, t, g, unknown or other
  misc_feature (673)..(673): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattgggctgagcgttgggttttcctgtcgcttattttagcaggtgtccggtctgacgtgcaacgtggtggagtcgtgggggagtcgttggtccaggcccggtcggggggcccctaggacgtaccgttcggttccctggtagaacgtcccgttcgtttcggttttccgagttccgttttaaggttaaaacggtttttggaagttggtacgggtttcgggtcccgaccgtacggtccccgtaccggggaagggggaacggggtcggtaggggtagggttcggggtacggaaccctaaaaggttaaaagtaaaagggtaaagggtaaggtaagggtaaaggtaacggtaaacgggggttaaaccggtttaacgggtaaccggggtcctttacggttagggtaacggggtaaacgggggtccgtaaacggtttacccaaccgtttaacgtaccccgtaaccgaacgggaaccgaaaccgaacccggaacgtaacggaacgtcctacgtaacgttagtactcgtacgacgtaagaagtacgaaccngtccgtaaggacggtacggaccggaacggaacccgtaccgtaacttagttaaactacgttaacgtcggaccgtacgaataccgtacctaacaaacgttaacgtaacccgttaccccgtacgttaactttaagttaaccttaggttaacggaacggttaccgggg

SEQ ID NO: 295147 - DNA, 854 bp, Homo sapiens
  misc_feature: GYAE6OF01CUAU2.11.2.A02.1.454.CMB.1.raw
  modified_base (744)..(744): a, c, t, g, unknown or other
  misc_feature (744)..(744): n is a, c, g, or t
tcagcgagagataccacgaccggtgctcgatttagactcatctacagggggtctcagagaggagccttagccctggactccaaggcctttccacttggtgatcagcactgagcacagaggactcacatggaattgggctggagtcgttgggttttccttgtcgtcttattttagcgtaggtcgtccggtgtgacgtgctaagtggtggagtcggtgggggaggtcgttggtccgacggtccggtccggggggccctggacgtcgttcggtccgtggtacggtaacgtccgttcgtttcggtttccgagttacgtttaggttaaaacggttttgggaagttgggtaacggttttcggggccccgtccgtaaccggtccccgttaaccggggaacgggggtaacggggtccgtggggaacggttcggggtacggaaccgtaaaagtaaaaggtaaaaagggaagggtaagtaaggggtaaaggtagggaaacggttaaacggtttaagggtaccgggtacgttacggtagggtaacgggaacgggggtacttaacggtaccctaaccgtacgttaccgacgaaacggaacgaacccgaaaccggacgaaacggtcggaccttaacccgttacttacgggtaccttacgtacgtaacgtaaacggtaagaacgaaccgtaacgtccggtagaacgggaacggtacgaaaccggtaccaacccggttattaattaagtactttaccgngggtaccctaggtaacgttacctaacctaaccgaaacgtaaacggttaccccttaccgtaacccgtttaataaccgttttaagtttacggaagggttaagttaccggggg

SEQ ID NO: 295148 - DNA, 820 bp, Homo sapiens
  misc_feature: GYAE6OF01DNBMW.11.2.A02.1.454.CMB.1.raw
tcagcgagagataccacgaccggtgctcgatttagactcatctacagggggtctcagagaggagccttagccctggactccaaggcctttccacttggtgatcagcactgagcacagagactcaccatggaagttgggctgagcgttgggtttttccttgtcgtcttattttagcaggtgtccggtctgacgtgcaacgtggtggagtcggtgggggaggtcgttggtccgacggcccggtcggggggccccctggacgtaccgttgtccgttggtacgaacgtcccttcgtttggttttccagtccttttaggtaaaacggtttttggaattggtaggttcgggtcccgccgacggccccttaccggaagggggaaagggggccgtaggggtagggttaggggtacggacctaaaagttaaagttaaaaaggaaaagggtagtaagggaaaaggttcgggaaagggtaaacggtttaaggtaaccggggtcttacggttagggtagggaaacgggggtctaacgttaccgaacccgtactccgttacccgaaagaacggaaccaaaccgacccgtaaagacgtacctacgtacgttaaggttaactcgtacgacgaagtacgtacggaaacgtacggaccttagggaacggtaacgtaccgggaaaccggtaccctaacccggtactttaattaacgttagttaaccggtcgaaccggccggtaatacgttacctaacgaaacgtaaaacgttaacccgtttcccgttaaacctttacgtttaaattttacgtttaagtagggttaaacgttacggggg

SEQ ID NO: 295149 - DNA, 640 bp, Homo sapiens
  misc_feature: GYAE6OF01BIXP4.11.2.A02.1.454.CMB.1.raw
  modified_base (499)..(499): a, c, t, g, unknown or other
  misc_feature (499)..(499): n is a, c, g, or t
  modified_base (552)..(552): a, c, t, g, unknown or other
  misc_feature (552)..(552): n is a, c, g, or t
  modified_base (573)..(573): a, c, t, g, unknown or other
  misc_feature (573)..(573): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaactggtggagtcgtggggggaggcttggtccagccgtggggggccccctgagactgtcctgtgaagcctctggttcagtctttagaacgttttggatggtagttgggtccgccacgcctccgaggggaggggcgtgggaggtgggtggccaagtaagtaaaggaaggagtagggaagtggaaggtaacgttagtacggggtctcgtggtgggaaggggtcgattccgaacctatccgtaccaggacgaaccaaccggacccaaaggcgtcctacacgttggtatccgtagacaaggatacggaaccnggccctagggagtacggtacggaggacccaccggtacttatagttacttacgnggcgacggagtactcccttanaacgtaaacgtaaccttcccgaaccctttaattaactttaagtttacggtagggtaagttaccgggg

SEQ ID NO: 295150 - DNA, 786 bp, Homo sapiens
  misc_feature: GYAE6OF01BCKWS.11.2.A02.1.454.CMB.1.raw
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaacgtggtggaggtcgtgggggagcgttggtccgagccgtcgggggcccctggagactgtcctgtgaagtccctgtggttcagtcttttaggtaaacggttttggagtggtaggttcgggtcccgccgtacggcccgtaccgggaaggggaacggggccgtgggtagggtggggtcggacctaaagtaagtaaaaggaagggagtagggaacggtaggaggtaacgttagtacgggcttacgtggtaggaggggcgtacgtccactactctaccaggacaacgaaccgacaaggcactcaacgtatacttcgcgtacgaggtaactacggaacgtacggtacgtacggtaacgtaccggggtaacgaacccggtaaccccggtaaaccggtttacctttaaaacgttaacgtttaaccgttaacccgggtacgggtacccgggtaaacgaaacggttaaccgtttaaccgtaaaccgaaaacccggttaaaccgggttaaaaccctttcccccggtaaaaacccttttaccgggttttaaaacttttaaaggttttaaaccgggttaaacgggttaaggttaaaccccggggggg

SEQ ID NO: 295151 - DNA, 667 bp, Homo sapiens
  misc_feature: GYAE6OF02H2TDA.11.2.A02.1.454.CMB.1.raw
  modified_base (271)..(271): a, c, t, g, unknown or other
  misc_feature (271)..(271): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagcggtggtttcgtgtacggctatttagcaggtgtccggtctgcgtgcaatggtggagtcgtgggggagcgttggtccaggccgtggggggcccctgaggacctggtcctgtgaacgctcgtggtttcngtactttgaacgttttgatgagttggccgcagcctcgagggagggctggaggtggtgcaatagtaaagagataggaagtgaaggacgttagacgggctgtggtaggaaggggtcattccactaacttcgtaccaaggacgtaaccgaaccggaccgtaaaggacgacctactaccgttaggtattcgtccggtaacgtaacgtacgaacgtaaccgacgtacgtaggacggtacggtacggaaccggtaccgaccgtattaacttacgttaacgttcgacggtacggtacgtacgtacgtaaccgttaaccgaacgttaaacgtacccgtttaacccgttaccgtttaagttttaaccgtttaaggtttaacggttacgggttaacggttaccggg

SEQ ID NO: 295152 - DNA, 705 bp, Homo sapiens
  misc_feature: GYAE6OF02IT6DL.11.2.A02.1.454.CMB.1.raw
  modified_base (542)..(542): a, c, t, g, unknown or other
  misc_feature (542)..(542): n is a, c, g, or t
  modified_base (559)..(559): a, c, t, g, unknown or other
  misc_feature (559)..(559): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagcttgggttttccttgtcgctattttagcaggtgtccggtctgacgtgcaactggtggacgtcgtgggggagcttggtccagccggtcggggggcccctggacgacgtcgtccgtaggtggaagtccttcgttaggtttcaagtcgtttagtaaacggtttttggagttggtaggttcgggtaccgccaacgtccctaccggaagggggtaacgggcgtaggtaggtgggcggtaaccgtaaagtaaagtaaaaggtaacgggagtaggggtaaagtcggaagggtaaaccgtttaagtaacggggtcttacgtaggtaggaaggggacgtattacaacctatccgtaccgagaacgacgaaccgaccgaaagacggctacaacgtgtaacgtcgtagngaacgtatacgaaaccncgtactaggaagtacgtacggaacggacaaccgtacgtaaattcgttaaactacgtcggcgaccgtagtaacgttctaacgaaccgtaaacttaaccgttacccgaaccttattaaacgtttaagtacttagggtaacttaccggg

SEQ ID NO: 295153 - DNA, 547 bp, Homo sapiens
  misc_feature: GYAE6OF02FSI4K.11.2.A02.1.454.CMB.1.raw
  modified_base (450)..(450): a, c, t, g, unknown or other
  misc_feature (450)..(450): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaactggtggagtctgggggaggcttggtccagcctggggggccccctgagactgtcctgtgaagcctctggtttcagctttgaaacgttttggatgagttgggtccgccagcctccgagggaaggggctggagtgggtggccaatataaagaaggatgggaagtggaggaacgttagtacgggctctggtgaagggggcgattcaccatctccagagacaacgcccaaaggagctacactagtactctgcagatgaacngcctgagtagcgaggaccaccgctataatacttactgcgcgagagtctacaacgtaagaacttcccgaccttaacttattattatacggaattcggg

SEQ ID NO: 295154 - DNA, 678 bp, Homo sapiens
  misc_feature: GYAE6OF02HKDLV.11.2.A02.1.454.CMB.1.raw
  modified_base (421)..(421): a, c, t, g, unknown or other
  misc_feature (421)..(421): n is a, c, g, or t
  modified_base (518)..(518): a, c, t, g, unknown or other
  misc_feature (518)..(518): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaactggtggagtcgtgggggaggcttggtccagccggtcggggggccccctggagactgtcctggtagaagcctcgttggtttcagtcttttaggtaaaacggttttggattggtaggtttcgggtcccgccaggtccctaccgaagggggaaggggcgtgggagggtgggtcggaccaaagtaagtaaaaggaaggagtagggaagtaggaaggtaacgttagacgggntcgtagtaggaaggggctattccactatcctaccgagaacgactaatcgaaccgaaagacgtctacacgttgtaatcgtagcaagtactacgaaacncgtcctaaggaggtacggtacgaacgggaacccaaccgtacttaaataacgttaacttacgtcggaccgacggtaatacgtaccctaagaaacccgtaaggttaaacccgttccccttaacttaaaccttttaagtttaagtttacggtaaggtaaacgg

SEQ ID NO: 295155 - DNA, 709 bp, Homo sapiens
  misc_feature: GYAE6OF02IWXEG.11.2.A02.1.454.CMB.1.raw
  modified_base (261)..(261): a, c, t, g, unknown or other
  misc_feature (261)..(261): n is a, c, g, or t
  modified_base (575)..(575): a, c, t, g, unknown or other
  misc_feature (575)..(575): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaacgtggtggagtcgtgggggaggcgttggtccagccgtggggggcccctgagactgtcctgtgagcctntggttcagtctttagaacgttttggatgaggttggtccgccagcctccgaggggaagggctgggaggtgggtggaccaataagtaaaggaaggagtagggaagtggaggtaaacgttagacggggcttcgtggtggaagggggctagtccacctagttcctaccgagacgacccgaaacggccaaaaggcgtcgtacacgttgtactccgtagcctaaggtatacgaaacgacgtacccgtaggaacgtacgggttaaccggaacgggaacccaacccggttactttaaagttaaacttaaagttttacccggngtcccgggaacggtaacgtaccgtttacccgtaacgaaaacccctaaaggtttaaaccccgtttccccgtaactttaaacccgttttaattttaaacggtttaaccggtttaaggggtaactttaaccgggggg

SEQ ID NO: 295156 - DNA, 622 bp, Homo sapiens
  misc_feature: GYAE6OF02I453M.11.2.A02.1.454.CMB.1.raw
  modified_base (551)..(551): a, c, t, g, unknown or other
  misc_feature (551)..(551): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattgggctgagcgtggttttcctgtcgcttattttagcgaggtgtcggtctgacgtgcacgtggtggagtcgtgggggagtcttggtcagccgtcgggggcccctgagactcgtcctgtgacgcctgtgttcagtctttagtaacgtttgattgtagttcgggccgcacgtcctcggaggggtacgggcgagggtaggtgggtcgactaaagtaagtaaagaaggagtaggacgtggagtaacgttacgacgggtctcgtaggtaggaacgggctaacgtcgaaccctagtccgtacacgtacgaaccacggaccaaagacgtcctactacgtagttcgacgtcgtacaaggtacctaagaaccgcgcttagggaacgtggaaccggacggaacctacgtaatacttaattcgttacgngaccgactagtaccgtctaacgagtaaacctcgttacccattaccgttattaacggtagacgtgtaacggg

SEQ ID NO: 295157 - DNA, 704 bp, Homo sapiens
  misc_feature: GYAE6OF02I6PEQ.11.2.A02.1.454.CMB.1.raw
  modified_base (623)..(623): a, c, t, g, unknown or other
  misc_feature (623)..(623): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgcttattttagctaggtgtccggtctgacgtgcaactggtggagtcgtgggggaggcgttggtccgaggcccggtcggggggcccctggacgtactgtccgtgtacgaacgtccttcgttggttcagttctttacgttaacggttttggagttaggtaggttcgggtccgaccgacgtccgtaccggaaggggtacggggtcgtaggggtcggtggggtacgaccgtaaagtaagtaaaggaaggtagtaaggtaggtagaacggtaacgttaggtacgggcttcgtagggtacgggaacggggtcgtacttcgaaccgtactccgtaccgaagacggtaaccaaccggaccctaaaggaccgtctactacgttagtactccgtacgagtagaacgacgtaaccgacgtccgtaggaaggtaccggtacggacgaacctacggattacttaattacgttacgngtaccgtacgaatcgttaccacgtaaccagttaaccgttcccgtaaccttactttaattaccgtaggtacggtagtacggg

SEQ ID NO: 295158 - DNA, 740 bp, Homo sapiens
  misc_feature: GYAE6OF02GGTOY.11.2.A02.1.454.CMB.1.raw
tcagcgagagataccacgaccggtgctcgatttagactcatctacagggggtctcagagaggagccttagccctggactccaaggcctttccacttggtgatcagcactgagcacagaggactcaccatggaattggggctgagctgggttttccttgtcgctattttagcaggtgtccggtctgacgtgcaacgtggtggagtcgtgggggagtcgttggtccaggccgtcggggggcccctgagactgtcctgtgagcctctgttcagtctttagtaaacgttttggataggtaggttcgggtccgaccgcgtcccgtacccggaagggggaacggggtcgtaggggacgggttcgggggtcggaccgtaaaagttaagtaaaaacggaagggtaacgtaggggtaaagtaggtaacgggttaaacggtttaacggtaacggggtcttacggtaggtaggggaacggggtcgtacgtttacccaacgtactcccgtaccgaaggtaaccgacaaacccggtacccgtaaaggcgaccctaccgtacgttacgtaacttgtacgactaaggtaacgtagaaccgacggtcctagggacgtacggtacggacgtaccaaccggtacttaagttaactcgtttacgcggtacgcgtaagtcgtaactaccgtaaagtaacgttaccgttacccggtaaccttaacgttttacgtttaataggttacggtagttaaccgggg

SEQ ID NO: 295159 - DNA, 605 bp, Homo sapiens
  misc_feature: GYAE6OF02GMPRA.11.2.A02.1.454.CMB.1.raw
  modified_base (264)..(264): a, c, t, g, unknown or other
  misc_feature (264)..(264): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagcttgggttttccttgtcgcttattttagcaggtgtccggtctgacgtgcaactggtggagtcgtgggggaggcttggtccagccgtcgggggcccctggagactgtcctgtgaacgcctntggtttcagtctttgaacgttttggattgagttggtccgccagcctaccgagggaagggctgggagtgggtggacctaagtaataaaggaaggagtaggaagtggaggaacgttagtacgggctcgtggtaggaaggggctagttcgaacctatcctaccaagacgaacgaacgaccaaagacgctacactagtactctagcagatagaacgagcctaggacgtacgtacggaacggaccaccgtacttaataattaacttacgtgacgacgagtacgtctaaccaacgaacgtaacgttcccgacgttaacttaatttactacgttaggtaagttacggg

SEQ ID NO: 295160 - DNA, 694 bp, Homo sapiens
  misc_feature: GYAE6OF02HHHU7.11.2.A02.1.454.CMB.1.raw
  modified_base (504)..(504): a, c, t, g, unknown or other
  misc_feature (504)..(504): n is a, c, g, or t
  modified_base (565)..(565): a, c, t, g, unknown or other
  misc_feature (565)..(565): n is a, c, g, or t
tcagcgagagataccacgaccggtgctcgatttagactcatctacagggggtctcagagaggagccttagccctggactccaaggcctttccacttggtgatcagcactgagcacagaggactcaccatggaattggggctgagcgtgggttttcctgtcgctatttagctaggtgtccggtctgacgtgcaacgtggtacggagtcgtgggggaggtcgttggtccgaggccggtcggggggccccctggacgtactcggtcctgagacgtcctcgtggtttacaggtcgtttaggtaaacggttttggaagttggtaggttcggggtccgccgaacggtcccgttaccgggagggggaacggggtcgtaggggaagggttcggggtacgggacctaaaagtaacgtaaaaggaagggtagtacgggaagtcggagggtaaacgttagtacgggtctcgtggtaggaagggtctagtcactatcgacagacacacgcaagtcncgtacacgtgtctgcgtacagacgtacaacgtcgacctaggagtacggtacggacggaacnccggtaacttaagttaccgttaaacgttccgtgggacgtacggtaagtaccgtaacctacgaaacgttaacggttaacctcccgttaacgttactttaaattacggttagttacggtaccggttacggg

SEQ ID NO: 295161 - DNA, 872 bp, Homo sapiens
  misc_feature: GYAE6OF02GD20D.11.2.A02.1.454.CMB.1.raw
tcagcgagagataccacgaccggtgctcgattttagactcatctacagggggtctcgagagaggagccttagcccgtggacgtccaaggcctttccacttggtgatcagcacgttgagctacagaggactcaccatggaattggggctgagcgtgggttttccttgtcgcttattttacgcaggttcgtccggtctcgacggtgctaacgtggtcggtaggttccgtggggggaggccgtttcggtaccgaggcccgtcgggggggtcccccttggaacggtaccgtggtcccttggtacggtaacgtcccttacggttaggtttccacggttcgtttaaggtaaaccggtttttgggaacttgggtaggtttcggggtaccccgccgtaacggtcccgttaccggaaggggggtaacgggggtaccgtaggggtacggttacgggggtcggacctaaagttaaacgttaaaacggaaggtacgtagggtaacggttacggaacgggttaaacggttacgtacgggggtactcgttgggtacgggtaacggggtcgtacgttccgaaccgttacgttccgtaaccgtaaggaacgtaacccgaaacccggtaccaaaggtacgtcccgtaactacgttagttaaccttccgacggtaccgtaagtaacggtacggaaaccgtcgtacccgttagggtaccgttaaccggtacggaacggtaacccgtccgtaagtttaaacttaacgttacgttaccgtcgaccggttacggtaccggtaccgttacctaccggaaaacggtaaacgttacccgttaaccgtacctttaacgtttaacgttaccggtttaacggacggtacggttaaccggg

SEQ ID NO: 295162 - DNA, 434 bp, Homo sapiens
  misc_feature: GYAE6OF01C1YXE.27.42.D09.1.454.CMB.1.raw
  modified_base (425)..(434): a, c, t, g, unknown or other
  misc_feature (425)..(434): n is a, c, g, or t
tcagagcgtcgtctcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagttgggccagggaaccctggtcaccgtctcctcagcctccaccaagggcccatcggtcttccccctggccaccctcctccaacgagcacctctgggggcacagcggccctgggctgcctggtcaaggactacttccagacgacgctctgagcgggctggcaaggcgcatagnnnnnnnnnn

SEQ ID NO: 295163 - DNA, 428 bp, Homo sapiens
  misc_feature: GYAE6OF01CS7VC.27.42.D09.1.454.CMB.1.raw
  modified_base (421)..(428): a, c, t, g, unknown or other
  misc_feature (421)..(428): n is a, c, g, or t
tcagagcgtcgtctcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagttggggccagggaaccctggtcaccgtctcctcagcctccaccaagggcccatcggtcttccccctggcaccctcctccaagagcacctctggggcacagcgcctgggctgcctggtcaaggactacttccagacgacgctctgagcgggctggcaaggcgcatagnnnnnnnn

SEQ ID NO: 295164 - DNA, 540 bp, Homo sapiens
  misc_feature: GYAE6OF01CSS39.27.42.D09.1.454.CMB.1.raw
  modified_base (502)..(502): a, c, t, g, unknown or other
  misc_feature (502)..(502): n is a, c, g, or t
  modified_base (504)..(540): a, c, t, g, unknown or other
  misc_feature (504)..(540): n is a, c, g, or t
tcagagcgtcgtctcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggcctaattataaaatactactttgatttagttgggccaggaacctggtcaccgtctcctcacgcctccaccgaacgggcccagtccggttccttccccctcggcccacccctccctaccaacgacgccaccgtcgtgggggccacgacggccggcccgtggggcctcgcccgtcggtaccgaacgggaaccttaccgttacccgaacggtaccgaaccgtccgtccgtaggacgggccggggcgtcgggaccgaacgggccgacgaagtacggngnnnnnnnnnnnnnnnnnnnnnnnnnnnnnnnnnnnnn

SEQ ID NO: 295165 - DNA, 520 bp, Homo sapiens
  misc_feature: GYAE6OF01BK94U.27.42.D09.1.454.CMB.1.raw
  modified_base (492)..(492): a, c, t, g, unknown or other
  misc_feature (492)..(492): n is a, c, g, or t
  modified_base (494)..(520): a, c, t, g, unknown or other
  misc_feature (494)..(520): n is a, c, g, or t
tcagagcgtcgtctcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccaattaataaatacttactttgattagttcggggaccagggaaccctggtccaccgtctcctcacgcctccaccgaacgggcccacgttccggtccttccccccgtggcccacccctcctacctaacgacgcctacccgtcgtcggggaccacgacggccggccccgtgggcctcggccgtcggacgtaaacggaccttaccttaccgaacgaccgacgtctcgtggacggccgggctgggacaacgggccgcgacgtaggncnnnnnnnnnnnnnnnnnnnnnnnnnnn

SEQ ID NO: 295166 - DNA, 708 bp, Homo sapiens
  misc_feature: GYAE6OF02G8VQF.27.42.D09.1.454.CMB.1.raw
  modified_base (628)..(628): a, c, t, g, unknown or other
  misc_feature (628)..(628): n is a, c, g, or t
  modified_base (661)..(661): a, c, t, g, unknown or other
  misc_feature (661)..(661): n is a, c, g, or t
  modified_base (664)..(664): a, c, t, g, unknown or other
  misc_feature (664)..(664): n is a, c, g, or t
  modified_base (676)..(676): a, c, t, g, unknown or other
  misc_feature (676)..(676): n is a, c, g, or t
  modified_base (706)..(706): a, c, t, g, unknown or other
  misc_feature (706)..(706): n is a, c, g, or t
tcagagcgtcgtctcacgaccggtgctcgatttagacacatacgctaggggtaaaggggccgtaggagtggattggtcgtaccatcgtaactcagtaactccgggagccacctacttacaacccgttccctccaacacgttcgagtcgaccactctcactacgaccgaagtcctaactacccagttcctccctgaacgcctgaccgtcctgtcgtaccgccgcggacgacggaccgtgtacttacctgtcgccaggacgaaagttgcggactggcctagtttactaaaacttaccttaacttttcgagtttaacttaggggaaccacgggaaccctcggtcgacccgttcctacctccacgcctccaacctaagggcccatccggtctttccccctggccgacccctccttccgaacggtaccggccaaccgttccgtaggggggtccaccgaggccgggtccccttgggggcctcggccctttcgggtaccctaaacgggtaccttaacccgtttacccgaacggaaccggtaacccggaccgttcccgttagggaacggtacccgggggaaccgtttacggggttccggaaaacggggtttccgtacctaagtttaacggcgaccngcgcgccgcgcgcctcgcgtgacgacgcgagcncanacgacgacgtgngcgcgcacacgtctgtctctctctccgtcntc

SEQ ID NO: 295167 - DNA, 431 bp, Homo sapiens
  misc_feature: GYAE6OF02FQPC9.27.42.D09.1.454.CMB.1.raw
  modified_base (410)..(410): a, c, t, g, unknown or other
  misc_feature (410)..(410): n is a, c, g, or t
  modified_base (425)..(431): a, c, t, g, unknown or other
  misc_feature (425)..(431): n is a, c, g, or t
tcagagcgtcgtctcacgaccggtgctcgatttagacacatacgcagggaaagggcctggagtggattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattattggggccagggaaccctggtcaccgtctcctcagcctccaccaagggcccatcggtcttcccccctggccaccctcctccaacgagcacctctgggggcacagcggccctgggctgcctggtcaaggctacttcagacgacgctctgaggcgggcngggcaaggcgcatgnnnnnnn

SEQ ID NO: 295168 - DNA, 480 bp, Homo sapiens
  misc_feature: GYAE6OF01ECO0D.36.8.A08.1.454.CMB.1.raw
  modified_base (431)..(431): a, c, t, g, unknown or other
  misc_feature (431)..(431): n is a, c, g, or t
  modified_base (465)..(465): a, c, t, g, unknown or other
  misc_feature (465)..(465): n is a, c, g, or t
tcagtacgctgtctcacgaccggtgctcgatttagcatactctacaggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaaagctcctgatatatgctgtattcactgtgcaatcgggggtcccatctcggttcagtggcagtggatatgggacagatttcactctcaccatcagcagcctgcagcctgaagatgttgcaacttattattgtacaaagtataaacagtgccccgntcactttcggcggagggacccaaggtggagatanaaacgaactgtacgg

SEQ ID NO: 295169 - DNA, 502 bp, Homo sapiens
  misc_feature: GYAE6OF01C747E.36.8.A08.1.454.CMB.1.raw
  modified_base (437)..(437): a, c, t, g, unknown or other
  misc_feature (437)..(437): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtggcagtggatatgggacagatttcactctcaccatcagcagcctgcagcctgaagatgttgctaactttattattgtactaaaagtataaacagttgccccgtntcctacttttcgggcggtaaggggacccaaagggtggaagaactacaaaacgaacgttgtacggg

SEQ ID NO: 295170 - DNA, 516 bp, Homo sapiens
  misc_feature: GYAE6OF01A1688.36.8.A08.1.454.CMB.1.raw
tcagtacgctgtctcacgaccggtgctcgatttagcatactctacgagggggcagaagtctctctcagtcaggacacagcatggacatgagtgtccctgctcagctcctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaaagttcctaagctcctgatatatgctgtattcactgtgcaatcgggggtcccatctcggttcagtggcagtggatagtgggacagatttcgactctcaccatctagcagcctgcagcctagaagtatgtttgactaacttattattagtaacaaagtaataacgagtacgccccgcgttccgtacgtttcgggcgggtaacgggacccgaagggtcggaacggtatacgtaaacgtacgttacggg

SEQ ID NO: 295171 - DNA, 500 bp, Homo sapiens
  misc_feature: GYAE6OF01D7X4P.36.8.A08.1.454.CMB.1.raw
  modified_base (484)..(484): a, c, t, g, unknown or other
  misc_feature (484)..(484): n is a, c, g, or t
tcagtacgctgtctcacgaccggtgctcgatttagcatactctacagggggcagaagtctctctcagtcaggacacagcagtggacatgagggtccctgctcagctcctgggactcctgctgctctggctcccagataccagatgtgacatccagatgacccagtttccatcctccctgtctgcatctgtaggagacagagtcaccatctcttgccggcaagtcaggcattaacaatcattagcctgtatcagcagaaccaggaaagtcctaagctcctgatatatgctgtattcactgtgcaagtcggggtcccagtctcggttcagtggcagtgatagtggactagtatttcgactctcacctatcagcagcctgcagcctgaagatgttgactaattacttatttgtactaaagtataactacgtcgtccccgacttacgtacgtttcggacggacgggaaccgaagggtacgagacgtanaaacgtagtggtacgg

SEQ ID NO: 295172 - DNA, 498 bp, Homo sapiens
  misc_feature: GYAE6OF01AGOAO.36.8.A08.1.454.CMB.1.raw
  modified_base (219)..(219): a, c, t, g, unknown or other
  misc_feature (219)..(219): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggnaagtcaggcattaacaatcatttagcctggtatcagcagaaaccagggaaagttcctaagctcctgatatatgctgtattcactgtgcaatcgggggtcccatctcggttcagtggcagtggatagtgggacagatttcactctcaccatcagcagcctgcagcctgaagatgttgactaacttattattgtacaaaagtataaactagtcgtccccgctcctaccgtttcggacggagggacccgaaggtcggagactacaaacgtacgtggtacggg

SEQ ID NO: 295173 - DNA, 516 bp, Homo sapiens
  misc_feature: GYAE6OF01CUGJJ.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtatcactgtgcaagtcgggggtcccatctcggttcagtggcagtggatagtgggacagtatttcacttctcaccatcagcagcctgcagcctagaagtatgtcgactaactttattattagtactaaagtataaacgtagtcgccccgtctccgtacgtttcgggacggtacgggacccgtaaagggtcggaacgaactacgaaacggtaacgtggtacgg

SEQ ID NO: 295174 - DNA, 502 bp, Homo sapiens
  misc_feature: GYAE6OF01DA1WZ.36.8.A08.1.454.CMB.1.raw
  modified_base (338)..(338): a, c, t, g, unknown or other
  misc_feature (338)..(338): n is a, c, g, or t
  modified_base (431)..(431): a, c, t, g, unknown or other
  misc_feature (431)..(431): n is a, c, g, or t
  modified_base (442)..(442): a, c, t, g, unknown or other
  misc_feature (442)..(442): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaaagttcctaagctcctgatatatgctgtattcactgtgcaagtcggggtcccatctcggttcagtggcngtggatagtgggacagtatttcactctcacccatcagcagcctgcagcctagatagtgttgactaacttattattagtactaaagtataaacngtcgccccgtntccgtacctttcgggcggtacgggaccgaagggtcggaagatacgaaacgagtgtacggg

SEQ ID NO: 295175 - DNA, 539 bp, Homo sapiens
  misc_feature: GYAE6OF01D8B73.36.8.A08.1.454.CMB.1.raw
  modified_base (404)..(404): a, c, t, g, unknown or other
  misc_feature (404)..(404): n is a, c, g, or t
  modified_base (413)..(413): a, c, t, g, unknown or other
  misc_feature (413)..(413): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatgacccagtttccatcctccctgtctgcatctgtaggagacagagtccacctatcctcgttcggccgggacaagtcgagggctaattaacaatctatttacgcctggtatcagcaagaaaccgaagggtaaacttacctaagtctacctagatatatgcttagtattcactgtgactaagtcggggtccagttcgtcggttcagtgacaggtgtatagtgggactagtatttcactctcacatccgancacgctgcngcctagagtatggtctacaactttattagttataactaaagttataacgacgtcgacccgtatacgtacgtttacggacggtaggaacccgtaaggtcggaatacgaacgtaaacgtgtggtacgg

SEQ ID NO: 295176 - DNA, 510 bp, Homo sapiens
  misc_feature: GYAE6OF01B2EQP.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctctgccgggcaagtcaggcattaacaatcattagcctggtatcagcagaaaccagggaaagttcctaagctcctgatatatgctgtattcatgtgcaagtcggggtcccatctcggttcagtgcagtggatagtggacagtattcactctcacatcagcacgctgcacgcctagaagatgttcgactaactttattagttagtactaaagtataacagtcgcccgtactaccgtacgtttacggacgggtacgggaaccgtaagggtaggaacggactaacgaaacggtaacgtggtacggg

SEQ ID NO: 295177 - DNA, 532 bp, Homo sapiens
  misc_feature: GYAE6OF01B24ZC.36.8.A08.1.454.CMB.1.raw
  modified_base (218)..(218): a, c, t, g, unknown or other
  misc_feature (218)..(218): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtaggagacagagtcaccatctcttgccgggnaagtcaggcattaacaatcatttagcctggtatcagcagaaaccagggaaagttcctaagctcctgatatatgctgtattcactgtgcaagtcgggggtcccatctcggttcagtggcagtggatagtgggacagatttcactctcaccatcagcagcctgcagcctagaagtatgttgactaacttattattgtactaaagtactaacgagtcgaccccgattccgtaacgttttcgggacgggtacggggaacccgtaaaggggtacggtaacggtaactaaccgaaaaccggtaaacgttgggtaaccggg

SEQ ID NO: 295178 - DNA, 510 bp, Homo sapiens
  misc_feature: GYAE6OF01DPRZQ.36.8.A08.1.454.CMB.1.raw
  modified_base (362)..(362): a, c, t, g, unknown or other
  misc_feature (362)..(362): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (446)..(446): a, c, t, g, unknown or other
  misc_feature (446)..(446): n is a, c, g, or t
  modified_base (451)..(451): a, c, t, g, unknown or other
  misc_feature (451)..(451): n is a, c, g, or t
  modified_base (455)..(455): a, c, t, g, unknown or other
  misc_feature (455)..(455): n is a, c, g, or t
  modified_base (461)..(461): a, c, t, g, unknown or other
  misc_feature (461)..(461): n is a, c, g, or t
tcagtacgctgtctcacgaccggtgctcgatttagcatactctactagggggtcgagaagtctcgtactcacgtcacggacacagccagtggacatgagggtccctgctcagctcctgggactcctgctcgctcgtggtctcccagataccagtactgtgaccattaccgagatgacccagtttccatcctccctgtctgcagtctgtaggagacgagggactcaccatcctcttgccggacagtcaggcataacatcattagccttgtatcagcagaaaccagggaaacgttcctaaggtcgtaccgtgagtatatgtcttgtattcactgtgcgaagtcggggtcccatctgtcagtgcngtggagtgtggacagtacttcacgtctacgacatacagcacgtctgcacgcctagacgatgtnactaacttatatntacaaatntaacngtcncccgtnctacgttgggacgtaggaccgtaggagtacgagtacaaacgctggtacg

SEQ ID NO: 295179 - DNA, 493 bp, Homo sapiens
  misc_feature: GYAE6OF01EYP0M.36.8.A08.1.454.CMB.1.raw
  modified_base (388)..(388): a, c, t, g, unknown or other
  misc_feature (388)..(388): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtggcagtggatatgggacagatttcactctcacatcagcagctgcagcctgaacgntgttgcaacttattattgttacaaaagtactaacagtcgaccccgctcgtaccgtttcggcggacgggaccgtaaggtaggtacgatacaaacgacgtggtacgg

SEQ ID NO: 295180 - DNA, 494 bp, Homo sapiens
  misc_feature: GYAE6OF01D6NN7.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaaagttcctaaagctcctgatatatgctgtattcactgtgcaatcgggggtcccatctcggttcagtggcagtggatatgggacagatttcactctcaccatcagcagcctgcagccctgaagatgttgactaacttattaattgttacaaaagtataacagtcgccccgatctactttcggcggacgggaccgaaggtacggagaatacaaacgaactggtacgg

SEQ ID NO: 295181 - DNA, 719 bp, Homo sapiens
  misc_feature: GYAE6OF01DAOUP.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatccctccctgtctgcatctgtaggagacagagtcaccatctctggccggcaagtcaggcattaacaatctattagcctggtatcagcaagaaaccaagggtaaacgttacctaagctacctagatatatgcttgttaatctactgtacgtcgtaagtccgggggtaccctacgttccgttcgggtttaccaggttgggccgtaaggttgggtaacgttaaggtacggggtaactaaggttaactttaccgtacctttacctaccgtaaccctacttaccgaacggtccaacgtcccgttacggccgaacggtacccgttaggaaacgttacggttacggttaacgtaacctttaaaaccgtttttaagttttaagtttaacgggttaaaccttaaaaaaggtttaacgttaaaacccgtacggttaccgaccccccgttagttacccgttaccggtttaccggggtaccggggtaaacggggaaccccgtaaaggggtacgggtaacggtaaacgttacggtaaaaacccggtacgttcggtaacgggg

SEQ ID NO: 295182 - DNA, 503 bp, Homo sapiens
  misc_feature: GYAE6OF01EQFKJ.36.8.A08.1.454.CMB.1.raw
  modified_base (219)..(219): a, c, t, g, unknown or other
  misc_feature (219)..(219): n is a, c, g, or t
  modified_base (386)..(386): a, c, t, g, unknown or other
  misc_feature (386)..(386): n is a, c, g, or t
  modified_base (393)..(393): a, c, t, g, unknown or other
  misc_feature (393)..(393): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggnaagtcaggcattaacaatcattagcctggtatcagcagaaaccagggaaagtcctaagctcctagatatatgctgtattcactgtgcaagtcggggtcccagtctcggttcagtggcagtgatatgtgactagtattcactctcacatcagcagcctgcagctgaanctgttanctaacttattattacgtataaaagtataaactagtccgacccgtctacgtacgtttcggacgggtaacgggtacccgaaagggtacggaagatacgaaaacgtcgtacgg

SEQ ID NO: 295183 - DNA, 509 bp, Homo sapiens
  misc_feature: GYAE6OF01ARTAU.36.8.A08.1.454.CMB.1.raw
  modified_base (194)..(194): a, c, t, g, unknown or other
  misc_feature (194)..(194): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagganacagagtcaccatctcttgccgggcaagtcaggcattaacaatcatttagcctggtatcagcagaaaccagggaaattcctaagctcctgatatatgctgtattcactgtgcaagtcggggtcccagtctcggttcagtggcagtggatagtgggacagtatttcactctcaccatcagcagcctgcagcctagagatgttcgactaactttattattgtaactaaagtactaacgagtcgccccgtactccgtacgtttcgggacgggacgggaccgaagggtcggaagtacgtaacgaaacgtagtgtacggg

SEQ ID NO: 295184 - DNA, 643 bp, Homo sapiens
  misc_feature: GYAE6OF01BVCMS.36.8.A08.1.454.CMB.1.raw
  modified_base (229)..(229): a, c, t, g, unknown or other
  misc_feature (229)..(229): n is a, c, g, or t
tcagtacgctgtctcacgaccggtgctcgatttagcatactctacagggggtcgagaagtctcctactcgagtcaggacacagcatggacgactgaggtccctgctcaggctcctgggactcctgcgtgctctaggctcccagataccgagatgtcgacatccacgatcgacccagttccactcctcctgtctgcatcgagtagagacagactcacatctctggcgganagtcgagctaataacatactaagtttacgcgtagtactcgagacaaagaaaccgaaggtaaacgtacccgtaagccttaccgtagtaacttactaagtcgtacgttacgtacttactacgttaggtacgtacggtaaccgtcgggggtacccaagttcgtcggtacgaggtgacgtagtaggacgtagtacggactaaggttactttaccgactacctaccaacgtagtaccgacgtacgagtacctgacacgtccgtagtaagtcgttagtacgtaactaacgtttagttaagttacgtaaataaacgtactaacgtcgttaccgacccgtactacccgtaacgttaccgggacggtaacggaacccggtaaggtaacggacttaacgaacgtaaacggtagtcggtaaccgg

SEQ ID NO: 295185 - DNA, 613 bp, Homo sapiens
  misc_feature: GYAE6OF01DECK6.36.8.A08.1.454.CMB.1.raw
  modified_base (193)..(193): a, c, t, g, unknown or other
  misc_feature (193)..(193): n is a, c, g, or t
  modified_base (235)..(235): a, c, t, g, unknown or other
  misc_feature (235)..(235): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggngacagatcaccatctctgccggacagtcaggcattaacaatnatttagcctggtatcagcagaaaccagggaaagttccaagctcctagatatatgctgtattcactgtgcaagtcggggtaccagtctcggttcaggtgacaggtcgagtagtgggactaggtatttccgactctacgactatcagtccagtcctacggcacgtaccgtagaacgtagtttggttagtacgtaaactttagtttaacgttaggttaactaaaaaggtttactaaacgtacgttaccggtacccccgtacgttacccgttaaccggtttaccgggggaacccgggtaacggggtaaaccccggtaaaggggttacgggtaacggtaaacgttaacccgtaaaaaccgggtaacgttaagggttacccggg

SEQ ID NO: 295186 - DNA, 580 bp, Homo sapiens
  misc_feature: GYAE6OF01EACRB.36.8.A08.1.454.CMB.1.raw
  modified_base (193)..(193): a, c, t, g, unknown or other
  misc_feature (193)..(193): n is a, c, g, or t
  modified_base (252)..(252): a, c, t, g, unknown or other
  misc_feature (252)..(252): n is a, c, g, or t
  modified_base (288)..(288): a, c, t, g, unknown or other
  misc_feature (288)..(288): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtcacatctcttgccggcaagtcgaggcattaacaatcatttagcctaggtatnagcaagaacagggaagttctaagctctagatatatntctgttatctactgtgactaaggtcggggtccctagtcgtcggttctaggtggtacgtagtggtataggtagggactagtactttcacgtactcactatcgagacacgtctcgcacgtactacgtaagtattacgttcgaacttaacttagtttattagttaactaaaagttactaaacgtacgtaccgtccccgtacgttaccgtaccggtttacggggaccgggtaaggtaacccggtaagggtacggaacggtaacgtaaaccgtaaaccggtacgttggttaaccggg

SEQ ID NO: 295187 - DNA, 550 bp, Homo sapiens
  misc_feature: GYAE6OF01ATCVU.36.8.A08.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagganacagagtcaccatctcttgccgggnaagtcaggcattaacaatcattagcctggtatcagcagaaaccagggaagttcctaagctcctgatatatgctgtattcactgtgcaagtccgggggtacccagtcgtcggttctaggtcggctaggtggtatagtagggactaggtactttcgacttctacacctatcacgcacgcctgctacgcctagaagtattgttacgacttaactttattaagttcgttaactaaaagttataacgtagtccgaccccgtactaccgtacgttaccgggacggaacgggtaccgtaagggtacggaacgtacgtaacgaaacgtacgtggtacgg

SEQ ID NO: 295188 - DNA, 708 bp, Homo sapiens
  misc_feature: GYAE6OF01CM0ML.36.8.A08.1.454.CMB.1.raw
  modified_base (226)..(226): a, c, t, g, unknown or other
  misc_feature (226)..(226): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccatccctcctgtctgcatctggtaggagacagagtcacctatctcgttggccgganaaggtcgaggactaattaacaatctatttagcctaggtactacacgacaagaaaccgaagggtaaacgttacctaagacctaccgtagtaatatagtgtacttagttacttcacgtgtgtacgtaacggtccggggtaccctagttccgtcggttcgaggttcggacgtaggtacggtagttaggtacgggactaaggttactttaccgaccttactacctaacctacgttacgacgtcgaacgtccgtacgtaccgacggtaccctaaggtaacgtacgtttaggttaccgtaactttaacgttttaacgtttaagtttaacgttaaacgttaaaaagttaccgtaaaacggttaccgtacccggtacccccgttacgttaacccggtttacccggttaccggggaaccggggtacgggtaacccggtaaagggttacggtaacggtaactaaaccggtaaacgtaccggtagggtaccgg

SEQ ID NO: 295189 - DNA, 681 bp, Homo sapiens
  misc_feature: GYAE6OF01DZNYU.36.8.A08.1.454.CMB.1.raw
  modified_base (221)..(221): a, c, t, g, unknown or other
  misc_feature (221)..(221): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgctatctgtaggagacagatcacctatcctctcgccggnaagtcgaggcaattaacaatctatttagcctggtatcagtacaagaaaccgaagggtaacgttaccgtaagcctactacgtattactatgtctagttacttacacgtgtcgacgtaacggtccggggtacccacgttccgtcggttacgtaggtcggtacgaggttggtacgtaagtacgggtaactaggttaactttaccgtaccttaccgtacaaaccctactacgtaacgacgtacgtcccgtacgcgtaccgtccgtagtaacgtacgttagttaccgtaacttaaacgtttaagtttaactttaacggtaaacgttaaacgttaaccgtaaacgttaccggtacccgtaccccgtacgttacccgttaccggtttaccggggaccgggtaacgggaaaccggtaagggttacggaaaccgtacgtaaaccggtaaaccgtacggtggttaaccgg

SEQ ID NO: 295190 - DNA, 534 bp, Homo sapiens
  misc_feature: GYAE6OF01CRM9C.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcagtcaggcattaacatcattagcctggtatcagcaagaaaccagggaaagttcctaagctcctgatatatgctgtattcactgtgcaagtcgggggtcccagtctcggttcagtcggcagtggatagtgggacagtatttcactctcaccatccagcacgcctgccagccgtagaagtagtgttcgactaactttattattagtaactaaaagttactaaacgacgtccggaccccgtctaccgtacggtttccgggacgggtacgggaccgtaaagggtgggaacgtacgtaacgaaacggtacgtggtacggg

SEQ ID NO: 295191 - DNA, 726 bp, Homo sapiens
  misc_feature: GYAE6OF01A209D.36.8.A08.1.454.CMB.1.raw
  modified_base (241)..(241): a, c, t, g, unknown or other
  misc_feature (241)..(241): n is a, c, g, or t
tcagtacgctgtctcacgaccggtgctcgatttagcatactctacagggggagtctccctcactgcccagctgggatctcagggcttcattttctgtcctccaccatcatggggtcaaccgccatcctcgccctcctcctggctgttctccaaggagtctgtgccgaggtgcagctggtgcagtctggagcggaggtagaaaaagcccggggagtctctagaaatctctagtaaggcttcnggatactacctttacaacttctggatcggctgggtgcgccagatcggacccgggaaaggcccgtaggaggtggaggtggggattcggtactacgtccgtgggtcgtactcgtagaactaccgagtactacgacggtccccgttcccttaccgaaacggccctaggtacccaaccctaagttactccgaacggtacgaacctaaccgtacctaacgtccaacgtacccgaccccgtaccctacccctacccaaccgttcgggaacgttaccggcccgttaagggaacccgggtccccgttacccgggaaccctaccccggaacctaacttaacgttacgtttaaccgtcggttcgaccggaacgtacgaagtagggaacgtacttaacggttaggtaggggacgttcggtttagggttttcggggggtcggggggtacccttacggggtacggggtcccggaaaccgggggtacccgttaccgggg

SEQ ID NO: 295192 - DNA, 684 bp, Homo sapiens
  misc_feature: GYAE6OF01BFJXR.36.8.A08.1.454.CMB.1.raw
  modified_base (198)..(198): a, c, t, g, unknown or other
  misc_feature (198)..(198): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccactccctcctgtctgctatctgtagganacagactcactatctcgtggccggacaagtcgaggcattaacaatctattagcctggtatacacgacgaagaaaccgtaagggtaaacgttacctaacgtctacctagatactatgactagtattctactgtacgacgtaacggtccggggtaccctacgttccgtcggttacgtacggtggacgtaggtaggtagtaggtacgggaatacggttactttccgacgttcctacactacgtcacgaccacgtccgtacgacgtaccgaccgtaaggtaacgtagttacggttacgtaactttaactttaaacgttttacgttaacgttaaacgtaaaagtttaacgtaaaccgttacggtaccgtacccccgtacgttacccggttaaccgtttaccgggggaaccgggtaaaccgggtaccggtaaaggggtacggtaaacggtaaccgtaaaccgttaaaccggtaacggttcgggtaacccggg

SEQ ID NO: 295193 - DNA, 633 bp, Homo sapiens
  misc_feature: GYAE6OF01B7F14.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtaggagacagagtcaccatctcttgccggcaagtcaggcattaacaatcattagcctggtatcagcaagaaacagggaattcctaagctcctgatatatgctgtattcactgtgctaagtccgggggtcctatacgtcggttcagtggcagtggactagtgggaactagtactttacactctacgaccattcaacgcacgaccgtcgaccgacgacccgtagaacgtagttacggtttagtaaccttaaaccgttttattttaagtttacgtttaaactaaaaagtttacgttaaaacgtccggttaccggtaccccccgtaccgtttacccgtaaccgtttttacccggggacgggggttaaacgggaaccccggttaaaggggttacgggaaacggtaaccgttaaacccggtaaaaccggttaaacgttacgggttaaccggg

SEQ ID NO: 295194 - DNA, 726 bp, Homo sapiens
  misc_feature: GYAE6OF01C9GCB.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccagtttccatcctccctgtctgcatctgtaaggagacagagtcaccatctcgttcggccgggacaaggtcgagggactagttaaacaatctattagcctggtatcagaccaagaaaccgtaagggtaaacgttacctaacgtcgttaccctaggattattacgtagtcgttagttacttactacttgtacgacgtaacggtccgggggtaccctagtccgttcggttacgaggttcggacgtaggtaggaagttagtacggggtacagttaactttccgtaacttcctaccgaacctacgttacgaagccgacgtccctggaccgtacgtaccgtaggaacgtagttacggtttacgacctttaaactttaagttttaacgttacgttaaacttaaaaacggttattaaaccgtaacgggttaccgtacccccggttaccttacccggttaaccggtttacccgggggtacccggggtaaagggggtaaaccccggttaagggggttaacgggtaaacggttaaaccgttaccggaaaaaccgggtaaccgttgggttaacccgggg

SEQ ID NO: 295195 - DNA, 700 bp, Homo sapiens
  misc_feature: GYAE6OF01EVPM5.36.8.A08.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtcaccatctcttgccggnaagtcaggcattaacatcatttagcctggtatcagcagaaaccagggaaacgttcctaagctctgatatatgctgtattcactgtgcagtcggggtcctatcgtcggtcaggtcgcgagtggatagtgggactagtactttcacgttcctacgaaccctagttaccgacgtaccgtaacgtcccgttaggacccgtacggtaccccgttaagggtaaaccggttagtttacgggtttacgtaaaccctttaaaccgtttttaagttttaaacgttttaaccggtttaaaacgttaaaaacggtttaacgttaaaacccggtaaccgggttaccccgtaccccccggttaccgtttaacccgttaacccgggttttacccgggggaaccggggtaaaccgggggtaaacccgtaaaggggttacgggtaaacggttaaccgtaaaccggttaaaacccgggttaacgttcgggttaacccgggg

SEQ ID NO: 295196 - DNA, 519 bp, Homo sapiens
  misc_feature: GYAE6OF01EHCLB.36.8.A08.1.454.CMB.1.raw
  modified_base (216)..(216): a, c, t, g, unknown or other
  misc_feature (216)..(216): n is a, c, g, or t
  modified_base (386)..(386): a, c, t, g, unknown or other
  misc_feature (386)..(386): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtaggagacagagtcaccatctctgccggnaagtcaggcattaacaatcatttagcctggtatcagcagaaaccagggaaagttcctaagctcctgatatatgctgtattcactgtgcaagtcggggtcccatctcggttcagtggcagtggatagtgggacagtatttcactctcacatcagcagcctgcagagtgaanatttcgctagtttacttattgtacagtactagtaataaattaacgtggtaccctaccggttctaccgttttcgggacgggtaacgggtaccgaaaggggttggaacgtaagtacgaaaacggtacgttacggg

SEQ ID NO: 295197 - DNA, 845 bp, Homo sapiens
  misc_feature: GYAE6OF01CKQW8.36.8.A08.1.454.CMB.1.raw
  modified_base (193)..(193): a, c, t, g, unknown or other
  misc_feature (193)..(193): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtccacatctcttggccggcaagtcgaggcattaacaatcatttagcctgtatacagcaagaaaccgaggaaagttacctaagcctcctgaatatatgtctagtattactacgtgtgacgtaaggtccggggtaccctagttccgtcggttacgtaggtcgggtacgtaggtacggtaagttacggtagggtacgtaacggttaacttttccgtaacctttaccgtaccctaacccgtaacgttaccgaaccggtaccgacccggtcccgttaacggtacccgtacccgggttaacccggtaagggttaaacggttaacggttttaccgggtttaacggttaaccccgttttaaaacccggttttttaaagtttttaacggttttaacggttaaaaacccgttaaaaaacggttttaaaccgttaaaaaccgtttaaaccgggggttcccccgttaacccccccgggtttacccgtttaaaccccggtttaaacccggggttttacccggggggtaaacccgggggttaaaacccggggggttaaacccccggttaaaaaggggggtttaccggggtaaaacgttaaaccggtaaaaccccggtaaaaacccgggttaaaaccgggttacggggtttaaacccgggg

SEQ ID NO: 295198 - DNA, 767 bp, Homo sapiens
  misc_feature: GYAE6OF01C886O.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctggtaggagacagacgtcaccatctcttggccggcagtcgaggcataacaatactattacgctggtatcagacaagaaaccgaagggtaaacgttactaacgctacctagtactatatgtctagttacttactactgtgacgtaaggtccggggggttaccctacgttcgttaccgggttacgaaggttcgggtacgtagggttagggtaattagttaggaaggtaaccgtaaggttacttttacctaccttacctaccctaacctaattccgaacgtaccacggtacccgtgacccgtacggtacccgtaaggtaacgtaacgtttcggttactaaccgtttaaacgtttttaagtttaacgtttaacggtttaaaccgttaaaacggtttaaaccgttaaaaccggttaaaccggttcccccggtaacccccggttacccgtttaacccgttaaccgggtttttaccccggggggaccggggttaaaaccgggggtaaccccgggtaaaacggggttaacggggtaaacggtaaaccggttaaacccggtaaaacccgggttaacggttaaccccgggg

SEQ ID NO: 295199 - DNA, 513 bp, Homo sapiens
  misc_feature: GYAE6OF01A6J7G.36.8.A08.1.454.CMB.1.raw
  modified_base (219)..(219): a, c, t, g, unknown or other
  misc_feature (219)..(219): n is a, c, g, or t
  modified_base (306)..(306): a, c, t, g, unknown or other
  misc_feature (306)..(306): n is a, c, g, or t
  modified_base (395)..(395): a, c, t, g, unknown or other
  misc_feature (395)..(395): n is a, c, g, or t
  modified_base (445)..(445): a, c, t, g, unknown or other
  misc_feature (445)..(445): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggnaagtcaggcattaacaatcatttagcctggtatcagcaagaaaccagggaaagttcctaagctcctgatatatgctgtattcatgtncaagtcggggtcccatcgtcggttcagtggcaggtggatagtgggacagtatttcactctcaccatcagcagcctgcgagcctagaagnttgtcgactaacttattattagtaactaaagtataacagtcgaccccgtntacgtacgtttcgggacggtacgggaaccgaagggtaggaacgacgtacgaaacggtacgtggtacgg

SEQ ID NO: 295200 - DNA, 665 bp, Homo sapiens
  misc_feature: GYAE6OF01D04ZE.36.8.A08.1.454.CMB.1.raw
  modified_base (197)..(197): a, c, t, g, unknown or other
  misc_feature (197)..(197): n is a, c, g, or t
  modified_base (223)..(223): a, c, t, g, unknown or other
  misc_feature (223)..(223): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccatcctccctgtcctgcatctgtagganacagatccacatctcgttggccgganaagtcgaggctaattaacaatctaatttacgccttaggtatcgagacaagaaacccgaagggtaaacttaccgtaacgcctaccgtagacttatactgtacttagttacttacacgtgtacgacgtaacggtccggggtaccctagttcgtcggttacgaggtacggactaggttaggacttaggtacggaactagtactttaccgactacctacaacctactacgtacgacgtacgtccctaggcctacgtaccgtaaggtaacgtacgttcgttaacgtaacttaaacgttttaagtttaacgttaacgttaaaacgtaaacgttaataaaccgtcggtacccgtacccctacgttacccgttaccggttacgggaccgggtacggtaaacggaagggttacggaacgtaactaaaccgaaaccgtaggtgggtaaccgg

SEQ ID NO: 295201 - DNA, 508 bp, Homo sapiens
  misc_feature: GYAE6OF01BYLEF.36.8.A08.1.454.CMB.1.raw
  modified_base (195)..(195): a, c, t, g, unknown or other
  misc_feature (195)..(195): n is a, c, g, or t
  modified_base (306)..(306): a, c, t, g, unknown or other
  misc_feature (306)..(306): n is a, c, g, or t
  modified_base (402)..(402): a, c, t, g, unknown or other
  misc_feature (402)..(402): n is a, c, g, or t
  modified_base (488)..(488): a, c, t, g, unknown or other
  misc_feature (488)..(488): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccccagtttccatcctccctgtctgcatctgtagganacagagtcaccatctcttgccgggcaagtcaggcattaacaatcatttagcctggtatcagcagaaaccaggaaagttcctaagctcctgatatatgctgtattcactgtncgaagtcggggtcccatctcggttcagtcggctaggtggatagtgggactagtatttcacttctacaccagttcagcagcctagcagtcctagagntgtgactagttattattagtactaaagtataaccgagttcgaccctacgtcctacgttcggacgggacggacgtaggtagtacganacgaaacgtacgtggtacgg

SEQ ID NO: 295202 - DNA, 591 bp, Homo sapiens
  misc_feature: GYAE6OF01E3QQM.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcgaggcataacaatctattagcctggtatcagacaacgaaaccgaagggtaaacgttacctaagcctctagatatatgtctgtacttcactgtagtacgtaacggtccgggggtccctacgtccgttccggttcgaggtggtcgtaggtggtaagtaggtgggaactagtactttactacctctaccaccctatacagacgacgtcctcgctacgaccgtagaatagttgttacgtaacttaactttattaagttagtaaactaaaagttacaacgtacgtcccgtacccgtactaccgtaccgttacgggacgggtaacgggaaccgaagggtaggaacgtacgtaacgaaacggtacgtggtacgg

SEQ ID NO: 295203 - DNA, 728 bp, Homo sapiens
  misc_feature: GYAE6OF01A9U8Z.36.8.A08.1.454.CMB.1.raw
  modified_base (218)..(218): a, c, t, g, unknown or other
  misc_feature (218)..(218): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctctgccgganaagtcaggctattaacatcattagcctggtatacgacgtacaacgaaaccgtaagggtaaacgttaccgtaacgtcctaccgtagtaacttataagtacgtacgttaggttaacttacgtacgttggtacggtaccgtaacggttccggggggtacccctacgttccgttaccgggttacgtaggtcggtacgtaggtaggtaagttaggtacgggtaactacggttactttaccgaccgttacctacctaaccctagtaccgaacgtccgtaccgtccgttacggaccgtacggtccgtaacggtaacgtacgttacggttacgtaacctttaacgtttaagtttaacgttaacgttaaacgtaaaacgttacgtaaaccgtacggttacccgtacccccgttacgttaaccgttaccgggtttacccgggaacggggtaaacggaaccggtaaacgggtacggtaaaggtaaccgtaacggtaaaacgtaaccggttggttacccggg

SEQ ID NO: 295204 - DNA, 812 bp, Homo sapiens
  misc_feature: GYAE6OF01C44LV.36.8.A08.1.454.CMB.1.raw
  modified_base (200)..(200): a, c, t, g, unknown or other
  misc_feature (200)..(200): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccattccctccctgtcctgcatctgtagganacagtacgtaccacctatcctcgttcggaccgggacaaggtcgaacgggtactaacttaactaactactaatttacgaccttaggtactaccgaagaccgaaacggtaaaaccgtaacggggtaaacgtttaccgtaacgtaccgttaccgtaggtaacttatagtacggtaccttagttacttacctacgttggtacggaccgtaacgggttcccggggttaccctacgttccgttacggttacgtacggttacggacgttagggtacggtagttaacggtacgggtaactaggttacctttaccgtaccttacctaccctacctacgtaccgacgaccgtacgtcccgttacggccgtacggtaccgtaaggtaacgttacgtttacggttacgtaacgttttaaccgtttaagtttaacgtttaacgttaaacgttaaaagttaccgttaaacgtaccgggttaccccgaccccggttaccgttacccggttaaacccgggttaccgggggaacccggggtaaacgggtaaacccgggtaaggggttaccgggtaaaccggaaccgtttaaacccggtaaaaccgggttaccggttgggttaacccggg

SEQ ID NO: 295205 - DNA, 598 bp, Homo sapiens
  misc_feature: GYAE6OF01BTGFS.36.8.A08.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatatgacatccagatgacccagtttccatcctccctgtctgcatctgtagganacagatcaccatctcgtgccgganaagtcgaggctattaacaatcattagctggtatcagcagaaaccgaggaaagttcctaagcctcctgatatatgtctagtatcactgtgcgaagtccggggtccattcgtcggttcaggtgacgtagtaggatagtacgggactagtacgtttccacgttcctacacccgtatacgacgcctaacgccttagaccgtacgtccgtaggaagtgttagtacgtacttaacgtttattacgttaggttaaactaaagttactaaaccgtgtacccggtaccctacgttcgtaaccggtttaccgggacgggtaacccggggaaccgtaagggtacgggtaaacgtaacgttaacgaaaccggttaaacgtgggttaacccgg

SEQ ID NO: 295206 - DNA, 759 bp, Homo sapiens
  misc_feature: GYAE6OF01DG8RG.36.8.A08.1.454.CMB.1.raw
  modified_base (560)..(560): a, c, t, g, unknown or other
  misc_feature (560)..(560): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggctcccagataccagatgtgacatccagatcgaccctagtttccatcctccctgtctgcactctaggtaggagacagtagtccacctatccgtcgttcggccgggacaaggttccgaagggactaacttaaacaactcttaattacggtaccttggtactacgaacgacaaacggaaaaccggtaaggggaaaaccgtttaccgtaaacgtccttaccgtaggtaacttatagtacgtaccgttagttaacttcctaacgttggtcgaccgtaaacgggttcccggggttacccctaagtttccggttacggttaccgtaaggtcggtacgtagggttaggtaagttaggtacggggaacttacggtaacttttcctaaccttccctaacaacccgttacgtaccgtaacggtacccgtaacgtcccggttanaacccggttacccggtaacccggttaagtaacgtagtttacccgggttaactaaacctttaaccggttttattttaaccgttaagttaaaacctaaagttactaaacgtaccgttaccgccgtacttcgtacggttaccggggacggtaacggggaccgtagggtacggtaactaaccgtagaaacgttagtcgtacgg

SEQ ID NO: 295207 - DNA, 708 bp, Homo sapiens
  misc_feature: GYAE6OF01C4ELW.36.8.A08.1.454.CMB.1.raw
  modified_base (200)..(200): a, c, t, g, unknown or other
  misc_feature (200)..(200): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccatccctcctgtctgctatcgtgtacgganacagtacgtcaccatcctcgttcggaccgggtcaagtccgaggtacaattaacaatctaacttacgctaggtactacgacgacaagaaaccgaagggtaacgttacctaacgtactactagatatagtcgtactgtattctactgtcgacgtacggtccggggtcctagttacgttcggttacgtacggtaggcgtagggtaggtagtaggtacggtacgtaacggtactttacaaccgtctaaccgtactacgtacgacgtacgtaccgtcgtcgaccgtacgtaccgtagtaacgtagttcgttaacgtaacgttaacctttaattaacgttaacgttaaacgttaaaacgttacgtaaacggttaaccgtcccggtaaccccgttacgtttaacccggtaacccgggttacggggtaaccggggtaaacggggtaacccggttaaaggggtaccggtaaaggttaacccgtaacggtaaacccggtaaggttccggtaaccgggg

SEQ ID NO: 295208 - DNA, 813 bp, Homo sapiens
  misc_feature: GYAE6OF01DJ65P.36.8.A08.1.454.CMB.1.raw
  modified_base (188)..(188): a, c, t, g, unknown or other
  misc_feature (188)..(188): n is a, c, g, or t
  modified_base (202)..(202): a, c, t, g, unknown or other
  misc_feature (202)..(202): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggcctccagactaccagatgtcgacatccagactcgaccctagtttccattccctcctgtcngctatcgtgagganacagacgtcactatcgtcgttcggaccggacaaggtcgaggactaattaacaagtctaatttacgccttaggtactcgacgaccaaggaaaccgaagggtaaacgttaccgtaagtcctacctagtaacttatacgttcgtacttaggttattacgtacgttcggtacgtaaccgtaacgggttacccgggggttacccaacgtttcccggttacggttacgtacggttcggacgtacgggtaggttaacgtacgtacggggtaactagtaacgtttcctaccgttacgtaaccctaaccgtaacgttacccgagtaaccgtacggtacccgtacgaaccgggtaccgttaccggtaacggttaaggttacgttacgggtttacgtaaccttaaaccgtttttagtttaaacgtttaaccggttaaacgttaaaaacggttaacgtaaaccggttaccggttacccggtaacccccggttaacgttacccggtttaaccggggtttccggggaaacgggttaaacccggggtaaccggtaaaacgggggttacggtaaacggttaaccgttaaaacccgggtaacgttaaccgggtaggtttaacccgggg

SEQ ID NO: 295209 - DNA, 711 bp, Homo sapiens
  misc_feature: GYAE6OF01COU5F.36.8.A08.1.454.CMB.1.raw
  modified_base (144)..(144): a, c, t, g, unknown or other
  misc_feature (144)..(144): n is a, c, g, or t
  modified_base (233)..(233): a, c, t, g, unknown or other
  misc_feature (233)..(233): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagactaccagntgtgacatccagatcgaccctagtttccacttccctcctgtctgcatctagtaggagacgagacgtcactatcgtcgttcggccggganaagtcgaggtctaattaacaatctaattcgcctaggtatcgagacgaagaaaccgagggtaaactttacccgaagtcccttacgagtaacttagtagtcgtacttacgtactcctagtgtacgtaacgtacgggtcccgggtactacgttcggttacgtacggtacgtcggtacgtagttaggtagtacggaggtactagtttactctaccgtactacctactacagtaccgagtaccgtccgtgaccgacgtacgtaagacgttcgtacgttctaaacgtttaccttttaagtttacgaaaccgttaaaacgtaaacgttacgtaaacccgttaccggttacccccgtaccggttaccgttacccggtttaaacggggtttacccgggaaccgggggttaccggtaaaaccggggttaacgggtgggtaaacccctaaacggttaaacggaaaccggttaaggttcgggtaacccgg

SEQ ID NO: 295210 - DNA, 711 bp, Homo sapiens
  misc_feature: GYAE6OF01BJOTZ.36.8.A08.1.454.CMB.1.raw
  modified_base (199)..(199): a, c, t, g, unknown or other
  misc_feature (199)..(199): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccactccctccctgtctgctatctgtagganacagacgtccaccatcctcgtcggccggacaagtcgaggactaattaacaagttctaatttacgccgttaggtatacgacgacgaaacggaaaccgtaagggtaaacgttacctaaacggtccttacctagtaacttaatacgtgtacttagttacttcctaacgttgtacgacgtaacggttccggggtaccctagttcgttcggttacgaggtcggtacgtaggtaggtagtaggtacggtactagttacgtttcactacctaccaaccgtatccgagtcccacggtcctcgacgacgtaccgtaggaagttcgttggttacgtaaccttaagttttaacgtttaacgttaacgttaaacgtaaacgttaacgtaacccgttacggtccccgtaccccgttacgttacccgttaaccggggtttacccggggaaccgggtaaaccggggtacgtaaacggggtacggtaacgtaaccggtaaaccgaaacgggttacgttacgggtacgg

SEQ ID NO: 295211 - DNA, 720 bp, Homo sapiens
  misc_feature: GYAE6OF01AICPP.36.8.A08.1.454.CMB.1.raw
tcagtacgctgtctcacgaccggtgctcgatttagcatactctacgagggggcagaagtctctctcagtcaggacacagcatggacatgagggtccctgctcagctcctgggactcctgctgctctggcctcccagataccagatgtgacatccagatcgaccctagtttccactccctccctgtctgcatctggtaggagacagtacgtcacctatctcgttcggccgggacaagtcgaggactaataacaatctattacgccttggtatacacgacaacgaaaccggaagggtaaacgttacctaagtcctacctagatactatgtacttgttacttcctacgtggtacgacgtaacgggtccggggtaccctagttccggtttccggtacgtaacggtcgggacgtagggtaggtaagttacgggtacgggaacgtacggttactttaccgaccgttacctaccaacccgtatacgacgaccgtaccggtccgtacgaccgtacggtaccctaagggtaacgttagttggtttaaccgtaacttaaacgttttaagtttacgttaaggttaaactaaaaggttaccgtaaacgttaccgggtaccgtacccccgttacttacccgggtttaccggttaccggggaccggggtaacgggtaaccgggtaagggtacggtaacgtaaccgtaaaccggaacgtaacggttggtaaccgg

SEQ ID NO: 295212 - DNA, 611 bp, Homo sapiens
  misc_feature: GYAE6OF01BEGEC.36.8.A08.1.454.CMB.1.raw
  modified_base (221)..(221): a, c, t, g, unknown or other
  misc_feature (221)..(221): n is a, c, g, or t
  modified_base (338)..(338): a, c, t, g, unknown or other
  misc_feature (338)..(338): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcgttggccgggnaagtcaggcataacaatcattagcctggtatcagacagaaaccgagggaaacgttcctaagcctctgatatatgctagtatcatgtgacgaagtcggggtacctactcgtcggttcnggtcggcgaggttagagttagtcggtaactagtactttcaccgttctaccacctacgtacgtacgccgacgtcccgtagaccgtacgaccgtaggtaagtacgtttacggtacgtaccttaaagtttactttaagtttacgtaaactaaaaggttaacctaacgtacggttacccgacccccgttacgtacccgttaccggttacggggaacgggacgggtaacccgtaaagggtacggtaacgacgttaaccgaaacgtcggtggtaccggg

SEQ ID NO: 295213 - DNA, 614 bp, Homo sapiens
  misc_feature: GYAE6OF01A4MPC.36.8.A08.1.454.CMB.1.raw
  modified_base (214)..(214): a, c, t, g, unknown or other
  misc_feature (214)..(214): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagagacagatcacatctctgccggnagtcaggcattaacatcattagcctggtatcagtcaagaaacgagggaaacgttcctaagctctgtatatatgtctagtattcacgttgtcgtacgaacggttccggggtccctacgttcgttcgggttctaggtggccgaggttaggataggtagggactaaggtactttaccgacttcgtacaacccgtactcaaggacctacgcccgttgacctacgtaccgtaggaacgtagttcggttaagaccgttaactttagtttaagttacgttaaacctaaaaggttaactaacgtacggtccgtaccccgtacttaccgtaccggtttacgggacgggtaacgggtaccggtaaggtacgggtaaacgtactaaacgaaacggtaacgtggttaacggg

SEQ ID NO: 295214 - DNA, 708 bp, Homo sapiens
  misc_feature: GYAE6OF01B0V0H.36.8.A08.1.454.CMB.1.raw
  modified_base (196)..(196): a, c, t, g, unknown or other
  misc_feature (196)..(196): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccatcctcctgtctgcatctgtagganacagagtccaccatctctcggccggtacaagtcaggcaattaacaatcattagcctggtatcagcaagaaaccgaagggtaattcctaagctactgatatatgtctgtattcactgtgacgtaacgtccggggtcctacgtcgtcggttacaggttcggacgtaggtaggtaataggttagggaactaggttactttactaccgtctaccgtacctaagttcgaacgtaccgaacgtcccgtagacccgtaacgtacccgtaaggtaaacgtaacgttcgttaaccggtaacttaaacgtttttaacgtttaacgtttaaccggttaaaacgtttaaaaacgttaacgttaaaccgtaacggttaccccggtacccccgttacgttaacccggttaacccgggttttaccgggggaaccggggtaaaccggggtaacccgtaaaaggggttcggtaaaacggttaaccgttaaacccgggaaaaccggttaacgggttcgggttaacccggg

SEQ ID NO: 295215 - DNA, 754 bp, Homo sapiens
  misc_feature: GYAE6OF01DYJUQ.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgcatctgtacggagacagagtcaccatctcttgccgggcaagtcgaggcattaacaatcattacgctggtatcagcagaaaccgaagggtaaacgttacctaagcctcctagatatatgtctagttacttcactgtgacgtaacggttccgggggtccctaacgttccgttacggttacgtaggttcgggccgtaagggttgggtaagttacgggttacggggaacgtaaggttaacgttttacctaacccgtttaccctacccgtaaaccccgtacttaccgaacggtaccgtaaccggtcccgttacggacccgtacggtccccgttaaggtaacggttacgtttacgggtttacgtaacctttaaaccgttttaagttttaacgttttaaacggttaaaccgttaaaaggtttaaccgttaaaccgtacggttacccgtaccccccggttacgttaccggttaaccccgggttttaccggggacccgggtaaacggggtaacccggtaaaggggttacggtaacggtaaccgtaaccggtaaaaccgggtaccgtagggttaacccggg

SEQ ID NO: 295216 - DNA, 543 bp, Homo sapiens
  misc_feature: GYAE6OF01AIB73.36.8.A08.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (517)..(517): a, c, t, g, unknown or other
  misc_feature (517)..(517): n is a, c, g, or t
  modified_base (525)..(525): a, c, t, g, unknown or other
  misc_feature (525)..(525): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccattcctccctgtctgcatctgtagganacagagtcaccatctcttgccgggnaagtcgaggcattaacaatcatttagcctggtatcagcaagaaaccagggtaaacgttcctaaagcctctgaatatatgctgtattcactgtgacgtaacgtcgggggtcccagttccgttcggttcaggtggcgtaggtggtatagtgggactagtacttactactctacaactatcgacgcacgtcctgaccagcctagaagtagttgttcgactaactttattaattacgtaataaacgttaactaacgacgttccgacccgtctaccgtacgttccggaggacggacgaaggngaacgtanacgaaacgtagtggtacg

SEQ ID NO: 295217 - DNA, 593 bp, Homo sapiens
  misc_feature: GYAE6OF01A9D1M.36.8.A08.1.454.CMB.1.raw
  modified_base (195)..(195): a, c, t, g, unknown or other
  misc_feature (195)..(195): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgcatctgtagganacagagtcaccatctcttgccgggcaagtcaggcattaacaatcatttagcctggtatcagcaagaaaccgagggtaaacgttcctaagctcctgatatatgctgtattcactgtgactaacgtccgggggtaccctagtccgtcggttacgtaggtggtcgtaggtcggtatagtagggtactagtactttcgtacttctaccaccatcaacgcgacgcctagccgacgtcctagaagtacttggttacgacttaacgtttatttaagttagttaactaaaagttactaacgtagtaccgaccccgtacttaccgtaccggtttaccgggacggggtaacgggtaaccgtaagggtacggtaaacggtactaaccgaaacggtacgtcgggtaccgg

SEQ ID NO: 295218 - DNA, 749 bp, Homo sapiens
  misc_feature: GYAE6OF01CIF7R.36.8.A08.1.454.CMB.1.raw
  modified_base (202)..(202): a, c, t, g, unknown or other
  misc_feature (202)..(202): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggcctccagataccagatgtgacatccagatcgaccctagtttcccactccctcctgtctgcatcgtggtaagganacagtacgtccactattccgtcgttcggaccgggacaaggtccgaggactaacttaacaatctaattacgtccgtaggtactacgacgacgaaacggaaaaccggtagggtaaacttaccgtaagtccgttaccgtagtaacttatacttgtacttacgttattccgtacgttgtacgtacgtacggggtcccggggtacctacgttccgttaccggtacgtacggtcgggtacgagggttaggagttaggtacgggtaactagttacgtttaccaccgttacctacccgtactaacgtcacggaccgtacgtccgtacgaccgtacgtaccgtaaggaagttacgtacggtttaactaactttaaggttttaactttaagttaaccgttaaattaaacgggtaacctaaccggtaccggtaccccgtaccccggttacgttacccggttaaccgggttacggggaaacccggggtttaacgggaacccgggttaaaggtaccgggtaaagtaaccggttaaaccgaacgggtacgttcgggtacgg

SEQ ID NO: 295219 - DNA, 773 bp, Homo sapiens
  misc_feature: GYAE6OF01CLQ0P.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccatccctcctgtctgcatctggtagagacagagtccaccatctcgtgccggacagtcgaggctaattaacaatctattacgaccgtaggtatcgaagtacaaacggaaaaccgtaacggggtaaaaccgttaccgtaacggtccttaccgtagtaagttattaagtgtaccgttaggttacttcgacgttgtacgacgtaacggttccggggtaccctagttccgttacggttaccgtaggttcgggtacgtagggtaggtagttacggtacgggtaactacggtttacttacctaaccgttctaacccgtaacctaacgttacccaaggtaccgacgtcccgttacgacccgtaacggtccgtaaaggtaacggttagttaccgggtttaacttaacccgtttaaacgttttaagttttaacgtttaaacgttaaaacgttaaaaaccggtttagtaaaacccgttaccgggttaccccgttaccccgttaccgtttaaccggttaccccgggtttacggggaaccgggttaacggggtaaaccggtaaacggggtacgtaaacgttaaccgtaaacggaaacccgttggtaccggttaccgg

SEQ ID NO: 295220 - DNA, 650 bp, Homo sapiens
  misc_feature: GYAE6OF01DRCPW.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgcatctgtagagacagagtcaccatctcgtgccggcagtcaggcataacatctattagcctggtatcagacacgaaacgagggtaaagttacctaagctacctgatatatgtctagtacttcacgttgtacgtacgtaacggtccggggtaccctagtcgttccggttcgaggtcggctaggtaggattagtacgggtactagttactttaccacgttacctaccgtaacctactacgaacgcctaacgtcctacgaccgacgtcccgtaaggtaagtacgttagttacgtaaccgtttaaacgtttaacgtttaagtttaacgttaaacgttaaaacggttcttaaaaccgtacggttaccccgaccccgttacgttaccgttaaccggtttacgggaaccgggtaacgggaaacccgtaagggtaggtaacgtaacgttaaccgaaacggtacggttaggtaccgg

SEQ ID NO: 295221 - DNA, 809 bp, Homo sapiens
  misc_feature: GYAE6OF01CAGBP.36.8.A08.1.454.CMB.1.raw
  modified_base (197)..(197): a, c, t, g, unknown or other
  misc_feature (197)..(197): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgacccagtttccactcctcctgtctgcatctaggtagganacagacgtacacatctcgttcggaccgggacaagtcgaggactaattaacaatctaagtttacgccttaggtactacagacaaggaaacccgtaagggtaaacttaccaacgaccttaccagtaactatatacgtcttagtacttacgtacgtgttacgaacgtacggtaccggggtcctagtccgttacggtacgtaggtcggtactaggtacggtaataggtacgggactaacggttactttacctacgtaccgtaaccctaaccgtaacgttacccgaacgtaaccgtacggtaccccgtagggaacccgtaaccgtacccggtttaaaggaaacgggtttaccgtagggtttttaaaccgtaaaccctttaaacggtttttaaaccttaaagttttaacggtaaaacccgttaaaaaggtttaaaccgtaaaaccgtacgggttaaccccgtcccccggttaacttaaccccggtttaccggggtttacccggggaaccgggggtttaaacccggggaaaccccggttaaaaggggtacgggtaaaaccgggttaaaccggttaaaaccggtaaaaacccggttaacggggttcggttaaacccgggg

SEQ ID NO: 295222 - DNA, 906 bp, Homo sapiens
  misc_feature: GYAE6OF01C3ED2.36.8.A08.1.454.CMB.1.raw
tcagtacgctgtctcacgaccggtgctcgatttagcatactctacagggggcagaagtctctctcagtcaggacacagcatggacatgagtgtccctgctcagctcctgggactcctgctgctctggcctcccagactaccagatgtagacatccagactcgaccctagttttccactccctccctgtctgcatcgtgtaggagacagacgtcaaccattcgttcgttcggccggggactaaacggtcgaacggggtacaaatttaaaccaattacctaagttttaacggccttaggtactacgagaccgaaggaaaacccgtaagggtaaaacgtttacccgtaaagcccttaccgtagtaactattaagttgtacctttaggttaactttacctacgttagttcggtaccgtaaacggggttcccgggggttacccctaacggtttcccggtttaccgggttacgtaacggggtacgggtaccgttaaggggttagggttaacgggttaacggttaccgggggtaaacgttacgttaacgtttttaccccgtaccttacccggttaacccaaaccgtaaccgttaaccgaccggtaccgtaaccgggtcccgttaccggccgtaacggttacccgtaagggtaacgttaggtttacggtttaacgttaaccgtttaaaactttttacgtttaaacgtttaacgtttaaaccgtaaaagtttaaaccgttaaaacccgtaccgggttaccccccggtcccggttaaccccgtttaacccgggtttacccgggtttaacccggggaccgggggtaaaacccgggggttaacccgttaaaaggggttaaccggggaaaacgttaaccggttaaaacccggtaaaacccggttacggttaaaccgggg

SEQ ID NO: 295223 - DNA, 803 bp, Homo sapiens
  misc_feature: GYAE6OF01C2UAZ.36.8.A08.1.454.CMB.1.raw
  modified_base (505)..(505): a, c, t, g, unknown or other
  misc_feature (505)..(505): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagactaccagatgtgacatccagatcgaccctagtttccactcctcctgtctgcatcgtgtaggagacagacgtcacctatctcgtcggccggacaagtcgaggactaattaactaactactattacgtccgtaggtactacgagaccgaaacggtaaaaccggtaaacgggtaaaccgttaaccgtaacgtaccgttaccgtaagtaattaagttattcgtacttagttacttactacgttaggtacgtacgtaacgggttcccgggggttacctcgttccgtttcggttacgtacgggttacgggtagtacgggttaggtacgttaggacgggtacgtaagttaccttacgaccttactaccaaccgtanacgtaacgaccgtaacgtccgtacgaccgtacgtacccggtagtaacgttgttaacggtttacgtaaccgtttaaagttttacgtttaaattaacgggttaaaacgttaaaaaccgttacgttaaaaccggtaccggttaccccgtaacccccggtttaaccgtcccgggtttaaacccgggggttttaccgggaacccggggggttaaaccgggtaaaccgggtaaacggggttaccgggtaaaacggttaaaaccgtaagggtaaaaccccgttaaaggttaccggggtaacccgg

SEQ ID NO: 295224 - DNA, 576 bp, Homo sapiens
  misc_feature: GYAE6OF01D4LJ0.36.8.A08.1.454.CMB.1.raw
  modified_base (220)..(220): a, c, t, g, unknown or other
  misc_feature (220)..(220): n is a, c, g, or t
  modified_base (422)..(422): a, c, t, g, unknown or other
  misc_feature (422)..(422): n is a, c, g, or t
  modified_base (442)..(442): a, c, t, g, unknown or other
  misc_feature (442)..(442): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccattccctccctgtctgcatctgtaggagacagagtcacatctctgccggnagtcgaggcattaacaatctatttagcctggtatcagacaagaaaccgagggtaaacgttccgtaagtcctacctagacttatatgctagttattctacgtgtacgactaacggtcgggggtaccctatcgtttcggttcgaggtggtacaggttaggactagtcgggactaggtatttcacttctaccgtacctatcagcncgacgtgccgagcctagagntgttgacttaactatttagtagttaactaaagtagtaaactacgtaccgtccccgatttaccgtacggtttacgggacggtaacgggaaccgtaagggtagtaacggaataacccgaacgttacgtcggtacgg

SEQ ID NO: 295225 - DNA, 810 bp, Homo sapiens
  misc_feature: GYAE6OF01CYO0A.36.8.A08.1.454.CMB.1.raw
  modified_base (187)..(187): a, c, t, g, unknown or other
  misc_feature (187)..(187): n is a, c, g, or t
  modified_base (217)..(217): a, c, t, g, unknown or other
  misc_feature (217)..(217): n is a, c, g, or t
  modified_base (600)..(600): a, c, t, g, unknown or other
  misc_feature (600)..(600): n is a, c, g, or t
  modified_base (608)..(608): a, c, t, g, unknown or other
  misc_feature (608)..(608): n is a, c, g, or t
  modified_base (628)..(628): a, c, t, g, unknown or other
  misc_feature (628)..(628): n is a, c, g, or t
tcagtacgctgtctcacgaccggtgctcgatttagcatactctacgagggggcagaagtctctctcagtcaggacacagcagtggacatggacgggtccctgctcagcctcgtgggacctctgctgctcgtcgcctaccaagtactacagtactaggacaacactaccagtactaccgtaacccttntttacccaccttccgtcctcgtactcgtanacgtcgtaggaggacacgaggtacctaccaacgtcgtcgtacggtaccgggacggtaacgaacggttacgaacggtactaaacgttaaacctagttaacgttaacggtttaaccgtcggttaacgggtaacctacgaacggtaaaccggaaaacgggtaaaaaccggtaacggttaaacgttaacccgtaacgttacccttaggttaataattaacggttaccgtaaagttccttaaacggtttactacggtaaccggttagtaacgggtaccggttaccggttacccgggttactcgttaccgggttacggtacgacgggttacgacgtttacggtaaggtaacgtagggagtaacgtacgtactactacctactacacgtnaacgtacncgtaccggtactacggtacncgtacgtacgttacgttaagacgtttaactaaccttaagttaacgtttaactaaacggttaaacgttaaacgtaccggtaacctccggttaacccgccgttaaaccgttccggtacggtaaccgggagggtaaccgaacgggtagaaacgtacggaacaacggttaacgacggttaggtacc

SEQ ID NO: 295226 - DNA, 630 bp, Homo sapiens
  misc_feature: GYAE6OF01CY9TN.36.8.A08.1.454.CMB.1.raw
  modified_base (232)..(232): a, c, t, g, unknown or other
  misc_feature (232)..(232): n is a, c, g, or t
  modified_base (253)..(253): a, c, t, g, unknown or other
  misc_feature (253)..(253): n is a, c, g, or t
tcagtacgctgtctcacgaccggtgctcgatttagcatactctacagggggcagaagtctctctcagtcaggacacagcatggacatgagggtcccctgctcagcctccgtgggactcctgctgctctggcctcccagataccagatgtgacatccagatcgaccctagtttccatccctccctgtctgcatctggtaggagacagactcacctatctcgttcggccggganaagtcgaggactaataacatntattagtcctagtatcagacaacgaaacgagggtaactactacgctcctagtatatagtgtacttagtactacgtacgtggtacgtacggtaaccgggtccggggtacctacgtccggtttacggtagacggtggcgtaggtacggtagttagggaggtaactacggttacttaccgtaccttccgtaccacctagtaccgagtcccgaacgccgtacgacgtacgtcggtaagtagttacgttagttacgtaacttaacgttttaattagttaacgtaaactaaagtactaaccgtacgtcccgtaccctgtaacccgttacgggtacgggacggtaacgggacgtaggtacgagtaacacgaacgtgtggtaccg

SEQ ID NO: 295227 - DNA, 723 bp, Homo sapiens
  misc_feature: GYAE6OF01BD7NE.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagagacagagtcaccatcctcgttgccgggcaagtcaggcataacaatcattagcctggtatcagcaagaaacgagggaaagttcctaagctctgatatatgctagtacttacactgtcgacgtaacgtccggggtacctacgtcgttacggttacgaggtcggtacgtaggttacggtaagttaacggttagggtaacgtaagttacgttttaccgaccttaccttacctaaccccgtaaacgttccgaaacgtaccccgtacggtccccttaacgggaccctaaccggtacccggttaacggtaaaggttacgtttacggttaacggtaacccgtttaaaacgttttactttttaaacgtttaggtttaaaaccgttaaaacgtttaacggttaaaccgtaacggttcccgtacccccggtaccgtttaaccggttaccggtttaccgggggaaccgggtacgggaaacccgggtaaagggttacggaacggttaacggtaaaccgaaaacggttaaccggttggttaccggg

SEQ ID NO: 295228 - DNA, 788 bp, Homo sapiens
  misc_feature: GYAE6OF01CJV89.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagactaccagatgtgacatccagatgacccagtttccattcctccctgtctgcatctgtaggagacagagtccacctatccttcgttcggcccgggacaacggtccgagggtactaagttaacaacttctaacgttttaacgtcccgttaggttacttaccaaggtaccgaaacggaaaacccggaaggggtaaaaccgtttacccgtaaaggtaccttccgtaggtaattaattagttacgtcgttacgtttacttaccgtacgttcgtaacggtacgtaacgggttcccgggggttacccctaagttccgtttccgggttcgtaaggtcggacgtagggttaggagttagggtacgggaacgttacgttacgtttaccgtaccttacaccctaacccgtacttacgaacgacccgaaccgtcccgtacgtaccgaacgtcccgtaaggtaacgttagtttacgttacgtaactttaactttaagtttacgtttaacgttaaaacgtaaagttacctaaacggtaccggtaccccgttacccgtaccgttaccgttacccgggtttacggggaccggggtaaacggggtaaacccggtaaggggttaccggtaaacgttaacgtaaaccgtaaaccggtacggttcggtaccggg

SEQ ID NO: 295229 - DNA, 784 bp, Homo sapiens
  misc_feature: GYAE6OF01AB6KU.36.8.A08.1.454.CMB.1.raw
  modified_base (332)..(332): a, c, t, g, unknown or other
  misc_feature (332)..(332): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagactaccagatgtgacatccagtatcgaccctagtttccactcctccctgtactgctatcgttaggtacggagacaggacgtccaccgattcctcgttacggcccgggacaaggtcgagggtactaattaacaactactatttaacgccgttaggtactcgagcgaagaaaccgagggtaacttcctaagtcctcgtanacgtatagtagcttagtacttacgactggtacgacaagggttcccggggtaccctacgttccgttccgggttacagggttcgaccgtaggtagggtaattacggggtcggtaactaacggttatttacccaacgttccctaccgaaaccccgtcttaaccgaaccggtaccctaacgggcccgttaacggtacccgtaaccgggtttacccgaaagggtaaagtaccgttttacgggttaaccggttaacctttaaacgttttaacgtttagtttaaccggttaaacgtaaaaggttaactaaaccggttaaccgtcccggtaaccccgttacgtaacccggtttaaccggtttcccggggaacggggtaaccgggtaaaccgggtaaggggaacgggttaacccgaaagtttaccccggaaaaaaccggttggtaccgggtttaaccgggg

SEQ ID NO: 295230 - DNA, 932 bp, Homo sapiens
  misc_feature: GYAE6OF01CML0N.36.8.A08.1.454.CMB.1.raw
tcagtacgctgtctcacgaccggtgctcgatttagcatactctacagggggcagaagtctctctcagtcaggacacagcatggacatgagggtccctgctcagcctcctgggactcctgctgctctggctcccagataccagatgtagacatccagatcgaccctagtttccacttccctccctgtacctgctatccgtaggtaaggagaacaggtacgtaccaccctagttccttcgttacgggccgggactaacggtccggaagggtacctaattaaacaattctaacgtttacgtccgttaggtactacgaacgtacgaaacggtaaaaccgtaacggggtaaaaccgtttaccgtaacgtcctaccgtagtaattaagtattcgtaccttagttacttacgtacgttgtcggtacgtacgggttcccggggtacccttacgttcggttccggttacgtaggttacgggtaccgtaagggttaggtaaccgttaagggttaaccggggtaacgtttaggttaacccgttttaccggttaaccctttcccttaaacccgtaacccgtacgtaccggtaaaccgcccgtaaccgggtacccttaccgggaacccgttaaccggtacccgttaagggttaaacttacggttttacgggttaagttaaccgttttaacttttaaacgttttaggtttaaaccggttaaaaaccgttaaaaccggtttaacttaaaaccgggttacccgggtttacccgtaaacccccccgggtttacgttaaccccggggtttacccgggggtttaaccccgggggtaaaccggggtaaacccgggggttaaaaccgggaacgggggtttaaaccgggaacccgtttaaaacccgggttaaaccaaaaccggggtttaaccgggttaccggggttaacccggg

SEQ ID NO: 295231 - DNA, 636 bp, Homo sapiens
  misc_feature: GYAE6OF01AZTOZ.36.8.A08.1.454.CMB.1.raw
  modified_base (199)..(199): a, c, t, g, unknown or other
  misc_feature (199)..(199): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccactccctccctgtctgcatctgtagganacaggatcaccatctcgtggccgggacaagtcagggctaattaacaatcatttagcctaggtactcagtacaacgaaaccgagggtaacttacaagctccgtgaatactatctcttagtatactacgtgtgactacggtccggggtcctatccgtcgttgaggtcgactaggtcgagtagtcgggactagtacttcacgtctaccactagtcgacgactacgccgttagactacgtccgtaagagttacgttaggttaccaacttaacttaatttaagttaacttaaaccgttaaaattacccgttaaatcccggtaccgttacccccgcgttaacccgtttcgggtttaccccggggaacgggtaaccgggttaaccgaaaggggtttccggaaacgttacgaaacccgtaaacggtaaccgggttgtaacccggg

SEQ ID NO: 295232 - DNA, 526 bp, Homo sapiens
  misc_feature: GYAE6OF01BL0KV.36.8.A08.1.454.CMB.1.raw
  modified_base (197)..(197): a, c, t, g, unknown or other
  misc_feature (197)..(197): n is a, c, g, or t
  modified_base (209)..(209): a, c, t, g, unknown or other
  misc_feature (209)..(209): n is a, c, g, or t
  modified_base (224)..(224): a, c, t, g, unknown or other
  misc_feature (224)..(224): n is a, c, g, or t
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (400)..(400): a, c, t, g, unknown or other
  misc_feature (400)..(400): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatctagatgaccctagtttccatccctccctgtctgcatcgtgtagganacagagtcaccntcctcttggccgggnaagtcgaggcattaacaatcattagcctggtatcagcaagaaccgaggaagttcctaagctctgatatatgctntatcactgtacgcgtaagtccggggtcccagtcgtcgttcgagtggcaggtgatgtaggacagtnttcactctcaccatcgancagtcctgcngcctaggantgtcactattattactagtaacctaaagtactaaccgagttccgacccgtccgtacgtcggttccggacgggtaaccggacggtaaggtcggaacgtacgtaaaccgaacggtaacgtgtaacggg

SEQ ID NO: 295233 - DNA, 718 bp, Homo sapiens
  misc_feature: GYAE6OF01CQD4R.36.8.A08.1.454.CMB.1.raw
  modified_base (183)..(183): a, c, t, g, unknown or other
  misc_feature (183)..(183): n is a, c, g, or t
  modified_base (214)..(214): a, c, t, g, unknown or other
  misc_feature (214)..(214): n is a, c, g, or t
  modified_base (651)..(651): a, c, t, g, unknown or other
  misc_feature (651)..(651): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctccagataccagatgtgacatccagatcgaccctagtttccattccctcctgtcngcatcgtaggtagagacagtacgtccacctntccttcgtcggccgggataagtcggaaggactaattaacaatacttagtttacggtccgttaggtactacgaggtaccgaaacggaaaccggtaaggggtaaaccgtttaccgtaacggtccgttaccgtaggtaattacgttacttacgtaccgtttagttacttaccgtacgtttcggtacggtaccgtaaacggggttcccgggggttacctaaccggtttcggttaccggttacgacgggttcggacggtaggtacggtagttacggtagggtactacggttactttaccgacttccgtacacgtacgtaccgaacgtcgaccgtacgtacgaccgttacgacccgttaaggaacgttagttgttaaccgtaacttaactttaacgttagttaacgtaaacgtaaagttactaacgtccggtcctaccccgtntaccgttacggtacgggtacggtacgggaccgtagggacgtacgtaactacggaactggttacgacg

SEQ ID NO: 295234 - DNA, 746 bp, Homo sapiens
  misc_feature: GYAE6OF01ASLH0.36.8.A08.1.454.CMB.1.raw
  modified_base (219)..(219): a, c, t, g, unknown or other
  misc_feature (219)..(219): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatccctccctgtctgcatcgtgtaggagacagagtcaccatctctgccggnaagtcaggcattaacatcatttagcctggtactcagcaagtaaaccgaagggtaaacttacctaagtcctaccgtagtaatactatgacttgtattccagttgacgtactaaagtccggtaagggtcccctaagttccgttccgggttacagggttacggccttaaagggttcggaagttacggtacggggtaactaaggttacttttccgaacttaccgttaccaaccgtatacgacgtaccaacggtacccgttgaccgtaacgccgttaaggaaacggttacgttacggtttaccgaaccgtttaaaaccgttttgttttaaaacgtttaacggttaaaaccgttaaaaacgtttaacgttaaaacccggtaccgggttacccgttaaccccccggtaacgtttacccggttaaccgggttttaccggggaaccggggttaaaccgggggtaacccgttaaacgggggttaaaccggtaaggttaaaccttaaacccgggaaaacggttaacccggttacgggg

SEQ ID NO: 295235 - DNA, 804 bp, Homo sapiens
  misc_feature: GYAE6OF01C4ZRZ.36.8.A08.1.454.CMB.1.raw
  modified_base (97)..(97): a, c, t, g, unknown or other
  misc_feature (97)..(97): n is a, c, g, or t
  modified_base (192)..(192): a, c, t, g, unknown or other
  misc_feature (192)..(192): n is a, c, g, or t
tcagtacgctgtctcacgaccggtgctcgatttagcatactctacagggggcagaagtctctctcagtcaggacacagcatggacatgagggtcccngctcagcctccgtgggacctcctgctcgctcgtcggcctcccagactaccagatgtgacatccagctcgacctagtttccattccctccctgtcngacctatcgtagaggacgtacagtacgtaccacctacttccgttcgttacggccgggaataacggttccggaacggggtaaccttaaactttaaacgaacttaccgttaacggttttaccgccgttaaggttacctacgaacggaaccgaaacggtaaaccggtaaggggttaaaccttccaacggtccttacgtaagacgtttaatcgttacgtcttaacgttacgtacgtacgtggtaccgtacggtaacggtccccgggtactacgttccggttacggtacgaggttaccggacgtagggtacgtaacgtggtaccgggtacttaacgttaccgttacctaacttaccgacgttaactaccgtaaccggtacgtaccgtaccgttacccgacgtaccggtaccgttaaccgttaaggtaacgttaccgtttaagggttaaccccctaaagtttaaccggtttactacggttaccctaaacggtaacttaacgttaaccggtttaacccttaaaccgtcccggtttacggtaacccggttcgaaaccgggaacgttacggggaaacgttacgtacgtaaacccgtaagtacggcgttaagcccgtaacgg

SEQ ID NO: 295236 - DNA, 838 bp, Homo sapiens
  misc_feature: GYAE6OF01DBNBL.36.8.A08.1.454.CMB.1.raw
tcagtacgctgtctcacgaccggtgctcgatttagcatactctacagggggcagaagtctctctcagtcaggacacagcatggacatgagggtccctgctcagctccgtgggactcctgctgctctgcctcccagataccagatgtgactatccagactcgaccctagtttcccacttcccgtccctgtctgctatcgtaggaggacgacgagtacgtccaacctcttcgttcgtcgggaccggataacggtcggaggtactattaaacattctagtttacgccgttaaggtactaccgaaggaccgaaacggtaaaaccggtaaggggtaaaacctttaccgtaacgtccgttacctaagtattaacgtctaggttacttacgttacgtaaccgtacggtcgttacggaaccggttaaccgggggttaccccggggtaacctaacggtttccccggggtttacggttaacgacggggtttccgggacggttttaagggacggggtaacttaacgggtacgggaactttaaacggttctttacccgtaaccttcgaacccctagtacgaactaacgtccgaaccgtcgacgtacgacgtactaaggtacgtattcggtaacttaaccgttaacttttagtaacgttaacgttaaaacgtaaacgttaccgttaagtaccccgggtttcccacccgggtttaacgttaccgggttaaccccggggtttaaggggggaacccggggttaacccgggggtaaaacggtaaacggggtaaccggtaaacgttaaaacccggttaaacccggaaaacggggtccgtttcgggggaaaccccgg

SEQ ID NO: 295237 - DNA, 781 bp, Homo sapiens
  misc_feature: GYAE6OF01C7OQW.36.8.A08.1.454.CMB.1.raw
  modified_base (227)..(227): a, c, t, g, unknown or other
  misc_feature (227)..(227): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccatccctccctgtctgcatctgtaggagacagacgtcacctatctcgtcggccggganaaggtcgaggactaataacatactattacgcctaggtatcgagtacgaacggaaaccgtaagggtaacttaccgtaacgtctaccgtagtattaatagttcgtcgttagttacttaccgtacgttggtacgtacggttaaccggggtcccgggggttaccctacggtttcccggtttaccggttacggtacgggttcgggtacgtaagggttagggtaagttacgggtacgggtaactacggttacctttaccgtacctttaccgtaccctaaccgtaccgttaaccggactacccggtaccgtacccgtacggtaacccgacggttaccgtaagggtaaccgttacggttacgttaaccgttaacgttttaaccgttttaagttaacttaacgtaaaaccgttaaaacgttacgtaaccggttaccggtacccgtacccccggttacttacccggttaccggggttaccgggaaccggggtaacgggtaaccggtaacgggtaacggtaacgtaaaccgaacgggttaaaccgtccgggttagggtaacccgg

SEQ ID NO: 295238 - DNA, 520 bp, Homo sapiens
  misc_feature: GYAE6OF01EVJ72.36.8.A08.1.454.CMB.1.raw
  modified_base (418)..(418): a, c, t, g, unknown or other
  misc_feature (418)..(418): n is a, c, g, or t
  modified_base (511)..(511): a, c, t, g, unknown or other
  misc_feature (511)..(511): n is a, c, g, or t
tcagtacgctgtctcacgaccggtgctcgatttagcatactctacagggggcagaagtctctctcagtcaggacacagcatggacatgaggggtccctgctcagctcctgggactcctgctgctctggctcccagataccagatgtgacatccagatgacccagtttccatcctccctgtctgcatctgtaggagacagagtcaccatctcttgccgggcaagtcagggcattacatcattagcctggtatcagcagaaaccaggaaagttcctaagctcctcgatatatgctgtattcactgtgcatcgggggtccactctcggttcgagtggtcagttggactagtgggtacagagtttctactcttacacctatcacgtcagcctgcagctacgagatgttgacacttattattntacgtaaatataacagtcgaccccgtcttccgtacgtttcggtccgggaacgggtaccgaaagggtacggtaagacgtaagaaccggttaacnggttacggg

SEQ ID NO: 295239 - DNA, 792 bp, Homo sapiens
  misc_feature: GYAE6OF01B1PS4.36.8.A08.1.454.CMB.1.raw
  modified_base (306)..(306): a, c, t, g, unknown or other
  misc_feature (306)..(306): n is a, c, g, or t
tcagtacgctgtctcacgaccggtgctcgatttagcatactctacagggggagtctccctcactgcccagctgggatctcagggcttcattttctgtcctccaccatcatgggtcaaccgccatcctcgccctcctcctggctgttctccaaggagtctgtgccggaggtgcgagcgtgggtcgcgtagtcgtgggaggcgggaggtaaggaaaacgggcccggggagtctacgtagaaactcctccgtagtacggtcttcgtggtactaactaccttaacctacttcgtggagtcggcgtgggtncgccgagcgtcggaccggggaacggtcgtagggaggtggaggtggggtacgtcgtacgtacgtcggtggtcgtactcgtagaacctacgacggtactaccgtaccgtccccgttacctaccgacggtccgtacggtcccactatacgtaccgacgtaccgactacgtacacgtacgaccgccaccctaccctcccgtaacgtacggtacgggtacgtcggaccgtacgggtaccgcccgtaaccggaccgacccgacttaacgttaacgttaaaccgttcgttacggacggtacggtaacgaacggtacggttaacgggtaaacgtacgttaaacggggttggggttaacgggtacgggttttcgggggttttaaacgggggtttttccgggggggggaacgggggttttccccgggttaacggggggttcccgggggtaaaccccgggggttaaccccggggttaaccccggggttcccccgggg

SEQ ID NO: 295240 - DNA, 846 bp, Homo sapiens
  misc_feature: GYAE6OF01EB13L.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccacttccctccgtgtctgctatcgtaggtaggagacgagtacgtaccacctattccgttccgttcggacccggggtacaacggtcgaacgggtactaaacttaaacgtaacttacttaacgttttacgtaccgttaggttactacgtacgaaccgaaacggaaaaccggtaaggggtaaacgttaccgttaaacgtaccgttacgtacgtaacgttagtagttacgtacgttagttacgttacgtacgttggtacgtaacgtaccggggttacccgggggtaccctacggtttccggtttaccgggttaccgtagggtcgggtaccggtaagggttacggtaacggtttaaggtacggggttaacgtacggtttacgtttaacccgtaccttaacccgttaacccgttaaccgtaaccgttacgtaccggtaccgtaccgtacccgtaggacccgtacggtaccgtaaggtaacgtacgtttacggttacgttaaacctttaagtttaactttaagtttaacgttaaacgttaaacgttaaccgttaacgtaaccggttccccggtaccccgttacgtacccgtttaccgggtttaacccgggacggggtaaccgggtaaccgggttaagggtacggtaaacgttacggtaaaccgtaaacgtccggttggtaccgg

SEQ ID NO: 295241 - DNA, 655 bp, Homo sapiens
  misc_feature: GYAE6OF01CCJK0.36.8.A08.1.454.CMB.1.raw
  modified_base (274)..(274): a, c, t, g, unknown or other
  misc_feature (274)..(274): n is a, c, g, or t
  modified_base (522)..(522): a, c, t, g, unknown or other
  misc_feature (522)..(522): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagactaccagatgtgacatccagatcgaccctagtttccattccgtccctgtctgcatctagtaggagacagtagtcacctatctcgttcggccggacagtcgagggactaagttaacagtctaattacgcctggtatcganacgaagaaaccggaaggtaaacttccgtaagtcctacgtgtaatactagtgtcttagttacttacgtactggtccgtacggtaacggttccggggtaccctacgttccgtttccggttacgtaggtcgggtacgtaggtaggtaattacgggtcgggtaactaggtttacttaccggaacttcctacaaccccgtataccggaacgccgtacgtcctaggaccgtacgtcgtagaacgttgtacgttntaacttaactttagttacgtagtaaacgtaaagtcgtaactaccggtccgaccccttagtcccggtagggttcggacgggaagggtacccggtagggttaacggactaaccgtagtaaaccgtggtcgtacgg

SEQ ID NO: 295242 - DNA, 764 bp, Homo sapiens
  misc_feature: GYAE6OF01C2JET.36.8.A08.1.454.CMB.1.raw
tcagtacgctgtctcacgaccggtgctcgatttagcatactctacagggggcagaagtctctctcagtcaggacacagcatggacatgagggtccccgctcagctccgtggggctcctgctgctctcggctccgaggtgccagatgtcgacctataccaaatcgacccagtctccactccctcctgtctgctatccgtaggtaggagacgagtagtcatcgatcctacgttcggccgggactaagtcgacggtactaagttaagaagtgtacgtttaggcttaggttacacgagtaccgaacggtaaaaccgacgggtaaaccgacccgtaacgtcctacctactagttaccgtagtcggtacgacctacttaccgttaacgtttaacgtaaaccggttcgggttaaccctaagtttaacgacttcgacggtacggtcgttaagggcgtagttacggacggttacaaccgttacgttacctttacgtaccccttaccgtaccaacccgtacgtaccgaacgtccgtaccgtccgtacggacctacgggtaccttaaggtttaacgttacgtttaccgtaactttaacgtttaaccgtacgtttacgtaaccttaaccgtaacgtttaactttaccgttaaacccgtttacccgttaccggttaccccgggttaacggaaccgggtaaaccggtacggttaacggtaacgggaaccttaaccgggaacgtaaacggttcgggaggtacccttgggacccttaacg

SEQ ID NO: 295243 - DNA, 658 bp, Homo sapiens
  misc_feature: GYAE6OF01CZ5QS.36.8.A08.1.454.CMB.1.raw
  modified_base (197)..(197): a, c, t, g, unknown or other
  misc_feature (197)..(197): n is a, c, g, or t
  modified_base (225)..(225): a, c, t, g, unknown or other
  misc_feature (225)..(225): n is a, c, g, or t
  modified_base (320)..(320): a, c, t, g, unknown or other
  misc_feature (320)..(320): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatccctccctgtctgcatctggtagganacagagtccacctatctcgtggcccggnaagtcgagggactaattaacaatctaagttagcctaggtatcagacgaagaaaccgaagggtaaacgttcctaagtcctacctagtatatatgtnttagtattcgtacgtgtacgacgtaaacggtccggggtaccctagttccgttcggttcgaaggtggcgtagggtcggtaattaggtagggtactaggttacttccgacctcgtaccaaccctatcgaacgacgtcgacctggaccgacgtaccgttaagaagttacgtttcgttaacgtaaccttaaaggttttaactttagtttaacgttaaacgttaaaagttactaaacgtaccgttacccgccccgttacgttaccgttaccggtttacggggacgggtaaaccgggtaacgaaggggttacgaacgtaacgtaaccgaaacgtagtggtaccg

SEQ ID NO: 295244 - DNA, 894 bp, Homo sapiens
  misc_feature: GYAE6OF01EM7NY.36.8.A08.1.454.CMB.1.raw
  modified_base (111)..(111): a, c, t, g, unknown or other
  misc_feature (111)..(111): n is a, c, g, or t
  modified_base (209)..(209): a, c, t, g, unknown or other
  misc_feature (209)..(209): n is a, c, g, or t
tcagtacgctgtctcacgaccggtgctcgatttagcatactctacagggggcagaagtctctctcagtcaggacacagcatggacagtgagggtccctgctcagcctccgngggacctcctgctcgctcgtggcctcccgagactaccagtcgtgtcgacactccgaagactaccgaacccgttagtttcccacttccctccctgtcgnctagtcgtaggtaggacgaacgacgtacgtacccacctacgttcccttccggttccgggaccgggtactaacggtccggaacgggtacctaaacgttaaaccgtaacgttacgttaactttacgtccgttaggtactacgaacgtaacgaaacggtaaaccgggtaaggttaaaccgttaccgttaacgtaccgttacgttacgtaacgttagttacgtacgttacgtttacgttactttacgtacgttaggtaccgttaaccggtaccggggttcccggtacttaccggttccgttacggttcggtaaggtcgggtaacggtagggtaacggtagggttaagggtacggtaacgttacgttaccgtttacccgtacctacacccgttacacgtacgacgtaccgtacgtccgtaccgacccggttaacgaccgtacggttaacggtcgtttacggtaaccctttaagtttaacgttttaaacgttaacgtttaaaccgttaaacgttaaaacgttaaccgtaacccggttcccggtaccccgtaccccgttaaccggtttacccgggttccggggttaacccggggtaacgggtaaccgggtaaacccgggtaagggttaacccgggtaaaggtaaaccccggtaaacggttaaccccgggttaacggtaccggttaacccggg

SEQ ID NO: 295245 - DNA, 586 bp, Homo sapiens
  misc_feature: GYAE6OF01EQ3HD.36.8.A08.1.454.CMB.1.raw
  modified_base (194)..(194): a, c, t, g, unknown or other
  misc_feature (194)..(194): n is a, c, g, or t
  modified_base (197)..(197): a, c, t, g, unknown or other
  misc_feature (197)..(197): n is a, c, g, or t
  modified_base (204)..(204): a, c, t, g, unknown or other
  misc_feature (204)..(204): n is a, c, g, or t
  modified_base (208)..(208): a, c, t, g, unknown or other
  misc_feature (208)..(208): n is a, c, g, or t
  modified_base (213)..(213): a, c, t, g, unknown or other
  misc_feature (213)..(213): n is a, c, g, or t
  modified_base (216)..(216): a, c, t, g, unknown or other
  misc_feature (216)..(216): n is a, c, g, or t
  modified_base (219)..(219): a, c, t, g, unknown or other
  misc_feature (219)..(219): n is a, c, g, or t
  modified_base (223)..(223): a, c, t, g, unknown or other
  misc_feature (223)..(223): n is a, c, g, or t
  modified_base (280)..(280): a, c, t, g, unknown or other
  misc_feature (280)..(280): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (291)..(291): a, c, t, g, unknown or other
  misc_feature (291)..(291): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatccctcctgtctgcatctgtaganacngatcacntctntgcgnagnagnatanatcattgcctaggtatacagacaagaaacgaggtaacgtacctaagtctcagatatntnctntattcngtgtgacgaacggtccggggtcctagtctcggttacgagtcgtacgagtaggtagtagtagggactagttactttacacgttctaccgaactacacgctaccgacgtccgttacgctacgtacctagggtaagtcgtttacggtacgtaacttaaaccggtttaattttagttaacgtaaacttaaagtacttaaacggtacgtccccggtaccctacgttaccgtaaccggttccgggaacgggacggtaaccggtaaggtacggacaacgttaacgaaacgtgtcggtaccgg

SEQ ID NO: 295246 - DNA, 710 bp, Homo sapiens
  misc_feature: GYAE6OF01CHY7S.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagactaccagatgtagacagtccagtatcgaccctagtttcccacttccctccctgtcctgactatcgtaggtacggagaccagacgtccactatctacgtcggaccggtaagtcgaggactaataacatctattacgctgtactcgacgacgaacggaaaccggtaagggtaaccttaccgtaacgtccttaccgtagttaactagttacgtactcgttagttacttacgtacgttggtacggtaaccggtaaccggggttccgggtacctacggttccggtcggtacggtacggtgacgtaggtacgtagtacggtcggtacttagtacctttcgaccgttactacccgtaactacggtccgaacgtccgtacgtaccgtacggccgtacgacgttaaggtacgttacgttagtacgtaactttaaggtttaattacggtaactaaacgtaaagttacaacggtccggtacccgaccggttactaccgggttaccggtagggaccgggtaaggaaccgggttaaggtaccgtaaacggtaaccgaaacccggtaccggttaaggtcccgggtaacg

SEQ ID NO: 295247 - DNA, 942 bp, Homo sapiens
  misc_feature: GYAE6OF01CGHTH.36.8.A08.1.454.CMB.1.raw
  modified_base (108)..(108): a, c, t, g, unknown or other
  misc_feature (108)..(108): n is a, c, g, or t
  modified_base (186)..(186): a, c, t, g, unknown or other
  misc_feature (186)..(186): n is a, c, g, or t
tcagtacgctgtctcacgaccggtgctcgatttagcatactctacagggggcagaagtctctctcagtcaggacacagcatggacatgagggtccctgctcagctccngggactcctgctgctctggcctcccagactaccagatgtgacagtccagatcgacctagtttccactcctcctgcgtncgtatccgtgtacggagacacggataccaccgtatccgttagttcggccggggtactaacggttccgacggggtacctaaccgtttaaactaacgttacctaacgtttacggacccttagggtacttaccgacggtacgtaacgaaaacccggtaagggtaaaccgttaccgttaaacggtcgttacccgtagtacgtaactaacgtcggtacttcggttacttaccgtacgttaggttacgtaccggtaacggttacccgggggttacccctaaccggttaccgtttaccggggtttaccgtaacgggttacggggtaccggttaacgggttacgggtacgtttaaacgggtaacgggtaacgttaaacgggttaccgttttacccgtaaccgtttcccgtaacgtaacccccgttaacgtaccgttaacgggtacccgtaaccgggtaccgttacccggtaccgtaacgggtacccgttaacgtaaccggtaacgtttacggggtaccttaaaccggttaaacgttttaacgtttaaccgttacggtttaaaaccgttaaaacggttccgtttaaaaaacccggggtccgtttaaaccccgttaacccccgggtaggtttaacccccgtaacccggggttttaacccggggtaaccggggtaaaccgggttaccccgggtaaaagggttaccgggtaaaccgggtaaacgtttacccccggaaaaccggttaacgggttcgttaaacccggggg

SEQ ID NO: 295248 - DNA, 701 bp, Homo sapiens
  misc_feature: GYAE6OF01CKZ9H.36.8.A08.1.454.CMB.1.raw
  modified_base (192)..(192): a, c, t, g, unknown or other
  misc_feature (192)..(192): n is a, c, g, or t
  modified_base (208)..(208): a, c, t, g, unknown or other
  misc_feature (208)..(208): n is a, c, g, or t
  modified_base (235)..(235): a, c, t, g, unknown or other
  misc_feature (235)..(235): n is a, c, g, or t
  modified_base (295)..(295): a, c, t, g, unknown or other
  misc_feature (295)..(295): n is a, c, g, or t
  modified_base (356)..(356): a, c, t, g, unknown or other
  misc_feature (356)..(356): n is a, c, g, or t
  modified_base (376)..(376): a, c, t, g, unknown or other
  misc_feature (376)..(376): n is a, c, g, or t
tcagtacgctgtctcacgaccggtgctcgatttagcatactctacgagggggcagaagtctctctcagtcaggacacagcatggacatgagggtccctgctcagtctccgtgggactcctgctgctctgcctccatactacagattgacacatccgagatccgacccttagttccacgttccctcctagtcngcatcgtagagatacngactcactactcgtacgtggaccgganaacgtcgaaggtcctaaattaactactattaacgttgaccgtggttaacacaccggtaanaaaccggtaaacggtaaacgggtaacttacccgtaggtaccttaacgtgtaaattagttanacgtactattacgtaccgtntaggcgtaaccgtttaacggggccggtttaaccagttcccggtaagttggaacgcggtacgtggtacggatacggtagtacttagtactccgattaccgcaacgtactacgaacgtctaaccgtggtacacggacttaggtacgagttaccgtgttaaccgtaaatttaccttaaagttaccgtaataaaaccggttaaactacgtaacggtccccgtaaacccgttccctaaggttacccggttaccggggtacgggaaccggttaacggtaagaacgggggttaactacggaaactaaccggaaaccggtgtccgggtacccg

SEQ ID NO: 295249 - DNA, 902 bp, Homo sapiens
  misc_feature: GYAE6OF01B1ST6.36.8.A08.1.454.CMB.1.raw
  modified_base (156)..(156): a, c, t, g, unknown or other
  misc_feature (156)..(156): n is a, c, g, or t
  modified_base (194)..(194): a, c, t, g, unknown or other
  misc_feature (194)..(194): n is a, c, g, or t
  modified_base (294)..(294): a, c, t, g, unknown or other
  misc_feature (294)..(294): n is a, c, g, or t
tcagtacgctgtctcacgaccggtgctcgatttagcatactctacagggggagtctccctcactgcccagctgggatctcagggcttcattttctgtcctccaccatcagtggggtcaaccgcatcctcgccctcctcctggctgttctccaaggngtctgtggccgaggtgcgagcgtggtgcagtcgtgggngcgggaggtaaggaaaacgggccgggatcgtactaagaaactctcgtagtacgtcttcgtgatacctaccttactattcgtgtacgtcggtcgtgggtcnccgcgtagacgtacgggaccggggacggcggtagggaggtggtagggtgggtactcggtacttcgtccggtggtatccgttacgacgtaactaacgacgtactaccggtacccggtcccgttaacccgttacgaacccggtaccggtaaccgtaccgtacctacgttccgtaccgtaacggttaacccggaaacgttaacccgttacccgaaagttaccccgaaccccggtaacccccgggttaaccccccttaaccccgttaaccccgtaacccgggtaaacgggttacccgggggttaaacccgtaacccgggttcccggtaaaacccggggggtaccccggtcccccggtaaacccgggtaacccgtaaccccgggttaccttaaaagtttttaaccggttaacccgtttaaccggttgggtaccggtaaccggtaagtaccggttaagggtaaacggttaaccgtaacggtttacggggttaagggtcggggttaaccgtttacgggtttttacggggggttaggggggggtacccggggttacccggtttagggggaccccggggtttaccggggtaaaccgggtccccgggttttaacccgg

SEQ ID NO: 295250 - DNA, 767 bp, Homo sapiens
  misc_feature: GYAE6OF01CE9VF.36.8.A08.1.454.CMB.1.raw
  modified_base (163)..(163): a, c, t, g, unknown or other
  misc_feature (163)..(163): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgacccngtttccatcctccctgtctgcatctggtaggagacaggtagtaccacctatccgtacgttcggcccggggtacaaggttccgaggggaccttaagttaaacgaacttacgtaacttttaacggcccgttaggtacttacgaacggaccgaaacggaaaaccgtaaagggtaaacgttacccgtaacggtcctacctaggtaattaacgttatacgtcttacgttacttcgtacgttagtacgaccgtaacgggttcccggggtacctacgtacgttccggttacgacggttcggacgtaggttaggacgttacggtacggggtataacggtacttttacccgaacttcgtaacctaaccccgtagttaccaggtaacccgtacgacccgtttacggacgtaccggaccgttaaggtaacgttagttacgttcgtaaccgtttacttttaattaacggtttaactaaacgttaaaacggtttctaaaacccgttacggtacccgtaccccgtacgttaccgttaccggtttaccgggggaacggttaacggggttacgaaacgggttcggaacttacgaaccggtaaacggcgttggtaacccgg

SEQ ID NO: 295251 - DNA, 727 bp, Homo sapiens
  misc_feature: GYAE6OF01AVB83.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcgttgccggcagtcgaggctattaacatctattacgcctggtatcagacaagaaccgaaggtaacgttacctaagtcctacctagacttatatgtctgttaacttctacgtgtcgacgtaacggttccgggggtacccacgttccgtcggttgtacggtggtacgaggtacggtagttaggtacgggtaactaggttactttaccgtaccttaccgtaccaaccctagtaccgaacgtccgtaaccgtcccgtacggactaaccggtcccgttaaggaacgttacggtttacggttacgtaaccgttaaacgttttagtttaacgttaacggtttaaaccgtaaaaagtttacctaaggtaacccggttacccggttaccccctaaccgtttacccggttaccggttttaaccccggggaacgggggtaacccgggttaaaacccggttaaagggggttaccggtaaacggttaaacccgtaaaccggtaaaccggttaaccggttcgggtaacccgg

SEQ ID NO: 295252 - DNA, 696 bp, Homo sapiens
  misc_feature: GYAE6OF01DCIH0.36.8.A08.1.454.CMB.1.raw
  modified_base (311)..(311): a, c, t, g, unknown or other
  misc_feature (311)..(311): n is a, c, g, or t
  modified_base (357)..(357): a, c, t, g, unknown or other
  misc_feature (357)..(357): n is a, c, g, or t
  modified_base (415)..(415): a, c, t, g, unknown or other
  misc_feature (415)..(415): n is a, c, g, or t
tcagtacgctgtctcacgaccggtgctcgatttagcatactctacagggggcagaagtctctctcagtcaggacacagcatggacatgacgggtccctgctcagcctccgtgggacctcctgctgctcgtcggcctcccagaactaccagatgtacgacactccagtactcgaccctacgtttaccacttccctcccttgtctgcagttcgtaggtaggacaacgaggactccacctacttccttcggttcgggaccgggacaagtcgacggaaccttaattaactagtcttaacgtttacgtcgtagtanacgagacgaacggaaacgtaggtaaacctcgactctagtacacttnatcgtctaccgtctacttagtcgacggcgttacggaccggtctacgttcgtacgtcgnggtccgagtacggtagttacgtcggacgtagtacgttacttacgtactccgtactactacgtacacgtccgtaccgacgtcgtaccgtacgtacgtacggtagttacgttacgttaacctttaacgttaacgtttaacgttacgttaacgttaaacttaaacggttaacgttaacggtaccttaccgtacctccgtaccgttacggtaaccggtttacgggaaccgggttaacggaaccggttaggtaacgtaaacgtacgaaacgtaaggtacggtacgg

SEQ ID NO: 295253 - DNA, 866 bp, Homo sapiens
  misc_feature: GYAE6OF01B3ISU.36.8.A08.1.454.CMB.1.raw
  modified_base (186)..(186): a, c, t, g, unknown or other
  misc_feature (186)..(186): n is a, c, g, or t
  modified_base (231)..(231): a, c, t, g, unknown or other
  misc_feature (231)..(231): n is a, c, g, or t
tcagtacgctgtctcacgaccggtgctcgatttagcatactctacaggggggcagaagtctctctcagtcaggacacagcatggacatgagggtccctgctcagctcctgggactcctgctgctctggcctccagatacagatgtgacatccagactcgaccctagtttccacttccctcctgtcngctatcgtgaggacgacagacgtccactatctacgtcggccgganaaggtcgagggactaataacaatactaagttacgtacttcggtactacaagacaaggtaaaccgaagggtaaacgttaccgtaagcctacctagtaattaactagtcgtcttattacgttactagtacgtacggacgtaaacgggtccgggggttaccctacgttacggttccggtacgtacggttcgaggttagggtacgttaagtacggtacgggtaactaggttaacctttaccttaactacccgttaaccgtaacccgtacgttaccgaaccgttacggaccgttacccggtacgttaacccggaacgtttaccggaaacggtttaaccgggttaagtttacggggtttaaccttaaaccttttaaacccggtttttaattttaaacggtttaaaccggggttaaaaaacctttaaaaacggggttaaacctttaaaacccgggtaacccgggttttaccccgggtaaacccccgttaaccggtttaacccggggtttaaccccgggttttaacccggggggaaacccgggggttaacccggggttaaacccgggtaaaggggttaaccgggttaaaccgggtaaacttaaaccggtaaacgggttaacccggttagggttaaaccccggg

SEQ ID NO: 295254 - DNA, 488 bp, Homo sapiens
  misc_feature: GYAE6OF02HIJVX.36.8.A08.1.454.CMB.1.raw
  modified_base (436)..(436): a, c, t, g, unknown or other
  misc_feature (436)..(436): n is a, c, g, or t
tcagtacgctgtctcacgaccggtgctcgatttagcatactctacagggggcgagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtgcagtggatatgggacagatttcactctcaccatcagcagcctgcagcctgaagatgttgactaacttattattgtactaaaagtataaacagtcgccccgntcctacgtttcggcggacggaccaaggtggagatacgaaacgtactgtacgg

SEQ ID NO: 295255 - DNA, 564 bp, Homo sapiens
  misc_feature: GYAE6OF02IYS09.36.8.A08.1.454.CMB.1.raw
tcagtacgctgtctcacgaccggtgctcgatttagcatactctacagggggtcgagaagtctactctcagtcaggacaacagccagtggacatgagggtccctgctcagctcctgggactcctgctgctctggctccagataccagatgtgacatccagatgacccagtttccatccgtccctgtctgcatctggtacggagacagagtcaccatctcttgccgggcaagtccagggcattaacaatctatttaagcctggtatcagcagaaaccagggaaagttcctaagctcctggagtatatgcttgtattcactgtagtcaatcgggggtaccattctcggttcagtgcagtggatagtagggactagaatttcacgttctcaccatctagacagccttgcagtcctagaacgatggttgacctaactttattagttgtacgtaaaagttattaaactagttacgaccccgtacttaccgtacgttttaccgggtaccggtaacgggtaccctaaggggttacggtacggtagtaccaaacggtaccgtacggttaccgg

SEQ ID NO: 295256 - DNA, 345 bp, Homo sapiens
  misc_feature: GYAE6OF02G80B1.36.8.A08.1.454.CMB.1.raw
  modified_base (343)..(345): a, c, t, g, unknown or other
  misc_feature (343)..(345): n is a, c, g, or t
tcagtacgctgtctcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggcgccctgctccaggagcacctccgagagcacagcggccctgggctgcctggtcaaggactacttccagacagcgtactgagcgggctggcaaggcgcatagnnn

SEQ ID NO: 295257 - DNA, 858 bp, Homo sapiens
  misc_feature: GYAE6OF02GZ5MF.36.8.A08.1.454.CMB.1.raw
tcagtacgctgtctcacgaccggtgctcgatttagcatactctactagggggtcggagaagtctctctacaacgtcaggtaccaccagacaatccggacgatgagggtccctgctcagcctcctggggactccgtcgcgtggtcctcttggctcccgagataccagatagtggacactccgacggactaggacccctaggtttccactaccttccctgggtccttggctagtcgtaaggtacggtaggaccgtaggtaggtaccgaccctactccgtcttacgggcccgggtacctaaagggtccgaacggggacccttaacttaaaacctaaacgtttacgtaacttttaacggtcccttaggggttaacttccggtaaggaccgaacgggtaaaaacccggaaccgggggtaaaacggttaaccccgtaaaaagggtccccttaccgtaggtacggttaaggttaaggttacggtaccttaccggttaacttttaccctaaaccgttaggttacggacgtaaaacgttccggggggtaccctacgtaccgttacgtacgtacgttcggaccgtaagtaggtaagttacgtaccgggtactacggtacgtttaccaaacttccctacaaacctaactacgacgactacgtccgtacgccgtacgcccgtagtaaccgtaggtacgttttcgaccgtaaacgtaacgttaacgttacccgtagttaacccgttagtaaccgttaaagtaaccgttaagtaacggttaacggttacggttaccggtttaccggtaccgtaaacgggtaccggaagggttacgggaacgttacggtaaccgtaaacgtaacggttacggg

SEQ ID NO: 295258 - DNA, 485 bp, Homo sapiens
  misc_feature: GYAE6OF02GIDIX.36.8.A08.1.454.CMB.1.raw
  modified_base (383)..(383): a, c, t, g, unknown or other
  misc_feature (383)..(383): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtggcagtggatatgggacagatttcatctcaccatcagcagccttgcagccngagatgttgcaacgttattattagttcaaaagtataaacagtacgcccgctcgactttcggcgagggaccaaggtcggagagtacaacgtaacgtgtacggg

SEQ ID NO: 295259 - DNA, 484 bp, Homo sapiens
  misc_feature: GYAE6OF02G2X1B.36.8.A08.1.454.CMB.1.raw
  modified_base (337)..(337): a, c, t, g, unknown or other
  misc_feature (337)..(337): n is a, c, g, or t
  modified_base (428)..(428): a, c, t, g, unknown or other
  misc_feature (428)..(428): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaaagttcctaagctcctgatatatagctgtattcactgtgcaatcgggggtccatctcggttcagtgcngtggatagtgggacagatttcactctcaccatcagcagcctgcacgccgtagaagatgttgacaactttattattgtacaaaagtataaanagtgcccgctcgtactttcggacggagaccgaagtggagatacaaacgactgtcgg

SEQ ID NO: 295260 - DNA, 489 bp, Homo sapiens
  misc_feature: GYAE6OF02HOCXM.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtgcagtgatatgggacagatttcactctcaccatcagcagcctgcagcctgaagatgttgactaacttattattgtacaaagtataaacagtacgcccgcttacgtactttcggacggaggaccgaaggtggaacgatacgaaacgtacgtgtacgg

SEQ ID NO: 295261 - DNA, 574 bp, Homo sapiens
  misc_feature: GYAE6OF02IJ0L0.36.8.A08.1.454.CMB.1.raw
  modified_base (219)..(219): a, c, t, g, unknown or other
  misc_feature (219)..(219): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagatacctagatgtgactatccagatgacccagtttccatcctcctgtctgcatctgtaggagacagagtcaccatctcttgccggnaagtcaggcattaacaatcatttagcctggtatcagcagaaaccaggaaacgttcctaagctcctgatagtatgctgttattcactgtgcaagtcgggggtcccatcgtcggttcagtgctaggtggatagtgggactagtatttcactctacactaatacagcacgccttgacagtcctagaagtattggttagactaaactttatttaagttagttaaccgaaaaagttaataaaccgtaagttacgtaccccgtacttaccgtaacgttttaccgggacgggtaacgggtaacccgtaaaggggttcggtaacggttaacgttaacgtaaaaccgtacgttaggttaacggg

SEQ ID NO: 295262 - DNA, 520 bp, Homo sapiens
  misc_feature: GYAE6OF02G6GJO.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaagttcctaagctcctgatatatgctgtattcactgtgcaagtcgggggtccagtctcggttcagtggcagtggatagtggacagtatttcactctcaccatcagcagcctgcacgccgtgaagatgttgtactaactttattaattgtactaaaagttataactagtacgccccgtctaccgtacgttttcgggacggtaacgggacccgtaagggtcggaggaacttacggaaacgtacgtggtaacggg

SEQ ID NO: 295263 - DNA, 490 bp, Homo sapiens
  misc_feature: GYAE6OF02IQ1YL.36.8.A08.1.454.CMB.1.raw
  modified_base (307)..(307): a, c, t, g, unknown or other
  misc_feature (307)..(307): n is a, c, g, or t
  modified_base (389)..(389): a, c, t, g, unknown or other
  misc_feature (389)..(389): n is a, c, g, or t
  modified_base (410)..(410): a, c, t, g, unknown or other
  misc_feature (410)..(410): n is a, c, g, or t
  modified_base (425)..(425): a, c, t, g, unknown or other
  misc_feature (425)..(425): n is a, c, g, or t
  modified_base (484)..(484): a, c, t, g, unknown or other
  misc_feature (484)..(484): n is a, c, g, or t
tcagtacgctgtctcacgaccggtgctcgatttagcatactctacagggggcagaagtctctctcagtcaggacacagcatggacatgagggtccctgctcagcccctgggactcctgctgctctggctcccagataccagatgtgacatccagatgacccagtttccatcctccctgtctgcatctgtaggagacagagtcaccatctcttgccgggcaagtcagggcattaacaatcatttagcctggtatcagcagaaaccagggaaagttcctaagctcctgatatatgctgtattcactgtncaagtcgggggtccatctcggttcagtgcagtggatagtgggacagatttcactctcaccatcagcagcctgcagcctgagntgttgctaattattattgtanaaagttatacagtcncccgctctacgttcggacggtacgggaccaaggtggagtacgtacgaaacggacttggngtaccg

SEQ ID NO: 295264 - DNA, 538 bp, Homo sapiens
  misc_feature: GYAE6OF02HBXZJ.36.8.A08.1.454.CMB.1.raw
  modified_base (217)..(217): a, c, t, g, unknown or other
  misc_feature (217)..(217): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcacatctcttgccggnaagtcaggcataacaatcatttagcctggtatcagcagaaaccagggaaagttcctaagctcctgatatatgctgtattcactgtgcaagtcggggtccatctcggttcagtgcagtggatagtgggacagtattcactctacactatacagacacgcctgcacgctagatagtgttcgactaactttattattacgtaactaaaagttaactaaacgtacgtccgtaccccgtacttaccgtacgtttccgggacgggtaaccgggtaaccgtaagggtacggtaacggtacgtaaccgtaaacgtacgtaggtaccggg

SEQ ID NO: 295265 - DNA, 516 bp, Homo sapiens
  misc_feature: GYAE6OF02H6STR.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcacatctcttgccgggcaagtcaggcattaacaatcatttagcctggtatcagcaagaaaccagggaaagttcctaagctcctgatatatgctgtattcactgtgcaagtcgggggtcccatctcggttcagtggcagtggatatgggacagatttcactctacaccatcagcagcctgcagcctgaacgatcgttgactaacttatttattgttaataaaagtataaacagtcgacccgactccgtacgtttccggacgggtacgggaaccgtaagggtaggaacgtagtaaccgaaacggtaccgtggtacgg

SEQ ID NO: 295266 - DNA, 722 bp, Homo sapiens
  misc_feature: GYAE6OF02HDYNS.36.8.A08.1.454.CMB.1.raw
tcagtacgctgtctcacgaccggtgctcgatttagcatactctacgaggggtcgagaagtctctctcgagtcctaggaccacgagtccaagtcggtacattggagggtccctgctcagctcctgggactccgtgctgcctcttgggacttcccggagtataccagtagtttcgttgacatcctagatggacccagtttccatccgtcctgtctgcgagtctgggtaggatacgtagagtccacggtactcgtacgttgccggtctaagtcaggcacttacaagtctattacgtccgtggtatcagcagaaactagggtaacgtcctaagcctccgtaggagtactagtgcgttggtacttctagtgtcgacaagtcgggggtacctagtctacggttctagtggcaggttcgtagtagtgggactagtactttacacgttcctacgactagtaccacgacgacgtccttacgtacgtacgtacccttagaaacgtaattacgggttacgtaaccgttaaacccgttttagttaaccgtttacggttaaccgtaaaaacggtttaagtaaacccgttaagggtttacccgttcccccggtacgtttaccgttacccggttttccgggaccgggggttaacgggtaaccccgttaaaggggttaaccggtaacgggttaccggtaacccggtaaaaccgggtaccgttacgggttaaccccggg

SEQ ID NO: 295267 - DNA, 530 bp, Homo sapiens
  misc_feature: GYAE6OF02IXJGG.36.8.A08.1.454.CMB.1.raw
  modified_base (448)..(448): a, c, t, g, unknown or other
  misc_feature (448)..(448): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcgttcagtggcagtgatagtgggacagtatttcactctcaccatcagcacgcctgcagcctagaagtatgttgactaactttattattagtactaaaaggtaataaacgacgtacgaccccgtnttccgtaactttccgggacgggaacgggtaacccgaagggttacggaagtaacgtaaccgaaacggtacgttaggtaccggg

SEQ ID NO: 295268 - DNA, 613 bp, Homo sapiens
  misc_feature: GYAE6OF02H16VP.36.8.A08.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtcaccatctcttgccggnaagtcaggcattaacaatcatttagcctggtatcagcaagaaaccagggaaagttacctaagctcctgatatatgctgtattcactgtgactaacgtcgggggtccctatcgttcggttacaggtcggcgtaggtggtatagtagggactaggtatttcgacttctacctacctatacagctacgcctcgacagcccgttagaagtattggttagtaccttaaacgtttactttaagtttacgttaaactaaaaggttaactaaaacgtacggttaccgacccccgtacttaccgttaaccgttttccggggaccgggtaaaccgggtaacccggtaacggggttacgggtaacggtaacgttaaccggtaaaacggtaaccggtaggttaccggg

SEQ ID NO: 295269 - DNA, 528 bp, Homo sapiens
  misc_feature: GYAE6OF02G2S4Q.36.8.A08.1.454.CMB.1.raw
  modified_base (218)..(218): a, c, t, g, unknown or other
  misc_feature (218)..(218): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
  modified_base (404)..(404): a, c, t, g, unknown or other
  misc_feature (404)..(404): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccggnaagtcaggcattaacaatcatttagcctggtatcagcagaaaccagggaaagttcctaagctcctgatatatgctgtattcactgtgcaagtcgggggtcccatctcggttcagtggcaggtggatagtgggacaggatttcacttctcaccatcagcagcctgcagcctgaantgttncaacttnttattgtaactaaagttataaacgtagtcgacccgtcttccgtaacgttttccggacgggtaacgggtaacccgaagggttacggaacggtacgttaaccgaaaccggtacgtaggttaccggg

SEQ ID NO: 295270 - DNA, 478 bp, Homo sapiens
  misc_feature: GYAE6OF02GUCQR.36.8.A08.1.454.CMB.1.raw
  modified_base (426)..(426): a, c, t, g, unknown or other
  misc_feature (426)..(426): n is a, c, g, or t
  modified_base (431)..(431): a, c, t, g, unknown or other
  misc_feature (431)..(431): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaaagctcctgatatatgctgtattcactgtgcaatcgggggtcccatctcggttcagtggcaggtggatatgggacagatttcactctcaccatcagcagcctgcagcctgaagatgtgcaactttattattgtacaaagtataacagtncccgntcactttcggcggaggaccgaaggtcggagatcaaacgactgtacgg

SEQ ID NO: 295271 - DNA, 766 bp, Homo sapiens
  misc_feature: GYAE6OF02HO0C6.36.8.A08.1.454.CMB.1.raw
  modified_base (193)..(193): a, c, t, g, unknown or other
  misc_feature (193)..(193): n is a, c, g, or t
  modified_base (217)..(217): a, c, t, g, unknown or other
  misc_feature (217)..(217): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctcctgtctgcatctgtagganacagagtcaccatctcttgccggnaagtcgaggcattaacaatcatttagcctggtatcagacaagaaaccagggaaagttcctaagcctacctgaatatatgcttgtattcactgtgactaacgtccgggggtccctaagttccgttcggttacgtaaggttcggacgtaggtagggtacttaaggtagggggtaacctaaggttacttttacgtaaccttaccttacccgaaccttaactaccgtaacggaccgtaacggtccctacggtaccgtaacggtacccgtttaaggaaacggtacgtttaggtttaccgtaaccgtttaaaaccgtttttaaagttttaacgtttaacggtttaaaaccgttaaaaaacggtttaaacgtaaaaccgttaacggttacccggtacccccccggttaccgtttaacccggttaacccgggtttttacccggggaccgggggtaaaacccggggttaaccccgggtaaaagggggtttaccgggtaaacggtaaaccggtttaaaccccggaaaaaccggttaccggttaacgggttaacccgggg

SEQ ID NO: 295272 - DNA, 495 bp, Homo sapiens
  misc_feature: GYAE6OF02JKAQV.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaagtcgggggtccatctcggttcagtggcagtggatagtgggacagtatttcgactcgtcacatcagcagcctgcacgcctagaagattgttgactaactttattattgtactaaaagtataacagtcgcccgtctctacgtttcggacggacggaccgaaggtggagatacgaacgtactggtacgg

SEQ ID NO: 295273 - DNA, 493 bp, Homo sapiens
  misc_feature: GYAE6OF02GZ04R.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtccatctcggtcagtgctagtggatatgggacagatttcactctcaccatcagcagcctgcagcctgagatgtgctacttattattagtactaaaagtataaacgagtacgcccgtctacgtacgtttcggacggacgggtaccgaagggtcggagatacgaaacgtacgtgtacgg

SEQ ID NO: 295274 - DNA, 524 bp, Homo sapiens
  misc_feature: GYAE6OF02I6MLH.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttcgccgggcaagtcaggcattaacaatcatttagcctggtatcagcagaaaccagggaagttcctaagctcctgatatatgctgtattcactgtgacagtccgggggtccatcgtcggttcagtggcaggtggatagtgggacagtatttcactcgtcaccatcagcacgtcctgccacgccgtagagagttgttcgacttaactttatttagttcgtaacgtaaaacgtaattaaacgagtaccgcccgtctacgtacgttcggacggtacggaccgtaaggtcggagacgtacgaaacgtagtaggtacgg

SEQ ID NO: 295275 - DNA, 601 bp, Homo sapiens
  misc_feature: GYAE6OF02ILKH9.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagagacagagtcacatctcttgccgggcaagtcaggcataacaatcattagcctggtatcagcagaaaccaggaaagttacctaagctacctgatatatgctgtatctactgtgcaagtcggggtcctatctcggttcaggtcgctagtgtagtatgggtacagtatttcgacttctactaccgatcgagcaaggccttgacacgtacctagaagtaacttggttacgtacctaaactttaatttaacgtttacgtaaaccgttaaaagttaaactaaacgtagttacccggaccccgtcttacccgttaacgttttcccgggaacgggttaaccgggaaccccgtaaaggggttaacggtaacgggtaacgttaaacccggaaaaccggttaacggtacggttaaccgggg

SEQ ID NO: 295276 - DNA, 522 bp, Homo sapiens
  misc_feature: GYAE6OF02F2UXI.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagagacagagtcaccatctcttgccgggcaagtcaggcattaacaatcatttagcctggtatcagcagaaaccagggaaagttcctaagctcctgatatatgctgtattcactgtgcaagtcgggggtcccatctcggttcagtcggcagtggatagtgggacagatttcactctacacatcagcagcctgcagcctagaagtatgttgacgtaacttatttaagttagttacaaaaaggttactaaacgtagtacgccccgtctaccgtacgtttaccgggacgggaacggtaaccgaaggtcggaaggtataccgaaacgtacgtgtacgg

SEQ ID NO: 295277 - DNA, 772 bp, Homo sapiens
  misc_feature: GYAE6OF02GHF0A.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgcatctgtaggagacagagtcaccatctcttgccggcaagtcgaggcattaacaatcattagcctggtatcagcaagaaaccagggaaacgttcctaacgtctcctgactatatagcttagtattctactagtcggactaagtaccgggggtccccgtactccgttcgggtttcgtaggtacgggtcgacggttggtacgtagttagggtacgaagtagtttacctacgttccgttacctaacccgtaacttacgaaccggtaccgaaccggtcccgtttacggacccgttaacgtccccggttaacgaaaacgggttaactttacgggttttaccggtaacctttaaacccgttttaaaccgtttttaaagttttacgtttaaaccgttaaaaaacggtttaaacgtttaaacccgttaagggttacccgttaccccccggtaacccgttaccggtttaacccgtttttaccggggggtaacccggggtaaaccggggggttaacccccgtaaagggggttacgggggtaaacggttaaccgttaaacccggtaaaacccgggttaaccgttacccgggtttaacgggg

SEQ ID NO: 295278 - DNA, 546 bp, Homo sapiens
  misc_feature: GYAE6OF02IN8Y8.36.8.A08.1.454.CMB.1.raw
  modified_base (219)..(219): a, c, t, g, unknown or other
  misc_feature (219)..(219): n is a, c, g, or t
  modified_base (371)..(371): a, c, t, g, unknown or other
  misc_feature (371)..(371): n is a, c, g, or t
  modified_base (392)..(392): a, c, t, g, unknown or other
  misc_feature (392)..(392): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcctcttgccggnaagtcgaggcattaacaatcatttagcctggtatcagcagaaaccagggaaagttcctaagctcctgatatatgctgtattcactgtgcagtcggggtccatctcgtcagtgcagtggatagtgggacagtatttcacgtctcacctatcancgacgcctgcagcctgaacgngttagttcgactaacgtttattagtttagttactaaaagtaacttaaacgtacgtacgtccccgtcgttaccgtacgtttaccgggacgggtaacgggtacccgtaaagggtacgggaacgtagtaccgaaaaccggtaccgtaggttaccggg

SEQ ID NO: 295279 - DNA, 522 bp, Homo sapiens
  misc_feature: GYAE6OF02FZIK1.36.8.A08.1.454.CMB.1.raw
  modified_base (397)..(397): a, c, t, g, unknown or other
  misc_feature (397)..(397): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttggccgggcaagtcaggcattaacaatcatttagcctggtatcagcagaaaccagggaagttcctaagctcctgatatatgctgtattcatgtgcaagtcgggggtccagtctcggttcaggtggcgaggtggatagtgggacagtatttcactctcaccatcagcagcctgcacgcctagaagtntgttcgactaactttattagttagtaactaaaagtataacgtacgtcgccccgtactctaacggtttccggacgggtaacggtaccgaagggtcggacgtacgtaacgaaacgtacgtggtacgg

SEQ ID NO: 295280 - DNA, 494 bp, Homo sapiens
  misc_feature: GYAE6OF02FZ7TR.36.8.A08.1.454.CMB.1.raw
  modified_base (387)..(387): a, c, t, g, unknown or other
  misc_feature (387)..(387): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaccagggaagttcctaagctcctgatatatgctgtattcactgtgcaatcgggggtccagtctcggttcagtggcagtggatagtgggacagatttcgactctcacatcagcagcctgcagcctgaanatgtgactaacttattattgtactaaaagtataaacagtcgccccgctctactttcggacggtacgggaccaagggtcggaacgagtaccaaacggtacgtgtacgg

SEQ ID NO: 295281 - DNA, 533 bp, Homo sapiens
  misc_feature: GYAE6OF02I9NR6.36.8.A08.1.454.CMB.1.raw
  modified_base (305)..(305): a, c, t, g, unknown or other
  misc_feature (305)..(305): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccggcaagtcaggcattaacaatcatttagcctgtatcagcagaaaccagggaaagttcctaagctcctgactatatgctgtattcactgtncagtcggggtcccatctcggttcagtgcagtggatagtgggactagatttcactctcaccatcagcagcctgcagccgtgaagtatgttgactactttattattgtaactaaagttaataaaccgtagtaccgccccgtactaccgtacgtttaccggacggggtaacgggacccgtaagggtacgggaagtaaccgtaacgtaaaccggtaacgtaggttaaccggg

SEQ ID NO: 295282 - DNA, 715 bp, Homo sapiens
  misc_feature: GYAE6OF02JT91H.36.8.A08.1.454.CMB.1.raw
  modified_base (196)..(196): a, c, t, g, unknown or other
  misc_feature (196)..(196): n is a, c, g, or t
tcagtacgctgtctcacgaccggtgctcgatttagcatactctacaggggcgagaagtctctctcagtcaggacacagcatggacatgagggtccctgctcagctcctgggactcctgctgctctggctcccagataccagatgtgacatccagatgacccagtttccatcctcccgtgtctgacatcgtgtaggngacagagtcacattctcgttcggaccgggcaagtccgaggcattaacaatcatttagccgtaggtatcagcagaaaccagggaagtacctaagactcctacgatatatgctagtattacactgtagctaagtccgggggtcctaatcgtttcggtctaggttcggacgtaggttacggatacggttagggaccgtagtacgttttcaaacttcctacaacctatctacggcctacgccgttacgacacggtcccgtagaaacggtagtttacgggttcgtacctaaaccggtttttaagtttaacgtttacggtttaaacccgttaaaaagtttaaccgttaaaacggtaacggttacccggtacccccgttcgttaacccgttaacccgggttttttaccggggaaccggggtaaacccggggtaaaccggttaaacggggttaaccgggggtaacggttaacccggttaaacccgggtaaaaccggttaaaccggttaccggggtttaaacccgggg

SEQ ID NO: 295283 - DNA, 590 bp, Homo sapiens
  misc_feature: GYAE6OF02J1WK5.36.8.A08.1.454.CMB.1.raw
  modified_base (220)..(220): a, c, t, g, unknown or other
  misc_feature (220)..(220): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagacgtcaccatcctcttgccggnaagtcaggcataacatctattacgcctggtatacacgacaacgaaaccgaggaacgttacctaagtctaccgtagtactatactgtactagtacttctactgtagacgtaacgtccggggtaccctagttccgtacggttcgacgtcggtacgtacgtaggtacgtagtcggtacaggttacttacgtacgtctacgacctatcgacgactagtaccgtgactacgtcctagatagttacgttagaaccttagtattacgttagtaactaaagtactaacgtcgttaccgacctcgtaccgtccggtttaccggacggtaccggtaacgtaggtacgacgtaacgtaaccgtaacgacgttaggtaccgg

SEQ ID NO: 295284 - DNA, 852 bp, Homo sapiens
  misc_feature: GYAE6OF02JARMC.36.8.A08.1.454.CMB.1.raw
tcagtacgctgtctcacgaccggtgctcgatttagcatactctacgagggggcagaagtctctctcagtcaggacacagcatggacatgagggtccctgctcagctcctgggactcctgctgctctggctcccagataccagatgtgacatccagatgaccctagtttccatcctcctgtctgcatctgtagagacagagtcaccatcctcgttgccggacaaggtcgaggcattaacaatctatttagcctagtactcagcaacgaaaccgaagggtaaacgttccgtaaagtcctcctagtaacttaatattacgtacttaggttacttctaacgtcgtagacgtaaacgggtcccggggttacctaacgttccgtttcgggttacgtaacggttcggacgttaggtacggtacgttaacggtacgggtaacgtaaggttactttaccggtaacctttaccgtaaccgtaccctaaagttacccgtaaacggtacccgtaacggtacccgttacggtaacccgtacggtaaccccggttaaggtaaaacggtacggtttaacggtttaccgggtaaaaccctttaactttttaaaacgttttaacgtttttaaacggtttaaacccgttaaaaaaggtttaacgttaaaacccggtaacggttaccccgggttaccccccgtttaaccggtttaccccggttaaacccgggtttttaaccggggaaccccgggggtttaaaaccggggtaaaccgggttaaacgggggtttaaaccggggttaacgttaaaacccgggttaaacccgttaaaaacccggggttaaccgtttaacccggggttaacccggg

SEQ ID NO: 295285 - DNA, 652 bp, Homo sapiens
  misc_feature: GYAE6OF02HOZXP.36.8.A08.1.454.CMB.1.raw
  modified_base (254)..(254): a, c, t, g, unknown or other
  misc_feature (254)..(254): n is a, c, g, or t
  modified_base (519)..(519): a, c, t, g, unknown or other
  misc_feature (519)..(519): n is a, c, g, or t
  modified_base (528)..(528): a, c, t, g, unknown or other
  misc_feature (528)..(528): n is a, c, g, or t
  modified_base (567)..(567): a, c, t, g, unknown or other
  misc_feature (567)..(567): n is a, c, g, or t
  modified_base (621)..(621): a, c, t, g, unknown or other
  misc_feature (621)..(621): n is a, c, g, or t
tcagtacgctgtctcacgaccggtgctcgatttagcatactctacaggggcgagaagtctctctcagtcaggacacagcatggacatgagggtccctgctcagctcctgggactcctgctgctctggctcccagataccagatgtgacatccagatcgaccctagtttcccatcctcccgtgtctgcaatctgaggagacagtacgtcaaccatcgtcgttacgccgggacaagtccagggctaattaacaatnatttaggcctggtaatcaggacaacgtaaaccgaacggggaaagtttacctaagaccttaccagtataacttatagtcgttagtattacctaatgtgaccgtaggtaccgggggtacccattcgtcggtacgtagttggacgagttaggagtagtagggtacgatagttttaccaactttctaccggaaccttagtacgacgaccgacgtacccttagggaccaacggttccagtaaaggtaatccgttaaggtacaaccttttntaaagtttnaaagtaaacgtaataaaccgtaacgttgaacccccgttntaccgttaaccgtttaccgggcggaacccgggtaaactaggggttaccggtaanacgttaaccgaaaacttacggtagtaaccgg

SEQ ID NO: 295286 - DNA, 574 bp, Homo sapiens
  misc_feature: GYAE6OF02GM2VC.36.8.A08.1.454.CMB.1.raw
  modified_base (219)..(219): a, c, t, g, unknown or other
  misc_feature (219)..(219): n is a, c, g, or t
  modified_base (333)..(333): a, c, t, g, unknown or other
  misc_feature (333)..(333): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttggccggnaagtcgaggcattaacaatcattagcctggtatcagcaagaaaccaggaaagttcctaagctacctgatatatgactgtattcactgtgcaagtcggggtccatctcgttcagngcagtgtatagtgggacagtactttcactcgtacacatcacgcacgtcctgacgcgtcctagaagtacgtggttacgaccttaaactttagtttaagttacgtaaactaaacgttaaactaacgtagtccgtacccccgtacgttaccgttaaccggtttaccgggaaccgggtaccggtaacggtaacgggttacggtaacggtaaccgtaacggtaaaccggtaacgtacggtaccggg

SEQ ID NO: 295287 - DNA, 500 bp, Homo sapiens
  misc_feature: GYAE6OF02HMFQX.36.8.A08.1.454.CMB.1.raw
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagagacagagtcaccatctcttgccggcaagtcaggcattaacaatcatttagcctggtatcagcaagaaaccagggaaagtctaaagctcctgatatatgctgtattcatgtncaagtcgggggtccatctcggttcagtgctagngtatagtgganagatttnactctcactatcagcagcctgcagcctagaagtactgttgactaactttattaattagtacttaaaagtaataacagtacgccccgctacgtacgttcggacggaacggaccgaaggtcggaagactaacaacgaacgtggtacgg

SEQ ID NO: 295288 - DNA, 625 bp, Homo sapiens
  misc_feature: GYAE6OF02HQSVU.36.8.A08.1.454.CMB.1.raw
  modified_base (518)..(518): a, c, t, g, unknown or other
  misc_feature (518)..(518): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctcctgtctgcatctggtaggagacagagtcacatcctcgttggccgggcaagtcgagggcaattaacaatctaatttagccttggtatcagcaagaaaccagggaaacgttacctaaggcctacctcgatatatgctagtattcactgtagactaacgtccggggtacccagttcgtcggttacgagtggacgtagtggtagtagtggggactagtactttacgacttccgtaccacccgtatacgagtaccgaggtccctagaccgacggtacctaggaaacggttacgtaggtttacgtacgttaaagtttactttaagtttacgtaaataaaacggtttaanaaaccgtagtacccgaccccgtactttaccggtaacgtttaccggggaccggaacgggtaaccgaagggtacgggaagtaacgtaccgaaacggtacgtaggtacgg

SEQ ID NO: 295289 - DNA, 546 bp, Homo sapiens
  misc_feature: GYAE6OF02G8JD9.36.8.A08.1.454.CMB.1.raw
  modified_base (221)..(221): a, c, t, g, unknown or other
  misc_feature (221)..(221): n is a, c, g, or t
  modified_base (366)..(366): a, c, t, g, unknown or other
  misc_feature (366)..(366): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttcgccggganaagtcgaggcataacaatcattagcctggtatcagacaagaaaccgaagggtaaacgttcctaagtctacctagatatatgctagtattcactgtgcagtcggggtccagtcgtcggttctagtggctaggtggactagtgggangtattcactcncaccatcagcacncctgcacgctagagntgtcgtactactttagttattagtaactaaagtaactaacgtacgtccgtacccgacttaccgtacggttaccggtacgggtaacgggtaaccgtaaggggtaggtaacgtacgtacggaaaccgtacgtaggttaaccgg

SEQ ID NO: 295290 - DNA, 357 bp, Homo sapiens
  misc_feature: GYAE6OF02FIJQO.36.8.A08.1.454.CMB.1.raw
  modified_base (338)..(338): a, c, t, g, unknown or other
  misc_feature (338)..(338): n is a, c, g, or t
  modified_base (344)..(357): a, c, t, g, unknown or other
  misc_feature (344)..(357): n is a, c, g, or t
tcagtacgctgtctcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatcggtcttccccctggccgccctgcctccaggagccacctccgagagcacagcggccctgggctgcctggtcaaggctacttcagacagcgtactgagcgggctggcaaggcncatagnnnnnnnnnnnnnn

SEQ ID NO: 295291 - DNA, 862 bp, Homo sapiens
  misc_feature: GYAE6OF02FGWNM.36.8.A08.1.454.CMB.1.raw
  modified_base (199)..(199): a, c, t, g, unknown or other
  misc_feature (199)..(199): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccccagtttccatcctccctgtctgcatctgtaggacgacngagtccaccatctcttaggccgggtcaagtcaggcattaacatctattagcctggtatcagcagaaccgaggaacgttctaagctacctgattactatcgtctacgttaacttcaactggttcgacgtaaacgttcccggggggtccctaacgtttccgtacgggttttaccgacggttacgggtacgtaacggttacgggtaacgtttaacggtacggggggtaaccctaacgggtttaaaccttttaccgtaccccgtttaccgtttaacccaaaccccgttaacgtacccgttaaaccggacccgtaaccggtaccccggttacggaaccccgtaaacgggtacccccggttaaagggtaaaccgggtttaacgttttaaccggggttttaacggaacccgttttaaaacccttttttaaagttttttaaacccggtttaaagggttttaaaacccaaaaacggtttaaaaccgttaaaccggtaccgggtttaccccgttacccccggtacctttacccgggttaaacccgggttttacccgggggttaacccgggggaaaccggggttttaaaccccggaaggggtttaacccggggtaacggtaaacccgtttaacccggtaaaaccggtaaaccgggtttccgggttaacccgggg

SEQ ID NO: 295292 - DNA, 563 bp, Homo sapiens
  misc_feature: GYAE6OF02G2TCD.36.8.A08.1.454.CMB.1.raw
  modified_base (366)..(366): a, c, t, g, unknown or other
  misc_feature (366)..(366): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagactagagtcaccatcctcgtcggccgggcaagtcgaggcattaacaatcatttagcctggtatcagcaaggaaaccagggtaaacgttcctaaggctcctagactatatgctgtatcatgtgacagtccggggtccatcgtcggttcaggtgctaggtggtatagtcggganagtactttcacgttctcgacctatcgacgccacgtcctgccacgtccgtagaagtgtgttacgactaactttagttattaacgtactaaaagtactaacgtacgtcgtccccgattaccgtaacggtttacgggaccgggtaacggaaccggtaacgggtaggacgttaacgaacgtaaaccggtagtaggtaccgg

SEQ ID NO: 295293 - DNA, 513 bp, Homo sapiens
  misc_feature: GYAE6OF02F274D.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaagtcgggggtcccatctcgttcagtggcagtggatagtgggacagtactttcactctccaccatcagcacgcctgcagccgtgaagattgttgactaactttattaattgtaactaaaagtataacagtacgtcccgctccgtacgttccgggcggtaacgggaccgtaagggtacggaagtactacgaaacgacgttggtacgg

SEQ ID NO: 295294 - DNA, 684 bp, Homo sapiens
  misc_feature: GYAE6OF02JOWNS.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctccagataccagatgtgacatccagatgacccagtttccatcctcctgtctgctatctgtagagactagatcacatctcgttcggccggtacaagtcgaggacaattaacatcatttagccgtaggtatcagacaacgaaacgaagggaacgttacctaacgtactccgtagtaactactatgtcttagttattctacgttgtcgtacgtaacgttccgggggtacctaacgttcgttacggttctaggttacggtacgaggttaggtataaggtacgggaacgtagttaacgtttacctaacttccttaccgtacctattacgacgtacaacgtccgtacgtaccgtacgtaccgtaagaacgtttagtacggtttaggtaccttaaacgtttaacgttaagtttacgttaaacgtaaacgttaacgttaaacgtacgttaccggacccttacgtaaccggttaccggttaaccggttaccggggtaaccggtaaacggtaacgggtaacgggtaacgtaacggtaacctaaaccgggtacttacgggttaccgg

SEQ ID NO: 295295 - DNA, 724 bp, Homo sapiens
  misc_feature: GYAE6OF02GO0TF.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttccatccctccctgtcctgctatctagtaggacacagacgtcaccattcctcgttggcccgggactaaggtccgagggtacaattaaccaattctaagtttaacgcccgttaggtactcgtacgacgaacggaaaaccgaaaggggttaaaccgttaccgtaagtccgttacctaggtaacttatacgtcgtactttagttaacttccacgttggtacgaccggtaacggttcccggggtacctaagttccggtttacggttacgtacgggtcggaacgtacgggttaggtagttacgtacggggacttaacggtacttttaccgacttccgtaaccctaacgtacttaccgacggtcctaacgtccgttacgcgtaacgttccgaagtaaccgttaggttacgttacgtacctttaaagttttacgtttaagttaacgttaaaacgtaacgtttaaacgtaacctacgggtccctacccgtactttaccggtaccggttcggacgggtaacgggacgtagggacgacgtaaccgtaaccaacggtataggtacgg

SEQ ID NO: 295296 - DNA, 709 bp, Homo sapiens
  misc_feature: GYAE6OF02FXV0H.36.8.A08.1.454.CMB.1.raw
  modified_base (219)..(219): a, c, t, g, unknown or other
  misc_feature (219)..(219): n is a, c, g, or t
  modified_base (293)..(293): a, c, t, g, unknown or other
  misc_feature (293)..(293): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtagagacagagtcaccatctcttggccgganaagtcgaggcattaacatctattagcctgtatcagcaagaacgaggtaacgttacctaagcctcgtagtatatntgtctagttattctactgtgacgaaggtccggggtccctagttccgtcggttacgaggtcggtacgtaggtacgggtagttacggtacgggtacgtaggttacttttaccgaaccttcctacccgtaaccgtacttaccggaacgtacgaccgtacccgttaccggtaccgtaacgttcccgtaggtaaacggttacgtttacggttacggtacccttaaacgttttacttttaacgtttaacgttaaacgttaaaaacggttaaacgtttaaacgttaaccggttcccgtacccccgttaaccgtacccggtttaaccggtttacccgggaacccggggtaacggggtaacccggtaaggggtacggtaacggttaaaccgtaaccggttaaacccgtacggttagggtaccggg

SEQ ID NO: 295297 - DNA, 532 bp, Homo sapiens
  misc_feature: GYAE6OF02IIJXV.36.8.A08.1.454.CMB.1.raw
  modified_base (341)..(341): a, c, t, g, unknown or other
  misc_feature (341)..(341): n is a, c, g, or t
  modified_base (351)..(351): a, c, t, g, unknown or other
  misc_feature (351)..(351): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccaggtgccagatgtgccatccaaatgacccagtctccatcctcctgtctgcatctgtaggagacagagtcatcatcacgttgccggcaagtcagggcattagaaatgattaggctggtatcagacagaaaccagggaaacgcccctaagcctcctcatctatggtgcatcctagttacaaactcggggtacctaattaagattcagcggnagtggatcgngcacgagtatttacactctaccaccatcagcaagcctgctagcctagaagtattttgactaacttacttactgttactaacaagtacttaactactttaccctacgttaccgttaccggaccgtaacgggaccgtaaggtacggtaaagtacaaacggtactaggtacgacgtgtaacccg

SEQ ID NO: 295298 - DNA, 707 bp, Homo sapiens
  misc_feature: GYAE6OF02HEMZK.36.8.A08.1.454.CMB.1.raw
  modified_base (238)..(238): a, c, t, g, unknown or other
  misc_feature (238)..(238): n is a, c, g, or t
  modified_base (471)..(471): a, c, t, g, unknown or other
  misc_feature (471)..(471): n is a, c, g, or t
tcagtacgctgtctcacgaccggtgctcgatttagcatactctacagggggcagaagtctctctcagtcaggacacagcatggacatgagggtccctgctcagctcctgggactcctgctgctcgtggcctcccagataccagatgtgacatccagatgacccctagtttccactcctcccgtgtctgacagtctaggaggagacagacgtaccaccattctcgttacggccgggtanaagcgaacggacattaaacaatctaatttacgcctaggtatacgagaacaacggaaaccgtaagggtaaacttaccgaacgtcctaccgttataacttaatacgttaggcttaagttacttaccaacggttgttcggaacgaacggggtttcccgggggacctacgttccggttacggtcgaaggtcggcgtaaggtcgtaaagtgtacggggactagtagtttacacttacnccgtactactacgacacgacgtaccttcgaccgcgtaccgttagaacgagtttacgacggttaacctactttaagttagtttaacgtaacgttaaaagaagtaaaccgtacggttacccgtcccgtacgtttacccgtacgggttttacccgggaacggggtaaccggtaaaccgggtaacggttacgggtaacgtaaacggttaaccgaaaaccggttacggtacggtaaccggg

SEQ ID NO: 295299 - DNA, 590 bp, Homo sapiens
  misc_feature: GYAE6OF02GAV07.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccggcaagtcaggcattaacaatcatttagcctggtatcagcaagaaaccagggaaacgttcctaagcctcctgatatatgctgtattcactgtgcgaagtccgggggtaccacgttcgttcggttcaggtggacgtaggtggagtagtagggactaggtatttcacttcgtacacctatcgtagccacgtcctgacacgtccgtagagtagttcgttagacttaactttatttaagttacgttaacgtaaaaagttactaaacgtacgtaccgtacccgtacttaccgtaacggtttaccgggacgggtaacgggtaaccggtaagggtacggtaacggtaaccgtaacgtaaacccggtaagttcggtaaccggg

SEQ ID NO: 295300 - DNA, 777 bp, Homo sapiens
  misc_feature: GYAE6OF02JJ0Z9.36.8.A08.1.454.CMB.1.raw
  modified_base (414)..(414): a, c, t, g, unknown or other
  misc_feature (414)..(414): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctccagactaccagatgtcgacactccagatcgaccctagtttccactccctccgtgtctcgctatcgtggtaggagacagacgtccactatccgtcgtcggccggactagtcgaggctaactaaacatcgtaattcgccgtgtactacgagtaccgaacgaaaccggtaacgggttaaacgttacctaacgtccgtaccgtagtaacttagtagtgtaccttagttacttactcgttagtacgtacggtaacggtccggggtaccctagttcggttccgttacgnggtcgacgtaggtacgtagtaggtacgagtacgtactttaccacgttaccctacgaacctacgtacgacgtaccgtacgccggttacacccgtacgtaccgtaaggtaacgtcggttacgttaacccgtaactttaacgttttaagtttaaccggtttaacgtaaaaccgttaaaacggttaaccgtaaaccggtttacggttaacccccgtacccgggttacccttacccggggttttaaccgggttacccgggggaacggggttaaacccggggtaaccggttaaaccgggggttaacggtaaccggttaaaccggtaaaacccgggttaacccgggttacggttacccgggttaaccggg

SEQ ID NO: 295301 - DNA, 893 bp, Homo sapiens
  misc_feature: GYAE6OF02GC9T3.36.8.A08.1.454.CMB.1.raw
  modified_base (92)..(92): a, c, t, g, unknown or other
  misc_feature (92)..(92): n is a, c, g, or t
  modified_base (147)..(147): a, c, t, g, unknown or other
  misc_feature (147)..(147): n is a, c, g, or t
  modified_base (240)..(240): a, c, t, g, unknown or other
  misc_feature (240)..(240): n is a, c, g, or t
tcagtacgctgtctcacgaccggtgctcgatttagcatactctacagggggcagaagtctctctcagtcaggacacagcatggacatgagtntccctgctcagctcctgggactcctgctgctctggcctccagactaccagatgtnacatccagatcgaccctagttccacttccctccctgtctgctattcgtaggtaggacgacaggactaccacctattctcgttcgggaccgganacggtcgacggactaacttaactacttacttagtttacgcgtagtatcgagaacgaaacgaaacgtaagggtaacttacgacgtcctacgtataacttagtacgttcgtagtttacgttaccttaccgtaggttcgtaaccggtaccggttaaccggggttaccccgggttaccttaccggttttaccggttacgggttaccggtaagggttaccggtaaggttacgggttaaacgggtacgttaaagggtaccgggttaacgtttaaccgtttaacccgtttaacccggtacctttaaaccccgtacccgttaaacccgtacggttaaacccggccgtaacccggtaccggttccccggtaaacgtacccggttaacccggggttaggtttaaaccctttaaagggtttaccgttttaacttaaaccgttttaacggttttaaacttttaaccgtttaacgtttaaacggtaaaactttaaaaccggtttaccgttaaccgtacccccgggtacctttacccggttaaccggtttaccgggggttaacccggggtttaccgggaaaccgggttaccggggaaaccggttaacggggttaaccgttaaccggtaaacccgggttaacgttaaccgggtcggtttaacccgggg

SEQ ID NO: 295302 - DNA, 706 bp, Homo sapiens
  misc_feature: GYAE6OF02I0UDH.36.8.A08.1.454.CMB.1.raw
  modified_base (194)..(194): a, c, t, g, unknown or other
  misc_feature (194)..(194): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctcctgtctgcatctgtagganacagagtcacatctcgttgccggacagtcgaggcaattaacaatactattaacgcgtggtatcagacaagaaacgtaagggtaacttaccaagtctacctagactatatcgcttagtactactacgtgtacgtacgtaacggtccggggtacctagttcgttccggttacgaggtcggtaacgtacggtaggtaagttacggtacgggtaacgtacgttaacgtttaccgtaccgttacctaccgtaacccgttaataccgtaacgaccgtaaccgtccgttacgtaccgacggtacccgtaggtaaattcggttagttaccggtaactttaaccgtttaagttaacgttacgttaaaacttaaaagttaaacgtaaccgttacgtacccggtaccccgttacgttaacccggttcgggttaaccgggacggggtaaaccgggtaaccggtaaacggggttcggtaaaccgaacggtttaaacccgaaaacggttaccggttacggtaccgg

SEQ ID NO: 295303 - DNA, 699 bp, Homo sapiens
  misc_feature: GYAE6OF02G6KT1.36.8.A08.1.454.CMB.1.raw
  modified_base (198)..(198): a, c, t, g, unknown or other
  misc_feature (198)..(198): n is a, c, g, or t
  modified_base (221)..(221): a, c, t, g, unknown or other
  misc_feature (221)..(221): n is a, c, g, or t
  modified_base (247)..(247): a, c, t, g, unknown or other
  misc_feature (247)..(247): n is a, c, g, or t
  modified_base (254)..(254): a, c, t, g, unknown or other
  misc_feature (254)..(254): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
  modified_base (343)..(343): a, c, t, g, unknown or other
  misc_feature (343)..(343): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatgaccctagtttccatccctcccgtgtctgcatctgtagganacagactcacatctcgtgccggnagtcgaggactataacatctattacncctgtancagacaagaaaccgagggtaacttactaacgcctaccgtanatatagtgtctntatacgtacttgtgtacgtaacggtccggggtaccncgttaccgttcgttcgtaggtcggtagtacggtaggtacgtaggtacgggtaactacgtaagttttaccctaccgttacctaccgaacctacgtacctaacgacggtacgtacccgttacgcgtaaccggtccgtaacggtaacgttacgtttacgggttccgtaaacgtttaacccgtttaaagtttacgttaaacgttaaacgttaaaaacggtttaacgttaaaccggtacggttaccccgtaccccgttaccgttacccggttaaccggttacccgggaacggggtaaccggtaaaccggtagggtaacgtaacgtaacgtaacccggtaaacgtacggtacggtaaccggg

SEQ ID NO: 295304 - DNA, 724 bp, Homo sapiens
  misc_feature: GYAE6OF02H526X.36.8.A08.1.454.CMB.1.raw
tcagtacgctgtctcacgaccggtgctcgatttagcatactctacagggggcagaagtctctctcagtcaggacacagcatggacatgaggtccctgctcagctcctgggactcctgctgctctggctcccagataccagatgtagacatccagatcgaccctagtttaccattccctccctgtcctgcattctgtaggagacagtacgtacacattctcgtcggccggcaagtcgaaggtctaattaacaatactagtttacgccgttaggtactacacgacgaaacggaaaaccggaagggtaaacgttaccgtaacgtccttaccgtacggtataacgttatgtactgttacttactacgtgtcgacgtaacggttaccggggtaccctacgttaccggttacgttacgtagggtcgtacgtaggttggtagtagtacgggtactacgtactttactaccttacgtacctaactactaccgagtccgtacgttcctacgacaccgtacgtagtaacgtacgttcgttaacgaaccttaagttttaacgttacgttaacgttaaacgttaaaacgttaaacgtaaaccgtacggttacccgtaccccggttacttaccggttaaccggttttaaccggggacccggggtaaaccggttaccggtaagggttaccggaacggttaaccggaacggtaaaccgttacggtacgggttacccggg

SEQ ID NO: 295305 - DNA, 762 bp, Homo sapiens
  misc_feature: GYAE6OF02J3N3Y.36.8.A08.1.454.CMB.1.raw
  modified_base (270)..(270): a, c, t, g, unknown or other
  misc_feature (270)..(270): n is a, c, g, or t
  modified_base (730)..(730): a, c, t, g, unknown or other
  misc_feature (730)..(730): n is a, c, g, or t
tcagtacgctgtctcacgaccggtgctcgatttagcatactctacagggggcagaagtctctctcagtcaggacacagcatggacatgagggtccctgctcagctccgtgggacctcctgctcgctcgtcggcctccagactaccagtatcggacacactccagtactcgaccctagttccactccctccgtgtctgctactcgtaggagacgacagactccactctcgtacgtacggccggactaacggtcgacggtaactaattaacncttacgtacgtttacgaccgttagtacgacgaacgaaccgtaaacgtaaccggtaaggttaccgtacctaacgtcgttacgtataattacgtacgtcttacggttacttacgttacgacgtaggtacccgaacggttacccggggttcccggtacctaggtttcccgggtacgttaacgggtacgttacggtaacggtagggtacgtaacggttacggtacggtaaaccttacggttacctttacccggaacccttaccgaacccgtaacgtccgaacgttacggaccgtaccgtaccggacgacgttacgtaccgtaaagtccgttaacgttacgtaaccttaacgttaattttaaccgtaagttaaccgaaaagttaccgttacgacccgttacgtcccgtacgtacccgttacgtccgggttacgaaccgggtaacggtaccgtaaggtacgttaanaccgttaaccgaaacggttcggtaccgtacgg

SEQ ID NO: 295306 - DNA, 704 bp, Homo sapiens
  misc_feature: GYAE6OF02FXB3C.36.8.A08.1.454.CMB.1.raw
  modified_base (197)..(197): a, c, t, g, unknown or other
  misc_feature (197)..(197): n is a, c, g, or t
tcagtacgctgtctcacgaccggtgctcgatttagcatactctacagggggcagaagtctctctcagtcaggacacagcatggacatgagggtccctgctcagctcctgggactcctgactgctctggctcccagataccagatgtgacatccagatgacccagtttccatcctccctgtcctgcatcgtgtagganacagagtcaccatctctcggccgggcaagtcagggcataacaatcattagcctgtatcagcaagaaccgagggtaacgttacaagctcctagatatatgtcttgtacttacacgtgtcgacgtaacggtccgggggtaccctacgttccgtttacggttacgtacggtcgggacgtaggtggtaataggtacgggactagttactttaccgtactaccgtaccaacccgtacgttaccgaaggtccgacgtcccgttacgaccgtacgtacccgtaggaaacggttacgttaacggtttacgtaacctttaaccgttttaagtttaaacgtttaacgttaaacgttaaaaacgttacgttaaacgtaccggttaccggccccgttacgttacccgtttaacccggtttcggggaacccgggttaacgggtaaaccggttaacgggggttacgtaacggtaaccgttaaaccccggtaaacggttaacccggttagggttaacccggg

SEQ ID NO: 295307 - DNA, 735 bp, Homo sapiens
  misc_feature: GYAE6OF02IC8GD.36.8.A08.1.454.CMB.1.raw
  modified_base (232)..(232): a, c, t, g, unknown or other
  misc_feature (232)..(232): n is a, c, g, or t
  modified_base (445)..(445): a, c, t, g, unknown or other
  misc_feature (445)..(445): n is a, c, g, or t
tcagtacgctgtctcacgaccggtgctcgatttagcatactctacaggggcagaagtctctctcagtcaggacacagcatggacatgagggtccctgctcagctcctgggactcctgctgctctggcctcccgagataccagatgtgacatccagatcgaccctagtttccatccctcctgtctgactatctgtaggacacaggactcaccattctcgttacggcccggganaacggttcgaggactaacttaacaactctatttacgccgttaggtactacgacgacaacgaaaccgaggtaaacgttacctaacgtctacctagtaactagtaactgtacgttgttactacctacgtgtacgtaacgaaccggttccggggtaccctattaccggttcggttacgaacggtcggtacgtaggttacggagttagtacgggtanacggttatttacaccgttacgtaccaccgtataccgtacgacgtaccgtccgttacgaccgaacgttcccgtaagtaaacggtaccgtttgttacccgtaagttaaacctttaacgttttaacgttaaccggttaaaccgttaaaaaggttaacgttaaaccgaacggtttccccgtaccccgttagtttaccccgttaacgggttcgggtaacccgggtaacggtaaccgggtaacggggtactaacggtaaccgttaaacccggaaacggtaccgttacgggtaccgg

SEQ ID NO: 295308 - DNA, 724 bp, Homo sapiens
  misc_feature: GYAE6OF02H0YN5.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggcctcccagactaccagtatgtgacatccagatcgaccctagtttccactccctcctgtctgctatcgtaggtaggagacagacgtaccacctacttctcgttcggccgggacaacggtcgagggtacctaattaacaacttactatttacgccttaggtactcgacgacaacggaaaccgaagggtaaacgtacctaacgctcctagtattatagtgtacttgttactactacgtggtacgacgtaacgggttccggggtaccctagttccggttaggttacgagggtcgtacggtaggtacggtagtagggtacgggaactaggttactttaccaccgtttacccgtacctacctacgtccacggacgtacgtccgttcgacgtacgtacccgtaaggtaacgttcgttcggttaacctactttaacgttttacgtttaagttaaccgtaaaagttaaacgttaaacgtaaccgttagttacccgtaccgtaccgttaccgttaccggttacccgggtttacggggaacccgggttaacgggaacgggttagggtaacggtaaacttaacggtaaccgtaacggtacgttaccggg

SEQ ID NO: 295309 - DNA, 687 bp, Homo sapiens
  misc_feature: GYAE6OF02H2TH0.36.8.A08.1.454.CMB.1.raw
  modified_base (198)..(198): a, c, t, g, unknown or other
  misc_feature (198)..(198): n is a, c, g, or t
  modified_base (235)..(235): a, c, t, g, unknown or other
  misc_feature (235)..(235): n is a, c, g, or t
tcagtacgctgtctcacgaccggtgctcgatttagcatactctacagggggcagaagtctctctcagtcaggacacagcatggacatgagggtccctgctcagctccgtgggacctcctgctgctctggctcccagataccagatgtgacatccagatgaccctagtttccatccctcctgtctgcatctggtagganacgagacgtaccactacttcctcgttcggcccggganaacgtccgagggctaattaaacaatcatttagccgttgtactcgagtacaacggaaaccgtaagggtaacgttaccaacgtctacctagtactagttatgtactcgttaattcgtacgtgtacgtacgtaacgggtccgggttacctacttccgttacggttacgaggtcggacgtaggtggtatagggtacggtacgtagttacgtttccacgttctccgaactcgtacgacgccgtacgtccgtagtcgacgtaccgtaagacgtacgttagttacgaactttaactttagttacgttaacgttaaaccgtaaagttaaactaacgttaccgtacccgtaccccgttagttaccggtttaaccgggtaccgggtaacggggtaaccggtaacggtaagggttacgaaccggtaaccgtaaaccggtaaccgttacggtaggttaacccgg

SEQ ID NO: 295310 - DNA, 784 bp, Homo sapiens
  misc_feature: GYAE6OF02FHVGN.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgacccagtttccatcctcctgtctgcatctgtaggacgacagacgtccaccatctcgttggccgggacaagtcgaggcataacatctattacgcctggtatcagccgaacgaaaccgaagggtaaacgttacctaacgtccttacctagtaattaactaacgtcgtacgttacggttacttaccgtacgttcggtacgtacccgtaaaggttcccgggggggtaccccttaacgttccggttaccgggtttacgaacgggttcgggtaccgtagggttacggtaagttaacggtagggaacctacggtttaacttacccgtaccttaccctacccgtaacccgtaacttaccaacggtacccgtaacggtcccgttaccggacccgtaacggtacccgttaaggtaaaccggtacgtttacggtttaaccgtaacgttaaaccttttaacttttaacgttaacgtttaaacgtaaaaacgttaaacgtaaaccgttaacccggttacccgacccccgttacgtaccccgtttaaccgggttaccgggtaccggggtaaaccgggtaacccggtaagggttacggaacgtaaccgttaaccgaaaccggtacggtacggttaacccgg

SEQ ID NO: 295311 - DNA, 579 bp, Homo sapiens
  misc_feature: GYAE6OF02HE75Z.36.8.A08.1.454.CMB.1.raw
  modified_base (208)..(208): a, c, t, g, unknown or other
  misc_feature (208)..(208): n is a, c, g, or t
  modified_base (362)..(362): a, c, t, g, unknown or other
  misc_feature (362)..(362): n is a, c, g, or t
  modified_base (415)..(415): a, c, t, g, unknown or other
  misc_feature (415)..(415): n is a, c, g, or t
  modified_base (421)..(421): a, c, t, g, unknown or other
  misc_feature (421)..(421): n is a, c, g, or t
  modified_base (430)..(430): a, c, t, g, unknown or other
  misc_feature (430)..(430): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgactatccagatgaccctagtttccatcctccctgtctgcatctgtacgagacagagtcaccntctcttgccggcaagtcaggcattaacaatcattagctaggtatcgagtacgacgtaaaccgaagggtaaacgttacctaagtcctcctaggacttaatacgtgcttagttacttctaactgtgacaaggtcggggtaccatcgtgtcagtcgnagtggatacgtggacagtacttcaacttcactactactcagcacgtctagccncgaccngtaaacgtnttcgttagaacctaactttaagttacgtttagtaactaaaaggttactaaacgtcgtaccgcccgttataccggtacgtttcgggaacggtaccggtaaccggaagggttaggtaacgaacgttaccgtaaaccggtagttcgggtacg

SEQ ID NO: 295312 - DNA, 608 bp, Homo sapiens
  misc_feature: GYAE6OF02GZKYI.36.8.A08.1.454.CMB.1.raw
  modified_base (164)..(164): a, c, t, g, unknown or other
  misc_feature (164)..(164): n is a, c, g, or t
  modified_base (288)..(288): a, c, t, g, unknown or other
  misc_feature (288)..(288): n is a, c, g, or t
  modified_base (399)..(399): a, c, t, g, unknown or other
  misc_feature (399)..(399): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagactaccagatgtgacatccagatgacccngtttccatcctccctgtctgcatctgtaggagacagacgtcacctatctcttgccggcaagtcgaggctattaacaatcattagctggtatcagcagaaacagggaacttcctaagctccgtanatatagtgctgtattcacgtgtcgacgtaacggtccggggtcctagttccgtacgttcgaggtgacgtagtggatagtcggactagtactttacaccttctaccgtaaccntacgacgacctagtacccgtcgaccgacgtaccgtagaacgtattcggttactaacgttaaacctttaagtttaacgttagttaaaaccgttaaactaacgttaaaccgacgttccgtaccccgtattaccgtaccggtttaccgggaaccggtacggtaaccggtaggtacggtaacgtaaccgtaacggtaaacgtacgtgtaccgg

SEQ ID NO: 295313 - DNA, 812 bp, Homo sapiens
  misc_feature: GYAE6OF02J0H8E.36.8.A08.1.454.CMB.1.raw
  modified_base (141)..(141): a, c, t, g, unknown or other
  misc_feature (141)..(141): n is a, c, g, or t
  modified_base (200)..(200): a, c, t, g, unknown or other
  misc_feature (200)..(200): n is a, c, g, or t
tcagtacgctgtctcacgaccggtgctcgatttagcatactctacagggggcagaagtctctctcagtcaggacacagcatggacatgagtgtccctgctcagctcctgggactcctgctgctctggcctcccagataccngatgtgacatccagatgaccccagttttccatcctccctgtctgcacgtctggtagganacagactacaaccctattccttcgttcggacccgggctaaacggtcggacgggactaaacttaaacgtaacttactaactttacgaccgtttagggtaacttacgaacggtacgaaaccggtaaaaaccggtaagggggtaaaaccgtttacccgtaaacggtcccgttaccgtaggtaatttaacgtattacggtaccgttagtttaacttccgtacgtttaggtacgtacggtaaaccgggttcccgggggtaccctagtttccggttaccggttcgtacggtcggtacgtaggttacggaagtttaggtacgggacgtaagttactttaccgtacctaccgtacaccgtacgtaccgaagtcccgacgtacccgttcgacggtacgtaacgtgtaaacggttgttacggttacgtacgttaaacgtttaactttaagttaaccgttaaacgttaaaacgttaaacgttaaccggtaaccgttacccgtacccgttaaccgtcccgggtttaaaccgttttccgggggaaccggttaaccggggtaaaccgttaacggggtacggtaaacggtaaccgttaaaccggtaaccggttaacggttaaccggg

SEQ ID NO: 295314 - DNA, 642 bp, Homo sapiens
  misc_feature: GYAE6OF02FWR07.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatccctcctgtctgcatctgtaggagacagagtcaccatctcttgccgggcaagtcgaggcattaacatctattagcctggtatcagcaagaaccgagggaacgttctaagctaccgtgatatatgtctgtattctactgtgtacgtacggtcggggtaccctagttccgttacggttacgtaggtacggtacgtaggtacggtaagttacggtaggggtaacgtagttaacgttttaccctaccgttacctacccgtacctaacgttaccgaacggtccgtaccggtacccttacgaccgtacggtacccgttaggtaacgtacgtttgttaaccgtacttaacgttttaatttaagttacgttaaacgtaaagttaactaaacgtacgtaccgtcccgtacctacggttaccgttacgggacggaacggtaccgtaaggtacggacgtacgtaacgaacgtacgtggtacg

SEQ ID NO: 295315 - DNA, 682 bp, Homo sapiens
  misc_feature: GYAE6OF02HEK8Z.36.8.A08.1.454.CMB.1.raw
  modified_base (199)..(199): a, c, t, g, unknown or other
  misc_feature (199)..(199): n is a, c, g, or t
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctccacccgataccagatgtgacatccagatcgaccctagtttccactcctccctgtctgcatctgtagganacagcgtcacatcctcgtcggccgganaagtcgaggactattaacatctagttacgcgtagtatcacgactaacggaaaccgtaagggtaaacgttacccgtaacgtccttaccgtagtaacttatacgttgcgttagttacttcgtacgttcgtacgacgtacggtccggggttaccncgttacgttccggttacgtaggtcggtaacgtaggtacggtaagtacgtacgggacgtacgttacttacgtaccttacctaccgtactactacgacgcctaacgtcgacgtaccaccggtcgtaagtaacgtagtttacgtacgtaacctttaaagtttatttaacggttaacgtaagttaaaacgtacttaacgtccgttaccgtacccgtacttacccggttaaccgttccggggaacggtaccgggtaacgggtaacggtacggtaacgtagtaaccggtaaaccggttagtcgggtacgg

SEQ ID NO: 295316 - DNA, 716 bp, Homo sapiens
  misc_feature: GYAE6OF02FL8VL.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctccagataccagatgtgacatccagatgaccctagtttccatcctcctgtctgcatctgtaggagacagacgtcaccatctcttcggccgggcaagtcgaggcattaacaatcattagcctggtatcagcagaaccgagggaaagttcctaagctcctagattatagtgcttgtattcactgtacgacgaacggtcgggggtaccctagttcgttacgggttacgtaggtggacgtaggtgggtacgtaaggtacgggtacgagtaacgtttccacgttacctaccaacctacgttaccacgtctaccggtcccttaaggcccgacgttacccgtaagtaacggttaacgttcgtttaacggacctttaaaccgtttttaagttttaacgtttaacggttaaacttaaaaaacggttaacttaaacggtaacggttacccggttacccccgtacgttacccggtttaacccgggttttaccggggaacccggggggtttaaccggggaacccgggttaaagggggtaaccggaacgggttaacccgtaaaccgggtaaacccggttaacggttacggggttacccggg

SEQ ID NO: 295317 - DNA, 826 bp, Homo sapiens
  misc_feature: GYAE6OF02H5B3Y.36.8.A08.1.454.CMB.1.raw
  modified_base (250)..(250): a, c, t, g, unknown or other
  misc_feature (250)..(250): n is a, c, g, or t
tcagtacgctgtctcacgaccggtgctcgatttagcatactctacagggggcagaagtctctctcagtcaggacacagcatggacatggagggtccctgctcagctccgtgggactcctgctgctcgtcggcctcccagataccagatggtagacataccgagatacgaccctagtttccatccctccctgtactcgcatcgtaggtagggagaacagacgtaccactattcctcgttcgggaccggganaacggtcgaacggtctaaattaacaacttactacgttacggacctagggttaactacctacggaaccgaaacggtaaaaccgaacggggtaaacgttacccgttaaacggtccgttacgtacgtaagttaactacgtacgttaccgtacgtttaacgttaccgtacggttgtacgggaacccggttaaccggggttacccggggggttaccctaggtttaccgtttacgggttacgtaaggggtccgggtaatacgggtacggtaaggtacgggtaacggtacgtacgtacgtttcctaacgttcctaaccgaccgttaatacgttaccgaacggtacgtcccggtacggtacccgtacggtacctagggtaacgtacggttacgtacggtaactttaacgttactttaagtacggttaaactaacgttaaagaaccgttaacgacccgtacccggtaaccgttaccggtaaccgggttacccgggtaacgggtaacccgggtaacgggtttaaccggcgggttaaaccgaaccgggttaaacccgtaaaaccgggtccggtttaaggtacccggg

SEQ ID NO: 295318 - DNA, 700 bp, Homo sapiens
  misc_feature: GYAE6OF02ITDIC.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccatcctccctgtctgcatctgtagagacagacgtcaccatctcgttcggccgggacaagtcgaggcattaacatctattacgcctaggtatcgagacaagaaaccgagggtaacgtccgtaagtcctacctagactatagtgtcttagtattctaacgttgtacgacgtaacgggtccggggtaccctacgttcgttacggttaccgtaggtcggtcgtaggttaggagttacggtagggtactagttactttaccgacttacctacctaacacgtaccgtacgacctaacgtcccgttagaccgtaccgtaccgtaagtaacgttacggttacggttacgtaacctttaaaccgttttagttttaacgttaacgttaaacgtaaaacgttaaccgtaaaccgtaccggttacccggtacccctacgtttaccggtaacccgggtttaccgggaaccggggttaaccgggtaaccggtaaggggttacggaaccgtacgttaaccggaaacgttccggttaggttaaccgg

SEQ ID NO: 295319 - DNA, 585 bp, Homo sapiens
  misc_feature: GYAE6OF02IKIJI.36.8.A08.1.454.CMB.1.raw
  modified_base (235)..(235): a, c, t, g, unknown or other
  misc_feature (235)..(235): n is a, c, g, or t
  modified_base (252)..(252): a, c, t, g, unknown or other
  misc_feature (252)..(252): n is a, c, g, or t
  modified_base (257)..(257): a, c, t, g, unknown or other
  misc_feature (257)..(257): n is a, c, g, or t
  modified_base (345)..(345): a, c, t, g, unknown or other
  misc_feature (345)..(345): n is a, c, g, or t
  modified_base (380)..(380): a, c, t, g, unknown or other
  misc_feature (380)..(380): n is a, c, g, or t
  modified_base (447)..(447): a, c, t, g, unknown or other
  misc_feature (447)..(447): n is a, c, g, or t
tcagtacgctgtctcacgaccggtgctcgatttagcatactctacgagggggcagaagtctctctcagtcaggacacagcatggacatggacgggtccctgctcagctccgtgggactcctgctgctctggctcccagactaccagatgtgacatccagatcgaccctagtttccatccctcccgtgtctgctatctaggtagagacagactacacctatctcgtcggccggtanaagtcgaggctagtaanaactntagttagcctggtatcagactacgaaaccgtaggtaaacgtacgtaacgctacccgtatatatagttgaccttagtatccagttcgtntacgacgtaccggggtcctacgtcgttacggtacnggtagcgtaagtggatacggtgactaggtacttacgattccgtacacgtactgacgactacgcgttncgacgtcagtaggattcgtacgtaacttaacgttattacgttacgaaactaaggtaaactaacgtatacccgtacctctaccgtaacggttggaccgggaacgttacgaggagtacgatacccggaagttcaggtccg

SEQ ID NO: 295320 - DNA, 766 bp, Homo sapiens
  misc_feature: GYAE6OF02FF856.36.8.A08.1.454.CMB.1.raw
  modified_base (147)..(147): a, c, t, g, unknown or other
  misc_feature (147)..(147): n is a, c, g, or t
  modified_base (160)..(160): a, c, t, g, unknown or other
  misc_feature (160)..(160): n is a, c, g, or t
tcagtacgctgtctcacgaccggtgctcgatttagcatactctacagggggcagaagtctctctcagtcaggacacagcatggacatgagggtccctgctcagctcctggactcctgctgctctggctccagataccagatgtgacntccagatcgaccngtttccatcctcctgtctgcatcgtaggtagacgacagacgtccaccatctcgttgaccgggactagtcaggtactattaacatctattacgacctggtactcgagacaagaaccgaaggtaacttaccagtctactagacttagtatagtacttagttacttacgacgttagtacgaccgtaacgggtccggggtaccctagttccgtacggttacgtagggtcgtacgtagggtacggtacgttacgggtacgggtactaacggtttacgtttacctaacgttacccgtaaccgtaacccttacgtaccgtacggtaccaacggttaccgtacgtaccgtacggttacccgtaagtaacggttacggttacgtttaccgtaacgtttaacgttttacgtttaacggtttaaccgttaaacgttaaaaacggtttccgttaaacgttaccgttccccgggtaccccgttaccgtttaacccggttaaaccgggttttacccggggaaaccggggtaaccggttaaacccgggttaaggggttaaccgggtaacggttaaacccggttaaccggtaaaccggttaccggttacgggttaacccggg

SEQ ID NO: 295321 - DNA, 571 bp, Homo sapiens
  misc_feature: GYAE6OF02GGLEG.36.8.A08.1.454.CMB.1.raw
  modified_base (197)..(197): a, c, t, g, unknown or other
  misc_feature (197)..(197): n is a, c, g, or t
  modified_base (248)..(248): a, c, t, g, unknown or other
  misc_feature (248)..(248): n is a, c, g, or t
  modified_base (357)..(357): a, c, t, g, unknown or other
  misc_feature (357)..(357): n is a, c, g, or t
  modified_base (503)..(503): a, c, t, g, unknown or other
  misc_feature (503)..(503): n is a, c, g, or t
  modified_base (542)..(542): a, c, t, g, unknown or other
  misc_feature (542)..(542): n is a, c, g, or t
tcagtacgctgtctcacgaccggtgctcgatttagcatactctacagggggcagaagtctctctcagtcaggacacagcatggacatgaggtccctgctcagctcctgggactcctgctgctctggcctcccagataccagatgtgacatccagactgaccctagtttccatcctcctgtctgcatctgtagagacngagtcacctatctcgtgcggcaagtcaggctatacatcattagcctgtacncgagtcaagaaaccgaggaacttccgtaagtcgtcctagacttatacgtgctagttattcgtactggtacgctaacgggtccggggttaccagttccgtcgggttaacnggtaggcttaggtcgggaattacgtgggaactagtacgtttcgacttaccgtactacgtactacgagtcgtacgcgttcgacgtagcctagtactagtgtacactacgttacttagttataacgtaatactacgtacgtctacccncgttacgtacgttcggaccgtaaggtaccgtagtacggngtaaccgtataaccggtacgttagaccgg

SEQ ID NO: 295322 - DNA, 364 bp, Homo sapiens
  misc_feature: GYAE6OF02FR6QO.36.8.A08.1.454.CMB.1.raw
  modified_base (322)..(322): a, c, t, g, unknown or other
  misc_feature (322)..(322): n is a, c, g, or t
  modified_base (356)..(364): a, c, t, g, unknown or other
  misc_feature (356)..(364): n is a, c, g, or t
tcagtacgctgtctcacgaccggtgctcgatttagcatactctacagggacaacgccaagaactcactgtatctgcaaatgaacagcctgagagccgaggacacggccgtatattactgtgcgagagttatccctcacggtgacaatcgctatttctacgacggtatggacgtctggggccaagggaccacggtcgccgtctcctcagcctccaccaagggcccatccggtccttccccccgtggccgccctgcctccaggacgccacctccgagacgcacagccggccctgggctagcctggtcaaggactactccagacngcgtactgacggcgggctggcgaaggcgcagtgnnnnnnnnn

SEQ ID NO: 295323 - DNA, 748 bp, Homo sapiens
  misc_feature: GYAE6OF02JZTS5.36.8.A08.1.454.CMB.1.raw
tcagtacgctgtctcacgaccggtgctcgatttagcatactctacagggggcgagaagtctctctcagtcaggacacagcatggacatgagggtccctgctcagctcctgggactcctgctgctcgtggcctcccagataccagatgtgacatccagatgacccctagtttccactcccgtcctgtctagctattctaggtaggacgtacgagtacgtccaacctacttcgttaccgttcgggcccgggacaaagttcgaacgggctaattaaactaactactaattacgtacgttaggtactacgacgacgaaacggaaacccggtaagggtaaaccgttaccgtaacgccttacgtacggtaatataactgtacctattacttactaccgtagttacgaccggtacgttaccggggttaccctcgttaccggttacggttacgtaaggttcgggtaacgtacggttaagtacgtaggttaaccggagtacggttactttaccgtaccttacctaccgtaactaactccgtaagcgtaaccggcttacgcacggtacgtagaacgttacgttggttacttaaccttacgtttaagttacgttaacttaaacgtaaagtaacgttaactaccgggtccgtaccgtcgtccggtaacgggtttacgggaaccgggtaacgggtaaccggtaaggggttactaacggtaactttaaaccccggaacgttttaacgggcccggtttaacgg

SEQ ID NO: 295324 - DNA, 551 bp, Homo sapiens
  misc_feature: GYAE6OF02H8EKD.36.8.A08.1.454.CMB.1.raw
  modified_base (223)..(223): a, c, t, g, unknown or other
  misc_feature (223)..(223): n is a, c, g, or t
  modified_base (311)..(311): a, c, t, g, unknown or other
  misc_feature (311)..(311): n is a, c, g, or t
  modified_base (392)..(392): a, c, t, g, unknown or other
  misc_feature (392)..(392): n is a, c, g, or t
  modified_base (426)..(426): a, c, t, g, unknown or other
  misc_feature (426)..(426): n is a, c, g, or t
  modified_base (430)..(430): a, c, t, g, unknown or other
  misc_feature (430)..(430): n is a, c, g, or t
  modified_base (471)..(471): a, c, t, g, unknown or other
  misc_feature (471)..(471): n is a, c, g, or t
  modified_base (530)..(530): a, c, t, g, unknown or other
  misc_feature (530)..(530): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagactaccagatgtgacatccagatgaccccagttttccatccctccgtgtctgcatctagtaggagacagagtcacatctcttgccgggnaagtcaggcattaacaatacattagcctggtatcagcaagaaaccgaagggaaacgttaccgtaaacgtctaccctagatataactancctgttattctaactgttgcaacgtcgggggtaccagtctcggttcaggtgacgagtggatagtagggactaggtactttntaacgtctaccactaacgtcaagctacgccgttnacgnacctagacagtgtgtcaacttattattacgtacaaaacgtntaaactagtccgcctactacacgtttacggcgacgggtaaccgagggttacggacgtanaaccgaacgagttagtaccgg

SEQ ID NO: 295325 - DNA, 712 bp, Homo sapiens
  misc_feature: GYAE6OF02G2UIQ.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgacccagtttccatcctccctgtctgcatctggtaggagacagacgtcaccatcctcttcggccgggcaagtcgagggcaattaacaatctattagcctgtatcagacaacgaaaccgagggaaacgttacctaacgtctcctagactatatgcttgttattcacttgtcgacgtaacggtccgggggtaccctacgttaccgtttcgggttaccgaggttcgggaccgtaagggttagggaagttaggtacggggtactaaggttaacttttcctaaccgttcctacctaaccctaacttccgaacggtccgaaccgtccgttacggacctacggtaccgtaacgggtaacgtacgtttaggttacgtaacctttaaacgtttaagtttaaagtttaacgttaaacttaaaaacgtttaacgtaaaccgttacggttacccggtaccccgttacgttacccggttaaccggtttaccggggaaccgggtaacgggtaacccggtaagggtaacggtacgtaaccgtaacggtaaaccggtacggttaggtaccgg

SEQ ID NO: 295326 - DNA, 709 bp, Homo sapiens
  misc_feature: GYAE6OF02IHH5D.36.8.A08.1.454.CMB.1.raw
  modified_base (224)..(224): a, c, t, g, unknown or other
  misc_feature (224)..(224): n is a, c, g, or t
  modified_base (318)..(318): a, c, t, g, unknown or other
  misc_feature (318)..(318): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggctcccagactaccagatgtagacagtccaaggatcgaccctagtttaccacttccctccctgtctgctatcgtgtaggagacgagacgtcaacctntcctctcggccggatagtcgaggtcaattaacatactattacgccgtagtatacagacgaaacgaaacgagggtaaactcctaactcctacgtntatatagtctacgtatatacctgtgtcgacgtacggttccgggtaccctagttccgtcgttacggacggtcggacgtaggtagggtactagggtacggactaaggttactttacgtactcgtacctacctacgtaccgacgtactacgtccgtacgtaccgtacgtaccgtaaggtaacgtacggtttcgtaacgtaaccgttagttttaaacgttaacgtttaacgtaaacgttaaaacgtaacgttaaaccgtaccgttacccgtaccccgttacgtttacccggttaccggtttacccggggaaccgggtaaacccgggttaacggtaacgggtttacggaacgttaacggttaacccgtaaaacggttacggttacgggttacccgg

SEQ ID NO: 295327 - DNA, 756 bp, Homo sapiens
  misc_feature: GYAE6OF02FYEQG.36.8.A08.1.454.CMB.1.raw
  modified_base (190)..(190): a, c, t, g, unknown or other
  misc_feature (190)..(190): n is a, c, g, or t
tcagtacgctgtctcacgaccggtgctcgatttagcatactctacagggggcagaagtctctctcagtcaggacacagcatggacatggagggtccctgctcagctccgtgggactcctgctgctcgtggcctcccagactaccagatgtgacactccagatcgaccctagtttcccactcctcctgtcngcatcgtaggtaggagacagacgtaccacctattccgtcgttcggccggacgaaggtcgaggactaacttaacgataccgttattacgtcgtcggtaatacgacgaccgtaacggaaaccggtaagggttaacgttaccgtacgtccgtacgtacgtattaagtacgtcgtacgttagttacgtactacgtgtacggtacgtacgggtccgggttacctacgttcggtacgtcgtaggtacggtacgtacggttcggaagttacgggtacggtacgtacggtttacttaccgtaccttcgtaaccaaccgttactaccgtacgacccgttacggccttaacgggccgtaaccgttcgtaaacgacgtttcgtacgttcgtaacgtttacgtttaacgttaccgttccggacgtaaccgttacttaacggttaccgtttacggtaccggttcccggtacctttcccgggtctttacccgggtttacgggtacccggggttaacgggtaaccggggttacggtaacccggggttaggtaacccgttaacggtaacccggttaaacggg

SEQ ID NO: 295328 - DNA, 805 bp, Homo sapiens
  misc_feature: GYAE6OF02HG2XT.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagatcgaccctagtttcccatccctccctgtctgctatctggtaggacacagacgtccacctattcctcttcggccgggactaaggtcgacgggactaacttaacaacttcttaatttacgccgttaggtactacgaacgaccgaaacggtaaaaccggtaacggggtaaaacgtttacccgttaaagtcccttaccgtagtaacttagttaacgttcgtacgttaggtttacttaccgtaacgttaggttacgtaccgtaaccgggttcccggggggttaccctacgtttccgggttaccggtttacgtagggttcgggtacgtagggttacgggtaagttaagggtacgggtaactaaggtttactttacccgttaacggttacccttacccggtaacctacggtacacggtacctaacccggtccttacggaccgaccggttacccgtagtaacggtacgttagttccggttaaaccttaacgttttacgttttaagtttacgttaaacgttaaaaacgttacgttaaaccgtacggtacccgtaccccgtacgttacccgttaacgggttaccgggaccgggtaacgggttaaccgacggggttacggaacgttaacgtaaccggtaaacgtccggttaggtaaccgg

SEQ ID NO: 295329 - DNA, 712 bp, Homo sapiens
  misc_feature: GYAE6OF02H4QEI.36.8.A08.1.454.CMB.1.raw
  modified_base (183)..(183): a, c, t, g, unknown or other
  misc_feature (183)..(183): n is a, c, g, or t
  modified_base (233)..(233): a, c, t, g, unknown or other
  misc_feature (233)..(233): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatcgaccctagtttccatccctcctgtcngcatcgtagtaggatacagtacgtcacctattcctcgttggaccgggtanaacggtcgagggactaattaaactaatactacgtttacgtccgtaggtatcgagacgtaacgaaaaccgtaaggggtaaaacgttcctaaacgtcgtaccgttagtaattacgttagtcgtagttagttacttacctagtcgtacgacgtaccgggttccggggtaccacgttcggttcggttacgtaggtcggtacgtaaggttggtaagtagggtaggacgtaagttacgtttaccgtacttacgtaccctaacacctacgacgtcgaaccgtccgttacgaccggttacgaccgtaaggtacgtaagttccgttagtaacctttaaacgtttatttaacgttaacgttaaactaaaacgtactaaaccgtacgtacccgtcccgttacgttacggtaccggttacgggtacgggaaccggtaacggtacgggtacgtaacggtaacgttaacccggaagtaccgttggtaacccgg

SEQ ID NO: 295330 - DNA, 810 bp, Homo sapiens
  misc_feature: GYAE6OF02H19EQ.36.8.A08.1.454.CMB.1.raw
  modified_base (70)..(70): a, c, t, g, unknown or other
  misc_feature (70)..(70): n is a, c, g, or t
  modified_base (153)..(153): a, c, t, g, unknown or other
  misc_feature (153)..(153): n is a, c, g, or t
  modified_base (200)..(200): a, c, t, g, unknown or other
  misc_feature (200)..(200): n is a, c, g, or t
tcagtacgctgtctcacgaccggtgctcgatttagcatactctacagggggcgagaagtctctctcagtnaggacacagcatggacatggagggtccctgctacagctccgtgggactcctgctgctctggcctcccagactaccagatgtanacataccgagactaccgaccctacgtttcccactcccctcctcgtcngtctactcgtagggtacgacgaacgacggtaccgtacacccgtacttccgttacggttccgggacccgggactaaacggttccggaacggggtaccttaaacgttaaactaaacgttaccgttaagttttaccgtaccggttaacggttactacgacggaaccgtaaacggtaaaaccgaacgggtaaacgttaccgtaacgtcctaacgtagtaacttagtactagtacgttacttacgttaccgtagtagtcgtaacggtaccggttaccggggtacctcgttccggtttacgtacgtacgggtacgtcgttaggacgttaggtagtaacgggtctagttactaccgttacctacgtacctaacgtctacgtacgacgtaccgtaccgttccggaccgtaacggaccgtaagtaactacggttagttaccgttaactttaacgtttaagtttaacctaaggttaaaacgttaaacgttaaggtaaccgttaccggtaccccgtcccggttacttaccggtcccgggttaaacgggaccggtaaccggtaaccggtaggggttaaccggaacgttaacgtaccggttaacggtaacggttgtaaccggg

SEQ ID NO: 295331 - DNA, 695 bp, Homo sapiens
  misc_feature: GYAE6OF02I4C64.36.8.A08.1.454.CMB.1.raw
  modified_base (154)..(154): a, c, t, g, unknown or other
  misc_feature (154)..(154): n is a, c, g, or t
  modified_base (252)..(252): a, c, t, g, unknown or other
  misc_feature (252)..(252): n is a, c, g, or t
  modified_base (443)..(443): a, c, t, g, unknown or other
  misc_feature (443)..(443): n is a, c, g, or t
  modified_base (488)..(488): a, c, t, g, unknown or other
  misc_feature (488)..(488): n is a, c, g, or t
  modified_base (525)..(525): a, c, t, g, unknown or other
  misc_feature (525)..(525): n is a, c, g, or t
tcagtacgctgtctcacgaccggtgctcgatttagcatactctacgaggggggcagaagtctctctcagtcaggacacagcagtggacatggagggtccctgctcagctccgtgggactcctgctgctcgtcggcctaccgagactaccaggtntacgtgactactaccgagtagtccggtacccctagtttcccacgttccccgttccgtattccgtacggctacgttcgttggaggactaacgaggtacncctaaccgtcttccggtacgttaccggacccgggtacctaacgggtaccggtaacggtacctaaagttaaaacctacgttccttaaggttaccgtcttacgggaattacgacgaacgtaacggtaaaccgggtaaggttaaccgttacaacgtccgtactagtactaatcacggtactaggttactacggntggtacaccggtagggtccgtactgtcgggtacggttgagtacgnggttagacgtaggacgtactatcgtactcactcctanatccagtctaacgcgattcgacggtactacggtatgtgtacttaacgtatttagttaccgaaggttaataaacggtctagtaacgtccgtaactcgtaacttcgggttacggtacggacgggtaaccgttaggaacggttcacggtaacgaccgtaaggttcgagtacgg

SEQ ID NO: 295332 - DNA, 663 bp, Homo sapiens
  misc_feature: GYAE6OF02G5POX.36.8.A08.1.454.CMB.1.raw
  modified_base (508)..(508): a, c, t, g, unknown or other
  misc_feature (508)..(508): n is a, c, g, or t
tcagtacgctgtctcacgaccggtgctcgatttagcatactctacagggggcagaagtctctctcagtcaggacacagcatggacatgagggtccctgctcagctccgtgggacctcctgctgctctggcctcccagactaccagatgtgacatccagatcgaccctagtttccatccctccctgtctgcatcgtgtaggagacagatacaccgatctcgtcggaccggacaagtcgaggactaattaacaatactaatttacgaccttaggtatcgaagaccaagaaaccgaagggtaacgttaccgtaagtcctacgtacgtattatatcgtacttagttactcgtacgtgtacgtagtaaccggttccggggtacctacgtttccgttacggttacgtaggtcggagtacggtagtagtaacggtagggtaactagttacgttcctcgtacctaccacgatacaccgtacacctaccgttacgaccacgtacctaggtaaacgtnttacgttacgttaaccgttaactttattaacgttaacgttaaacttaaacggttaataacgtaccgtccggtacccttacgtacgttacggttacgggacggtaacggaaccggttaggtacgtagtaacgttaaccgaaacggttcacgtacgg

SEQ ID NO: 295333 - DNA, 708 bp, Homo sapiens
  misc_feature: GYAE6OF02G6FLI.36.8.A08.1.454.CMB.1.raw
  modified_base (219)..(219): a, c, t, g, unknown or other
  misc_feature (219)..(219): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgtgacatccagatgaccctagtttccatcctccctgtctgcatctgtaggagacagagtcaccatctctgccgganaagtcgaggcagttaacaatctattagcctggtatcagcaagaaaccaagggtaacgttacctaagcctccgtagacttactaatgtactgttattactacgttgtcgacgtaaacggtccgggggtaccctacgttccgttcggttccgaaggttcgggtaccgtaggttacgggtaagttaacgggttacggggtaacgtaacgggttaacttttacccgtaaccgtttacccgttaccaacccgtacgtttaccgaacgacccgtaaacgtcccgttagacccgaacggtacccgtaaggaaacgtagtttagttacggtaaccttaaaccgttttaagtttagttaacgttaaacgtaaaaagttaccgttaaagtacggtacccgtcccgtaccggttacccgttaacggtttccgggaacggggttaaccggaaccggtaaggtacggaacggtacgtaaccgtaaacggtacgtggtaccgg

SEQ ID NO: 295334 - DNA, 784 bp, Homo sapiens
  misc_feature: GYAE6OF02FM0VD.36.8.A08.1.454.CMB.1.raw
  modified_base (353)..(353): a, c, t, g, unknown or other
  misc_feature (353)..(353): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagataccagatgtgacatccagactcgaccctagttccactccctccctgtctgacatcgtggtaggagactagacgtaccacctatccttcgttcggaccgggtactaacggtcggaggacctaagttaaacaattactatttacgtccgttagtactacgagaccgtaaacgaaaccggtaagggtaaaccgttaaccgtaacgtccgttaccgtaanaactttagtacgtacgtactttgttacgttccgtaagttcgtacgtacggtaacgggttcccggggtacctacgtttaccgttaccggttacgtacggtacgggtacgtacgggttaacggtaagttacggtacgggtacgttacgttaacgttcctaaccgttacccttaccgaaaccttactaccgtaacggccacggttccgacgaccgtacgtaccgtaagtaacgttacgttacgttaaccgtaacgttttaactttagtttaacgtttaacgtaaaacttaaacggttaaacgtaaccgtaccgtaccccgttacccgtaaccggtttcccgttaaccggggtaccggggtaacgggttaaccgggtaccgttaagggtacccgtaacggtaaccgtaaaccggtaacggtacggtacggtaccg

SEQ ID NO: 295335 - DNA, 737 bp, Homo sapiens
  misc_feature: GYAE6OF02GVS47.36.8.A08.1.454.CMB.1.raw
  modified_base (246)..(246): a, c, t, g, unknown or other
  misc_feature (246)..(246): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggcctcccagactaccagatcgtagacatccagatcgaccctagtttccactccctcccgtgtctgactactcgtcgtaggacgacacgacgtccacctacttctacgttcggccggganaacgtcgaggtactaattaacgatactaagtttacgaccgttaggtactacgagaccgtaaacggaaaccggtacgggtaaccgttaccgtaacgtccgtacctaagtaactttacgtaagtcgttacttacgttacttaacgtactaggtacgtaccgaacgggttcccgggtacctagttccgttcggtacacggtcgtacgtggtacgggttatacggttacggaacttaggtacctttacgtacctactaccgtactacgtacgacgtaccgactccgtacgacctacgtacttaacggatttacgtacgttacgtaaccttaacgttttagttaacgtaacgttaaacgttaaacgttactaaccgggttacctaccggtaccccttagttaccccgggttaacgggttccggaaccggggtaaccggtaacggttaagtccgggtaataaaccccgggtaacgtaaccttagggtcggtaaccgg

SEQ ID NO: 295336 - DNA, 767 bp, Homo sapiens
  misc_feature: GYAE6OF02F75RE.36.8.A08.1.454.CMB.1.raw
tcagtacgctgtctcacgaccggtgctcgatttagcatactctacaggggggcagaagtctctctcagtccaggacgacagcaactggacatgagggtccctgctcagctcctgggactcctgctgcctcgtggactaccagataccagactgtgaccacgtcccagtactcgaccctagtttccgaactccctccctgtctgcatcgtgtaggacgacagtagtccacctattccttacgttcggccgggtactaacggtcgaggtactacttaaacgaactacgtactttacgtccgttacggtactccgtagaccgaaacgaaaccggtaacgggtaaacggttacccgtaacgtccgtacccgtacgtactaacgttacgtcgtcgttagttacttacacgtttcggtacgtacgtaacggtaccgggggtacctaacgttcccggtttacggttaccgtaggtacgggtacgtaacggtacgggtaacgttacggtaggggaacttacggtttactttacgtaacctttccgtaccgtaacctacgttaacctaacggtctaaccgtccgttaacgacgtaacgtcccgtaagtaaccgttagttacggttacgtaccttaacttttacgttaacgtttaacgtaaactaaaaggttacttaacgtacggtaccgtccctacgttaccgttacggttaccgggacggtaacggtaaccgtaaggtcggtaacgtacgtaccgaaacgttacgtcggtaaccg

SEQ ID NO: 295337 - DNA, 665 bp, Homo sapiens
  misc_feature: GYAE6OF02JV50C.36.8.A08.1.454.CMB.1.raw
  modified_base (225)..(225): a, c, t, g, unknown or other
  misc_feature (225)..(225): n is a, c, g, or t
  modified_base (297)..(297): a, c, t, g, unknown or other
  misc_feature (297)..(297): n is a, c, g, or t
  modified_base (420)..(420): a, c, t, g, unknown or other
  misc_feature (420)..(420): n is a, c, g, or t
  modified_base (426)..(426): a, c, t, g, unknown or other
  misc_feature (426)..(426): n is a, c, g, or t
  modified_base (460)..(460): a, c, t, g, unknown or other
  misc_feature (460)..(460): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
  modified_base (575)..(575): a, c, t, g, unknown or other
  misc_feature (575)..(575): n is a, c, g, or t
tcagtacgctgtctcacgaccggtgctcgatttagcatactctacgagggggcagaagtctctctcagtcaggacacagcatggacatggagggtcccctgctcagctccgtgggactcctgctgctctggcctacccagtactaccgagtatgtgacatccagtatcggaccctgtttcccacttccctcctgtctcgcatgtgtagagacaggactccacctnttctcgttcgggccggacgtaacgcggacggtctaattaacaacgttacgtaatttcgtaccgtaggttacncgtaacgacgaacgttaaaaccggaaggtaacggttacccaagtccttaccgtagtacttaatgtactcggtatctctagtcgtacgacggtaccgggtcgggtacctataccgtcgttacgngtacgngttagtacgtagtagggagtacgtattcgtcccnttacccgtaccacgtacttcaggccctacgtccancctaagcgtatacgngttcttaagcttaaggtttaactgtttaacgaacttaactacgacgttacccgtcccgtaccgtnttaccccgggtaaggttacccgggtaacggtacggtaccgggttaaggaacggttataacccgttaaggtaacccggttagtccggtacg

SEQ ID NO: 295338 - DNA, 682 bp, Homo sapiens
  misc_feature: GYAE6OF02I64RQ.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactctgctgctgtggctccagactaccagatgtgactatccagatcgaccctagtttccatccgtcctgttctgacatcgtagtaggacgacgagtcgacacctacttccttgttcggccggacagtcgacggacaagttaacactactactttagccgttgttactacgacgacaacgaaaaccggtaaggtaaaccgtttaccgaacgtccttacgttgaattacttagtcgtccttagttacttctacgtcgtacggtacgtaaccgggtccggggttccctaagttcggtttacggtacgtcggtagacgtggtacgggtattacgggtaggacgtacgttactttcctacttcctaccctacgatacgtaacgccgtcgtccgaactacgactacggtaagtaccttagttcggtacttaaccttaagtttcttaaacgtttacgtaaacttaaaccgtattaaaccgtaccgtacccgtcccgttactttaccggtcggtttaccgggacgtacgggtaacgtagggttactaagaacggtaccgtaaacgtacgttaggtaccg

SEQ ID NO: 295339 - DNA, 664 bp, Homo sapiens
  misc_feature: GYAE6OF02J0VA4.36.8.A08.1.454.CMB.1.raw
  modified_base (149)..(149): a, c, t, g, unknown or other
  misc_feature (149)..(149): n is a, c, g, or t
  modified_base (153)..(153): a, c, t, g, unknown or other
  misc_feature (153)..(153): n is a, c, g, or t
  modified_base (219)..(219): a, c, t, g, unknown or other
  misc_feature (219)..(219): n is a, c, g, or t
  modified_base (248)..(248): a, c, t, g, unknown or other
  misc_feature (248)..(248): n is a, c, g, or t
tcagtacgctgtctcacgaccggtgctcgatttagcatactctacagggggcagaagtctctctcagtcaggacacagcatggacagtgagggtcccctgctcagtctccgtgggactcctgctcgctctggcctcccagactaccagntgtnacactccagatcggaccctagtttccactcccttccccgtgtctgctattcgtaggtagagaaccngacgtccacctgtcctacgtcgccggganacgtcgaggtactaacttaactactctaagtttcgacgtaggtaatcgacgacgaaacgtaaccggtaaggttaaccttaccgtaactccgtacgtactatgtaacgtcgtatccgtattaccgatcgtacgtacggtacggttacccggtactcgttcggtactcgggtgtaggcctaggtagtaacgtggtacgatacgttactctaaccgtctacactcgtaacgacgtcaccgtcacgtaccgtacgtccggtagtaaccgtcttaaccgtactaaccgttacttttagaacgttacgtaaataacccgtaagttaacccgcgttaccccggccttacgtaccggtaccggtaaccgtagggaccggtaaggacgtacggaacctacgggaaactacggtaccgtaggtccg

SEQ ID NO: 295340 - DNA, 694 bp, Homo sapiens
  misc_feature: GYAE6OF02FQK99.36.8.A08.1.454.CMB.1.raw
  modified_base (213)..(213): a, c, t, g, unknown or other
  misc_feature (213)..(213): n is a, c, g, or t
  modified_base (492)..(492): a, c, t, g, unknown or other
  misc_feature (492)..(492): n is a, c, g, or t
  modified_base (635)..(635): a, c, t, g, unknown or other
  misc_feature (635)..(635): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagactgtgacatccagactcgaccctagtttcccatccctccctgtctgcatctggtagagtacagactcaccntctctggcggacagtcgaggactatacatctattcgtccgtgtactcgagacgaacgaacgaagggtaactacctaagccgttacctagtaactattagtcgtacttgttacttacgtacgttaggtacgtaccggtaacgggttcccgggggttaccctacgtttaccggttccggttacgtacggttccgggtacgtaagggttccggtaagttaccggtaggggtaacttacggttaactttaccggaccttacctaccgaccttactacggaacnccggtactccgttcgacgtaccggtacgtagagttacgtagttagtaccttaaatttttacgttaagtttaaccgtaacggtaaaattaccggtaaacgtaccggttcccgtacccttacgttaccggtaccgttacgggggnggtaaaccggtaacggaggtacgtaacgtaaccgtaacgaacgttaccggtagtaccgg

SEQ ID NO: 295341 - DNA, 775 bp, Homo sapiens
  misc_feature: GYAE6OF02JYWRD.36.8.A08.1.454.CMB.1.raw
  modified_base (145)..(145): a, c, t, g, unknown or other
  misc_feature (145)..(145): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggctcccagataccagatgngacatccagatgacccctagtttccatcctccctgtcctgctatcgtgtaggagacagtcgtcaccattcctacgtttggacccggggtacaagttcgaacggggtaccaacgttaaacaatactactttacgaccgttcggtatacagaccaacgaaaaccgtaagggtaaacgttacctaaggtaccttaccgtagtaacttaatactagtacttggttaacttttaccaacgttcgtacgaaccggtaacgggttaacccgggggggtacccttaacggtttccgtttaccgggtttacgtaacgggttacgggtaccgtaagggttacgggttaaacgtagggttacgggtaaacgaacggtttaactttacccgttaaccgttaaccttccgtaaacccgacttaccggactaccgggtaactaccgttcgaccgtaactacccgtagtaaaggtcgttacgttacggtaaccttaagttttaactttacgttaacgttaaacgttaaattaacgtaaaccgtaacgtcccgtacccggtcttaccgttacggttaccgggaacgtaccgggttaaccgaaggtacgggtaactaacggtacgaaaccggttcggtaagtaccgg

SEQ ID NO: 295342 - DNA, 758 bp, Homo sapiens
  misc_feature: GYAE6OF02HE42H.36.8.A08.1.454.CMB.1.raw
  modified_base (188)..(188): a, c, t, g, unknown or other
  misc_feature (188)..(188): n is a, c, g, or t
tcagtacgctgtctcacgaccggtgctcgatttagcatactctacagggggcagaagtctctctcagtcaggacacagcatggacatgagggtccctgctcagctcctgggactcctgctgctctggcctcccagactaccagatgtgacatccagatcgaccctagtttccatccctcctgtctgcntcgtggtagagtacagacgtcactatcctcgttcggcccgggataacggtcgagggactaattaaacaacttctacgtttagccgttaggtactcacggaacaaacggtaaaaccggtaaggggtaaaacgttacccgtaaacggtccttacccgtagtattaatagttcgtcttaggttacttcgtaacgtggtacgtaccgtaaccgggttccgggggtacctacggttccgttaccggttacggtagggttcggtacggtaggtagggtaaggttacgggtacggggtaactaggttaactttcccgaaccttcccgtacccttaaccgtctaccggacgaccgtaccgtccggtacgacccggtacgtaccgtaacggaacggtttcgttacggtttaaccgtaccttttaaagttttaccgttttaagttaacgttaaaacgtaaacgttaacgttaaccgtacggttaccccgtcccgtacttaccggttccggtacccgggtggggaaacggttaccgaaggggtacgtaacgtacgaaaccggtacgttacggtgtaaccgg

SEQ ID NO: 295343 - DNA, 750 bp, Homo sapiens
  misc_feature: GYAE6OF02I9ZX6.36.8.A08.1.454.CMB.1.raw
  modified_base (265)..(265): a, c, t, g, unknown or other
  misc_feature (265)..(265): n is a, c, g, or t
  modified_base (587)..(587): a, c, t, g, unknown or other
  misc_feature (587)..(587): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggcctccagactaccagatgtgactatccgagtatccgaaccctaggtttcccacgttccctcccgtagtccgtgacttaacgtcgtagggtaggagaacgagtacgtccaaccgtattccgtcgtccggaccgggtanaacggttcgaggttaactaattaaccaattcgttaattacggtcgtaagtaactcgagtaaccaaaacggtaaacgtaacgggtaacttaccgaacgtcctaacggtataacttacgtagtccgtacttaagtcttacggagttcgtaccgaccggttaacgggtcccggaccttaggtttcccggtgttacggcggtaacgcgtagggttaacgaggttaacgaccgggaatcgtttaaccttcgtacctactacgtacccagttccgaagtaccgtaaccgtgtaccgtaccgtagtacgtaggtaacgttcggtttacnccgttaaaccttagtttaacgtaacgttaaccgtaaagttaaaccgtacggttaaccgaaccggtccgtaccccgtagtttccggtaacgggttaccggggaaccggttagtaaccggtaggttaacctaacgacgtaacccggttaagtcggtaaccggtcg

SEQ ID NO: 295344 - DNA, 811 bp, Homo sapiens
  misc_feature: GYAE6OF02F0SEY.36.8.A08.1.454.CMB.1.raw
tcagtacgctgtctcacgaccggtgctcgatttagcatactctacagggggcagaagtctctctcagtcaggacacagcatggacatgagggtccctgctcagctcctgggactcctgctgctctggctccagataccagatgtgacatccagatcgaccctagtttccactccctcccgtgtctgctagtgtcggtagagtacgagtacgtcaccattccttcgttcggcccgggacgtaacgacgacgggtactaataaccgtaattacctaagtttacgtccttagggtactacgtacgacctaaacggaaaccggtaaggggttaaaccgttaccgtaaacggtccgttacccgtaaggtaacttagtacgttacgacttttacgttacttacctaccgtggtacggaaccgttacgggggtacccggggttcctagtttaccggtttccggttacgtaggttcgggtaccgtaaggttacggtaaggttacggttagggaaccttaggttaccgtttaccaccttacccgttaactacccgtaacgttaccaaggtacccgtaccggtcccggttacgacccgtacgttaaccgtaagttaccggtagtttacggttacgtaaaccgttttacgtttttaacgtaagttttccgtaaaacgttaaacgttacgttaacgggttccgtaacccggtcctaccggtttaacccggttcggttaccggggtaacggggtaaccggtaacgggtaagggttaccggaagttaacccggtaccggtaaaaccgttcgggtaggtaacccgg

SEQ ID NO: 295345 - DNA, 990 bp, Homo sapiens
  misc_feature: GYAE6OF02FX6PH.36.8.A08.1.454.CMB.1.raw
tcagtacgctgtctcacgaccggtgctcgatttagcatactctacagggggcagaagtctctctcagtcaggacacagcatggacatgagggtccctgctacagctcctgggactcctgctgctctggctccagataccagatgtgacatccagatgaccctagtttccatcctccgtgtctgctatcgtaggtaggactacagacgttccacctattccgtcgttcggaccggggtacaacggttcgacggggtaacctaacgttaaacctaacttacctaacgttttacggtcccgttagggttacttacgaacggtaccgaaacggtaaaacccggtaaagggggtaaaaccggtttaacccgtaacggtaccgttaccggttacgtaaagttaacttaactacgtacgtttaggttaacgttactaccgttggtaacggtaaccgtaaaccggggttcccggggggttacccctaacggtttcccggtttacggttttacggtacgggtacgggtacgtagggttacgggtaacgttacgggtaacggggtacgttaacggtttaacgtttaccgtaaccgtttaccctaccgtaaaccctaacgttaccgaaccggtaccggtaccgttcccgtaccggtaccgtaacggttaccgtaaacgggtaaacggttacggtttacgggttaacccgtaacggttttaaaaccgttttaacgtttttaaaccgtttaccgggtttaaaaaacgttaaaaccgggttttaaaccttaaaaccggttaaccggggtttaaccccggacccccgggtttaaccgtttaccccgggtttaaacccggggtttacccggggggtaaacccgggggggtaaacccgggtttaaaccccgggggttaaacggggttacggggtaaaccgggtttaaacccgggttaaaacccgggtaaacccgggtttaaccggttaccggggtttaaacccgggg

SEQ ID NO: 295346 - DNA, 744 bp, Homo sapiens
  misc_feature: GYAE6OF02GDCDR.36.8.A08.1.454.CMB.1.raw
  modified_base (143)..(143): a, c, t, g, unknown or other
  misc_feature (143)..(143): n is a, c, g, or t
tcagtacgctgtctcacgaccggtgctcgatttagcatactctacagggggcagaagtctctctcagtcaggacacagcatggacatgagggtccctgctcagctccgtgggactcctgctgctctggcctccagataccagntgagacataccagatcgaccctacgtttccacttccctccttcgttctcgtcacttcgtaggtaggaagtacagtacgtaccacctacttcgttcgttcggccggtacaagtacggacggtactaactaactaattctaacgtttacgtcgttagacttacgacgaaccgaaacgggaaaaccggtaaacgggtaaacgttaccgtaacgtaccttacgtaggtaatacgttatacgttacttagttaccttgtactggtaccgacggttaacgggtccggggttacctcggttacgtaccgggttacgcggtacgggacgtaggtaggtaaggtcggtacgggtattaacgttcctttaacgacccgttaccaaccgtacttacgccgtacgtacgcgtacccgtgaccgtacgtccgtaaggtacttcggtacggttactaacgtttaactttagttaagttaacggttaaactaacggtttaacgaacccggttcgtaacccgtccgttaaccggttaccggtttaccgggtacccgggaccggtaacggtacgggaaggttacgacttaaaccgaccgtaacggtacgtagtaccgg

SEQ ID NO: 295347 - DNA, 194 bp, Homo sapiens
  misc_feature: GYAE6OF01CJAB9.31.12.B01.1.454.CMB.1.raw
  modified_base (170)..(194): a, c, t, g, unknown or other
  misc_feature (170)..(194): n is a, c, g, or t
tcagcagtagacgtcacgaccggtgctcgatttagtagtgtagattcgcgagggaggcgatacgctgtcagtctctccgcgagggaggcgatacgctgtcagtctctcgatggcgcgagggaggcgatacggctgtcagtctctcctgatggcgcgagggagcgatacgnnnnnnnnnnnnnnnnnnnnnnnnn

SEQ ID NO: 295348 - DNA, 196 bp, Homo sapiens
  misc_feature: GYAE6OF01DFT2V.31.12.B01.1.454.CMB.1.raw
  modified_base (156)..(156): a, c, t, g, unknown or other
  misc_feature (156)..(156): n is a, c, g, or t
  modified_base (162)..(162): a, c, t, g, unknown or other
  misc_feature (162)..(162): n is a, c, g, or t
  modified_base (170)..(196): a, c, t, g, unknown or other
  misc_feature (170)..(196): n is a, c, g, or t
tcagcagtagacgtcacgaccggtgctcgatttagtagtgtagattcgcgagggaggcgatacgctgtcagtctctccgcgagggaggcgatacgctgtcagtctctcgatggcgcgagggaggcgatacggctgtcagtctctcctgatcggcgngagggngcgatcgnnnnnnnnnnnnnnnnnnnnnnnnnnn

SEQ ID NO: 295349 - DNA, 118 bp, Homo sapiens
  misc_feature: GYAE6OF01COI95.31.12.B01.1.454.CMB.1.raw
  modified_base (113)..(118): a, c, t, g, unknown or other
  misc_feature (113)..(118): n is a, c, g, or t
tcagcagtagacgtcacgaccggtgctcgatttagtagtgtagattcgcgagggaggcgatacgctgtcagtctctcgacgtctactgctgatggcgcgagggagcgatacgnnnnnn

SEQ ID NO: 295350 - DNA, 274 bp, Homo sapiens
  misc_feature: GYAE6OF01BIZ1A.31.12.B01.1.454.CMB.1.raw
  modified_base (145)..(145): a, c, t, g, unknown or other
  misc_feature (145)..(145): n is a, c, g, or t
  modified_base (151)..(151): a, c, t, g, unknown or other
  misc_feature (151)..(151): n is a, c, g, or t
  modified_base (172)..(172): a, c, t, g, unknown or other
  misc_feature (172)..(172): n is a, c, g, or t
  modified_base (177)..(177): a, c, t, g, unknown or other
  misc_feature (177)..(177): n is a, c, g, or t
  modified_base (182)..(182): a, c, t, g, unknown or other
  misc_feature (182)..(182): n is a, c, g, or t
  modified_base (188)..(188): a, c, t, g, unknown or other
  misc_feature (188)..(188): n is a, c, g, or t
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (236)..(236): a, c, t, g, unknown or other
  misc_feature (236)..(236): n is a, c, g, or t
  modified_base (238)..(238): a, c, t, g, unknown or other
  misc_feature (238)..(238): n is a, c, g, or t
  modified_base (240)..(240): a, c, t, g, unknown or other
  misc_feature (240)..(240): n is a, c, g, or t
  modified_base (242)..(242): a, c, t, g, unknown or other
  misc_feature (242)..(242): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (248)..(248): a, c, t, g, unknown or other
  misc_feature (248)..(248): n is a, c, g, or t
  modified_base (250)..(250): a, c, t, g, unknown or other
  misc_feature (250)..(250): n is a, c, g, or t
  modified_base (252)..(274): a, c, t, g, unknown or other
  misc_feature (252)..(274): n is a, c, g, or t
tcagcagtagacgtcacgaccggtgctcgatttagtagtgtagattccgcgagggaggcgatacgctgtcagtctctccgcgagggaggcgatacggctgtcagtctctccgcgagggaggcgatacggctgtcagtctctccgngagggnggcgatacgctgtacagtctntccgngaggnggcganacggcgtgacagtcngtccgagaggnggcagtacggctgcagtcatgnangngngngngngngnnnnnnnnnnnnnnnnnnnnnnn

SEQ ID NO: 295351 - DNA, 145 bp, Homo sapiens
  misc_feature: GYAE6OF01AV0V1.31.12.B01.1.454.CMB.1.raw
  modified_base (113)..(113): a, c, t, g, unknown or other
  misc_feature (113)..(113): n is a, c, g, or t
  modified_base (129)..(145): a, c, t, g, unknown or other
  misc_feature (129)..(145): n is a, c, g, or t
tcagcagtagacgtcacgaccggtgctcgatttagtagtgtagattcgcgagggagccatacgctgtcagtctctccgcgagggagcgatacgctgtcagtctctcgatggcncgagggagcgatacgnnnnnnnnnnnnnnnnn

SEQ ID NO: 295352 - DNA, 416 bp, Homo sapiens
  misc_feature: GYAE6OF01BTDQB.31.12.B01.1.454.CMB.1.raw
  modified_base (101)..(101): a, c, t, g, unknown or other
  misc_feature (101)..(101): n is a, c, g, or t
  modified_base (119)..(119): a, c, t, g, unknown or other
  misc_feature (119)..(119): n is a, c, g, or t
  modified_base (143)..(143): a, c, t, g, unknown or other
  misc_feature (143)..(143): n is a, c, g, or t
  modified_base (152)..(152): a, c, t, g, unknown or other
  misc_feature (152)..(152): n is a, c, g, or t
  modified_base (158)..(158): a, c, t, g, unknown or other
  misc_feature (158)..(158): n is a, c, g, or t
  modified_base (175)..(175): a, c, t, g, unknown or other
  misc_feature (175)..(175): n is a, c, g, or t
  modified_base (191)..(191): a, c, t, g, unknown or other
  misc_feature (191)..(191): n is a, c, g, or t
  modified_base (200)..(200): a, c, t, g, unknown or other
  misc_feature (200)..(200): n is a, c, g, or t
  modified_base (205)..(205): a, c, t, g, unknown or other
  misc_feature (205)..(205): n is a, c, g, or t
  modified_base (216)..(216): a, c, t, g, unknown or other
  misc_feature (216)..(216): n is a, c, g, or t
  modified_base (239)..(239): a, c, t, g, unknown or other
  misc_feature (239)..(239): n is a, c, g, or t
tcagcagtagacgtcacgaccggtgctcgatttagtagtgtagattcgcgagggaggcgatacgctgtcagtctctcgatggcgcgagggaggcgatacgntgtcagtctctgatggcncgagggagcatacgctgtcagtcntcgatggcngagggngcatcgctgtcatcctntcgatggccgagaggngcgtatcgntgtcngtctctcgagngcgacggaggaggacgacgacgngtgtcgacgtctcgtcgtacgtcggcgacggacgggacggacgtacgtacgtacgtcgtcgtacgtctacgtacgtacgtcgtcggacggaggacggacgacgtacggacgtagtcgtacgtacgtcgtcgtacgtacggcgacggtagggtacgacgtacgtacgtacgtacgtac

SEQ ID NO: 295353 - DNA, 178 bp, Homo sapiens
  misc_feature: GYAE6OF01DNI5T.31.12.B01.1.454.CMB.1.raw
  modified_base (80)..(80): a, c, t, g, unknown or other
  misc_feature (80)..(80): n is a, c, g, or t
  modified_base (106)..(106): a, c, t, g, unknown or other
  misc_feature (106)..(106): n is a, c, g, or t
  modified_base (109)..(109): a, c, t, g, unknown or other
  misc_feature (109)..(109): n is a, c, g, or t
  modified_base (135)..(135): a, c, t, g, unknown or other
  misc_feature (135)..(135): n is a, c, g, or t
  modified_base (155)..(178): a, c, t, g, unknown or other
  misc_feature (155)..(178): n is a, c, g, or t
tcagcagtagacgtcacgaccggtgctcgatttagtagtgtagattccgcgagggagcgatacgctgtcagtctctccgngagggagcgatacgctgtcagtctcncgngagggaggcgatacgctgtcagtganggcgcggagggagcgatcgnnnnnnnnnnnnnnnnnnnnnnnn

SEQ ID NO: 295354 - DNA, 243 bp, Homo sapiens
  misc_feature: GYAE6OF02H5VV1.31.12.B01.1.454.CMB.1.raw
  modified_base (200)..(208): a, c, t, g, unknown or other
  misc_feature (200)..(208): n is a, c, g, or t
  modified_base (210)..(212): a, c, t, g, unknown or other
  misc_feature (210)..(212): n is a, c, g, or t
  modified_base (214)..(243): a, c, t, g, unknown or other
  misc_feature (214)..(243): n is a, c, g, or t
tcagcagtagacgtcacgaccggtgctcgatttagtagtgtagattccgcgagggaggcgatacgctgtcagtctctccgcgagggaggcgatacgctgtcagtctctccgcgagggaggcgagtacggctgtcagtctctccgcgagggagcgagtacggctaggtcagtctctcgatggcgcgagggagcgagtacgnnnnnnnnngnnngnnnnnnnnnnnnnnnnnnnnnnnnnnnnnn

SEQ ID NO: 295355 - DNA, 240 bp, Homo sapiens
  misc_feature: GYAE6OF02IRKR3.31.12.B01.1.454.CMB.1.raw
  modified_base (113)..(113): a, c, t, g, unknown or other
  misc_feature (113)..(113): n is a, c, g, or t
  modified_base (174)..(174): a, c, t, g, unknown or other
  misc_feature (174)..(174): n is a, c, g, or t
  modified_base (186)..(186): a, c, t, g, unknown or other
  misc_feature (186)..(186): n is a, c, g, or t
  modified_base (192)..(192): a, c, t, g, unknown or other
  misc_feature (192)..(192): n is a, c, g, or t
  modified_base (202)..(205): a, c, t, g, unknown or other
  misc_feature (202)..(205): n is a, c, g, or t
  modified_base (207)..(240): a, c, t, g, unknown or other
  misc_feature (207)..(240): n is a, c, g, or t
tcagcagtagacgtcacgaccggtgctcgatttagtagtgtagattcgcgagggaggcgatacgctgtcagtctctccgcgagggaggcgatacggctgtcagtctctcccgngagggaggcgatacggctgtcagtctctccgcgagggagcgatacggctggtcagtcttcncctgatgggccngagggngcgatacggnnnngnnnnnnnnnnnnnnnnnnnnnnnnnnnnnnnnnn

SEQ ID NO: 295356 - DNA, 370 bp, Homo sapiens
  misc_feature: GYAE6OF01CIZL2.44.1.A01.1.454.CMB.1.raw
  modified_base (363)..(370): a, c, t, g, unknown or other
  misc_feature (363)..(370): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnnnnnnn

SEQ ID NO: 295357 - DNA, 364 bp, Homo sapiens
  misc_feature: GYAE6OF01DWU8G.44.1.A01.1.454.CMB.1.raw
  modified_base (362)..(364): a, c, t, g, unknown or other
  misc_feature (362)..(364): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccataagcagcctgcagcctgatgattttgcaacttattactgccaacagtataagagttattctcagagttttggccaggggaccaagctggagatcaaacgaactgtggctgcaccatctgtcttcatcttccgccatctgatatatactgtctgagcgggctggcaaggcgcatagnnn

SEQ ID NO: 295358 - DNA, 368 bp, Homo sapiens
  misc_feature: GYAE6OF01B5W6P.44.1.A01.1.454.CMB.1.raw
  modified_base (364)..(368): a, c, t, g, unknown or other
  misc_feature (364)..(368): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatctccagtctgcaacctgaagattttgcaacttactactgtcaacagagttatactgccccgttcacttttggtcgggggaccaagctggagatcaaaggaactgtggctgcaccatctgtcttcatcttcccgccatctgatatatactgtctgagcgggctggcaaggcgcatagnnnnn

SEQ ID NO: 295359 - DNA, 369 bp, Homo sapiens
  misc_feature: GYAE6OF01DI5W0.44.1.A01.1.454.CMB.1.raw
  modified_base (366)..(369): a, c, t, g, unknown or other
  misc_feature (366)..(369): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaaacagtataagagttattctcagagttttggccaggggaccaaagctggagatcaaacgaactgtggctgcaccatctgtcttcatctttcccgctatctgatatatactgtctgagcgggctggcaagcgcatagnnnn

SEQ ID NO: 295360 - DNA, 472 bp, Homo sapiens
  misc_feature: GYAE6OF01EDGFH.44.1.A01.1.454.CMB.1.raw
  modified_base (454)..(454): a, c, t, g, unknown or other
  misc_feature (454)..(454): n is a, c, g, or t
  modified_base (461)..(472): a, c, t, g, unknown or other
  misc_feature (461)..(472): n is a, c, g, or t
tcagacagtatatacacgaccggtgctcgatttagacgtctcatcaagggccttagggcattccctggtaattcaggcaggaaccacgggaatggcccctaagggtcctgactctataaaggcgtcctagtttagaaggtggggtcccatccaaggttcagcggcagtggatctggggacagaattcatctcaccatcgagcagccgtgcgagtcctgggactaggacttttggcaaccgttattacctgaccaacctacgtaactaaaggcgtttattcctctaccgtaggttttcggccctaggggaccctaaggcgtaggacgactaccgaaaacggaactgtacggacgtcggcctaccggacttcgtacgtcgttaccaacgttccttaccccgtccactcctacgtactactagtacgtcggtctggacgacgggctcggacaaggcncagtagnnnnnnnnnnnn

SEQ ID NO: 295361 - DNA, 367 bp, Homo sapiens
  misc_feature: GYAE6OF01BF6XZ.44.1.A01.1.454.CMB.1.raw
  modified_base (363)..(367): a, c, t, g, unknown or other
  misc_feature (363)..(367): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnnnn

SEQ ID NO: 295362 - DNA, 285 bp, Homo sapiens
  misc_feature: GYAE6OF01A5HBZ.44.1.A01.1.454.CMB.1.raw
  modified_base (280)..(285): a, c, t, g, unknown or other
  misc_feature (280)..(285): n is a, c, g, or t
tcagacagtatatacacgaccggtgctcgatttagacgtctcatcaggggtcccctcgaggttcagtggcagtggatctgcgacagatttcaccctcaccatcaatagcctggaagctgaagatgctgcaacgtattactgtcatcagagtagtagtttacctcggcacttttggccaggggaccaagctggagatcaaacgaactgtggctgcaccatctgtcttcatcttcccgccatctgatatatactgtctgagcgggctggcaaggcgcatagnnnnnn

SEQ ID NO: 295363 - DNA, 439 bp, Homo sapiens
  misc_feature: GYAE6OF01DFLU2.44.1.A01.1.454.CMB.1.raw
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (396)..(439): a, c, t, g, unknown or other
  misc_feature (396)..(439): n is a, c, g, or t
tcagacagtatatacacgaccggtgctcgatttagacgtctcatctaggggccggttaaggggcattccctggtatcagcagaaacctagggaatgcccctaaggtccctgatctataaggcgtctagttttagaaagtgggtcccatcaaggttcagcggcagtggatctgggacagaattcactctcaccatcagcagcctgcagcctgatgattttgcaacttattactgcccaaacagttataaagagttaattctcagtaagttttggccctagggggaccaagcctggacgagtcgaaaacgaactgtggcgtgcaccatctgtcttcagtctcttcccgccatctgactatatactgtctgagcgggctgcaaggcacatacgnanacnnnnnnnnnnnnnnnnnnnnnnnnnnnnnnnnnnnnnnnnnnnn

SEQ ID NO: 295364 - DNA, 367 bp, Homo sapiens; identical to SEQ ID NO: 295361
  misc_feature: GYAE6OF01BLKZV.44.1.A01.1.454.CMB.1.raw
  modified_base (363)..(367): a, c, t, g, unknown or other
  misc_feature (363)..(367): n is a, c, g, or t

SEQ ID NO: 295365 - DNA, 659 bp, Homo sapiens
  misc_feature: GYAE6OF01AIO64.44.1.A01.1.454.CMB.1.raw
  modified_base (614)..(614): a, c, t, g, unknown or other
  misc_feature (614)..(614): n is a, c, g, or t
  modified_base (618)..(618): a, c, t, g, unknown or other
  misc_feature (618)..(618): n is a, c, g, or t
  modified_base (620)..(620): a, c, t, g, unknown or other
  misc_feature (620)..(620): n is a, c, g, or t
  modified_base (622)..(659): a, c, t, g, unknown or other
  misc_feature (622)..(659): n is a, c, g, or t
tcagacagtatatacacgaccggtgctcgatttagacgtctcatcagggccttaggggcattccctggtatcagcagaaaccagggaatgcccctaaggtcctgatctataaggcgtctagttttagaaagtgggggtcccatcaagggttcgagcggcaggtggatcgtgggacaagtaattcactctccaccatcagcacgcctgcacgcctgatgttattttgactaactttattactcgaccaaactagttaataaggtagtttacttctacgtaggttaggtttttcgggcccggtaacgggggaacccgaaaaggtccgttaggggaagtaacttaaccgaaaaaaccggtaaaccgttgggtcgggtccgttcgggaccccaaaccctaactttccgtttcggttttcccttttaccctaacttttccccccgttttacccccccggaccccttaacctttccgtttaggtaaacttttaaacgtttaaacttttaacccgtttacgggttttcccgttaggggtaaacgggggtccccggggggtccgttacggggggaacccggtaaaaccggggggcccgggtacccgttaaaggttaacgggngtgngngnnnnnnnnnnnnnnnnnnnnnnnnnnnnnnnnnnnnnn

SEQ ID NO: 295366 - DNA, 364 bp, Homo sapiens
  misc_feature: GYAE6OF01DY8I1.44.1.A01.1.454.CMB.1.raw
  modified_base (358)..(364): a, c, t, g, unknown or other
  misc_feature (358)..(364): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttactactgtcaacagagttatactgccccgttcacttttggtcggggaccaagctggagatcaaacgactgtggctgcaccatctgtcttcatctccgcatctgatatatactgtctgagcggctggcaaggcgacatagnnnnnnn

SEQ ID NO: 295367 - DNA, 365 bp, Homo sapiens
  misc_feature: GYAE6OF01ETBNU.44.1.A01.1.454.CMB.1.raw
  modified_base (361)..(365): a, c, t, g, unknown or other
  misc_feature (361)..(365): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcggctggcaaggcgcatagnnnnn

SEQ ID NO: 295368 - DNA, 364 bp, Homo sapiens
  misc_feature: GYAE6OF01BYVTE.44.1.A01.1.454.CMB.1.raw
  modified_base (360)..(364): a, c, t, g, unknown or other
  misc_feature (360)..(364): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacaatatctttttatccgtacagttttggccaggggaccaagctggagatcaaaggactgtggctgcacatctgtcttcatcttcccgccatctgatatatactgtctgagcggctggcaaggcgcatagnnnnn

SEQ ID NO: 295369 - DNA, 184 bp, Homo sapiens
  misc_feature: GYAE6OF01COH2O.44.1.A01.1.454.CMB.1.raw
  modified_base (184)..(184): a, c, t, g, unknown or other
  misc_feature (184)..(184): n is a, c, g, or t
tcagacagtatatacacgaccggtgctcgatttagacgtctcatcaggggtcccctcgaggttcagtggcagtggatctgcgacagatttcaccctcaccatcaatagcctggaagctgaagatgctgcaacgtattactgcatcagagtagtagtttacctcggctactttggccagggaccn

SEQ ID NO: 295370 - DNA, 603 bp, Homo sapiens
  misc_feature: GYAE6OF01CYWPO.44.1.A01.1.454.CMB.1.raw
  modified_base (452)..(452): a, c, t, g, unknown or other
  misc_feature (452)..(452): n is a, c, g, or t
  modified_base (513)..(514): a, c, t, g, unknown or other
  misc_feature (513)..(514): n is a, c, g, or t
  modified_base (518)..(518): a, c, t, g, unknown or other
  misc_feature (518)..(518): n is a, c, g, or t
  modified_base (521)..(525): a, c, t, g, unknown or other
  misc_feature (521)..(525): n is a, c, g, or t
  modified_base (531)..(532): a, c, t, g, unknown or other
  misc_feature (531)..(532): n is a, c, g, or t
  modified_base (534)..(535): a, c, t, g, unknown or other
  misc_feature (534)..(535): n is a, c, g, or t
  modified_base (537)..(537): a, c, t, g, unknown or other
  misc_feature (537)..(537): n is a, c, g, or t
  modified_base (539)..(539): a, c, t, g, unknown or other
  misc_feature (539)..(539): n is a, c, g, or t
  modified_base (544)..(544): a, c, t, g, unknown or other
  misc_feature (544)..(544): n is a, c, g, or t
  modified_base (546)..(546): a, c, t, g, unknown or other
  misc_feature (546)..(546): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (552)..(552): a, c, t, g, unknown or other
  misc_feature (552)..(552): n is a, c, g, or t
  modified_base (554)..(554): a, c, t, g, unknown or other
  misc_feature (554)..(554): n is a, c, g, or t
  modified_base (556)..(557): a, c, t, g, unknown or other
  misc_feature (556)..(557): n is a, c, g, or t
  modified_base (559)..(559): a, c, t, g, unknown or other
  misc_feature (559)..(559): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (569)..(569): a, c, t, g, unknown or other
  misc_feature (569)..(569): n is a, c, g, or t
  modified_base (571)..(571): a, c, t, g, unknown or other
  misc_feature (571)..(571): n is a, c, g, or t
  modified_base (573)..(573): a, c, t, g, unknown or other
  misc_feature (573)..(573): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
  modified_base (583)..(583): a, c, t, g, unknown or other
  misc_feature (583)..(583): n is a, c, g, or t
  modified_base (585)..(585): a, c, t, g, unknown or other
  misc_feature (585)..(585): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (592)..(592): a, c, t, g, unknown or other
  misc_feature (592)..(592): n is a, c, g, or t
  modified_base (596)..(597): a, c, t, g, unknown or other
  misc_feature (596)..(597): n is a, c, g, or t
  modified_base (599)..(601): a, c, t, g, unknown or other
  misc_feature (599)..(601): n is a, c, g, or t
tcagacagtatatacacgaccggtgctcgatttagacgtctcatcgaaggggccttaggggcattccctggtatcagccaagaaaccagggaatgcccctaaggtcctggatcgtactaagggcgtctagtttagaaagtggggtcccatcaacggttcagcggcagtggatctggggacagaattcacctctccaacctatcagacacgccgtggcacggcctgactagtaccttttggaccgtaactttagttacgtcggacccaaagtaagttaatttaaagtaagtttattctacggtaagttacgtttttcggacggtaacgggggaaccaacggtcgtaggaaagacttaaaccgaaaacggtaacttcggtacggtacttccggaaccacctaactttccgtacggtttaccttactaccttcccctttcccgactactcctaanattaatcttaacgtcgttccaggacggtcgggtactacggaactacgggtcactaggtagnntagntcnnnnnctatgnngnngngngagcncncncncncncnncncncncncncncncncncncgcncncncncnncncacnncnnncg

SEQ ID NO: 295371 - DNA, 368 bp, Homo sapiens
  misc_feature: GYAE6OF01C3RII.44.1.A01.1.454.CMB.1.raw
  modified_base (357)..(357): a, c, t, g, unknown or other
  misc_feature (357)..(357): n is a, c, g, or t
  modified_base (363)..(368): a, c, t, g, unknown or other
  misc_feature (363)..(368): n is a, c, g, or t
tcagacagtatatacacgaccggtgctcgatttagacgtctcatcagggccttaggggcattccctggtatcagcagaaaccagggaatgcccctaaggtcctgatctataaggcgtctagttttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgccatctgatatatactgtctgagcggctggcaggcncatagnnnnnn

SEQ ID NO: 295372 - DNA, 366 bp, Homo sapiens
  misc_feature: GYAE6OF01C5YE6.44.1.A01.1.454.CMB.1.raw
  modified_base (364)..(366): a, c, t, g, unknown or other
  misc_feature (364)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagttttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgccatctgatatatactgtctgagcgggctggcaggcgcatagnnn

SEQ ID NO: 295373 - DNA, 374 bp, Homo sapiens
  misc_feature: GYAE6OF01CPJ1K.44.1.A01.1.454.CMB.1.raw
  modified_base (231)..(231): a, c, t, g, unknown or other
  misc_feature (231)..(231): n is a, c, g, or t
  modified_base (368)..(374): a, c, t, g, unknown or other
  misc_feature (368)..(374): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattgctgccaanagtataagagttattctcagtagttttggccaggggaccaagctggagatcaaacgaactgtggctgcaccatctgtcttcatccttcccgcctatctgatatatactgtctgagcgggctgggcaaggcgcatagnnnnnnn

SEQ ID NO: 295374 - DNA, 426 bp, Homo sapiens
  misc_feature: GYAE6OF01EVFZ0.44.1.A01.1.454.CMB.1.raw
  modified_base (385)..(385): a, c, t, g, unknown or other
  misc_feature (385)..(385): n is a, c, g, or t
  modified_base (388)..(426): a, c, t, g, unknown or other
  misc_feature (388)..(426): n is a, c, g, or t
tcagacagtatatacacgaccggtgctcgatttagacgtctcatcagggccttaggggacgattccctggtatcagcagaaaccagggaatgcccctaaggtcctgatcctataaggcgtctagtttaggaaagtgggtcccatcaaggttcagcggcagtggatctgggacagaattcactctcaccatcagcagcctgcagcctgatgattttgctaacttattactgccaacagtataagagttattctcagtagttttggcctaaggggaccaagctagggaaaatcgaaaacgtacctggtacggctgacacctatcctgtcttcatcttcccgccatctgattatatctgtctgagcgggctggactaaggcgcatagncannnnnnnnnnnnnnnnnnnnnnnnnnnnnnnnnnnnnnn

SEQ ID NO: 295375 - DNA, 728 bp, Homo sapiens
  misc_feature: GYAE6OF01A39GF.44.1.A01.1.454.CMB.1.raw
tcagacagtatatacacgaccggtgctcgatttagacgtctcatcaggggccttaagggcattccctggtagtccagcagaaaccagggaatcgccctaaggtcctgatcctataacggcgtctagttttagaagtggggtcccatcaaggttcagcggcaagtggtatctgggacagaacttcactcctcaccatcagccaggcctgcacgcctgatgatttggctaacgttattacgtgtaccaacacgtaataacgtagtttacttccgtacgtaacgtaagttttaggaccgacgggggtaccaacggcgttacggagactacgaaacgtactggtacggtactggacctacctacttccgtaggttcccttacgtacgtcccgtttcccccgaccgtacgttccgttacgaacgttacggttaacgttacggttacggttccgggtaacggacgggtacccgggttccgtacgggtacctaaaccggggtccgactaacgtaggctacgctacggactcgtagtctaacgtctcgtatacgttactcggtactcgacgttaccacttaacgtacctacgtaccgtccggtaccgttacggtacggtaccgtaccggtacggtacggtacggtacggtaccgtacgtaacgtaaccggtacgttacggacggtacgtaccgtacgtaccgtacgttacgtaccgttacttaccgtccgtacccg

SEQ ID NO: 295376 - DNA, 366 bp, Homo sapiens
  misc_feature: GYAE6OF01B8RJX.44.1.A01.1.454.CMB.1.raw
  modified_base (363)..(366): a, c, t, g, unknown or other
  misc_feature (363)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnnn

SEQ ID NO: 295377 - DNA, 371 bp, Homo sapiens
  misc_feature: GYAE6OF01BIRRT.44.1.A01.1.454.CMB.1.raw
  modified_base (363)..(371): a, c, t, g, unknown or other
  misc_feature (363)..(371): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnnnnnnnn

SEQ ID NO: 295378 - DNA, 374 bp, Homo sapiens
  misc_feature: GYAE6OF01BIPOO.44.1.A01.1.454.CMB.1.raw
  modified_base (367)..(374): a, c, t, g, unknown or other
  misc_feature (367)..(374): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaaacagtataagagtttattctcagtagttttggccaggggaccaagctggagatacaaacgaactgtgctgcacatctgtcttcatccttccgccatctgatatatactgtctgagcgggctggcgaaggcgcatagnnnnnnnn

SEQ ID NO: 295379 - DNA, 735 bp, Homo sapiens
  misc_feature: GYAE6OF01D7OR5.44.1.A01.1.454.CMB.1.raw
  modified_base (178)..(178): a, c, t, g, unknown or other
  misc_feature (178)..(178): n is a, c, g, or t
tcagacagtatatacacgaccggtgctcgatttagacgtctcatcgaggccttagggcacttccctggtatcagctagaaaccaggaatcgcccctaaggtcctgatctataacggcgtctagtttagaacgtgggtcccatcaaggttcagcggcagtggatcgtgggacagattcnctctcaccatcagcagcctgctagcctgaagatgttagactaaacttattacgtgtacaaaagtcaacgagtcgcccctgaccgtacgtttccggcccgtaggggaacctaaaggttcggaacttactacctaaggtacgaaacgttggtaacggtactacgaccaacctattccgttacggttacctttacaaacgtttccccgttaccccggaccctaacgttacgtaaacttaacttaacgttaaccgttcggttacccgttaacgggtaaacggggcccggggtacgtttacggggtaacccaaaacggggtccgtaaccgtaaagtttaaaccggctaggtaccgtagtacgacgtacgacgtacgtacgtactacgtcgtacgtacgtacgttacgttacgttacgtacgtaactactacgtacgtacgtacgtacgtacgtacgtacgtacgtacgtacggtacgtacgtacgtacgtacgtaccgtaccgtcgtactacgtccgtaccgtaccgtaccgtaccgtaccgtaccgtccgtccgtccgtcg

SEQ ID NO: 295380 - DNA, 403 bp, Homo sapiens
  misc_feature: GYAE6OF01EYF8U.44.1.A01.1.454.CMB.1.raw
  modified_base (369)..(370): a, c, t, g, unknown or other
  misc_feature (369)..(370): n is a, c, g, or t
  modified_base (372)..(403): a, c, t, g, unknown or other
  misc_feature (372)..(403): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttattactgccaacagtataagagttattctcagtagttttggccaaggggaccaagctggagatacaaacgactggtggctgcaccatctgtcttcatcttcccgccatctgatatatactgtctgagcgggctggcaagggcgtcataggnngnnnnnnnnnnnnnnnnnnnnnnnnnnnnnnnn

SEQ ID NO: 295381 - DNA, 388 bp, Homo sapiens
  misc_feature: GYAE6OF01C7ZTX.44.1.A01.1.454.CMB.1.raw
  modified_base (253)..(253): a, c, t, g, unknown or other
  misc_feature (253)..(253): n is a, c, g, or t
  modified_base (383)..(388): a, c, t, g, unknown or other
  misc_feature (383)..(388): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagatttctctctcaccatcagcagcctgcagcctgaagatgttgacaactttattactgtacaaaagtacaacagtcgccccctnactaccgttttccggccctagggaaccaaagtggaatactacaaacgactgtggctgaccacatctgtcttcattccttcccgctatctgatatatactgtctgacgcgggctggacaaggccacatagnnnnnn

SEQ ID NO: 295382 - DNA, 369 bp, Homo sapiens
  misc_feature: GYAE6OF01EB69Y.44.1.A01.1.454.CMB.1.raw
  modified_base (362)..(369): a, c, t, g, unknown or other
  misc_feature (362)..(369): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttatactgccaacagtataagagttattctcagtagttttggcctaggggaccaagctggagatacaaacgaactgtgctgcacatctgtcttcatctcccgctatctgatatatactgtctgagcggctggcaaggcgcatagnnnnnnnn

SEQ ID NO: 295383 - DNA, 374 bp, Homo sapiens
  misc_feature: GYAE6OF01COE4A.44.1.A01.1.454.CMB.1.raw
  modified_base (351)..(351): a, c, t, g, unknown or other
  misc_feature (351)..(351): n is a, c, g, or t
  modified_base (368)..(374): a, c, t, g, unknown or other
  misc_feature (368)..(374): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgctaacttatactgacaacagtataagagttattctcagagttttggccgtagggaccaagctggagatacaaacgactaggtcggctcgcacccatctgtcttcatctcccgcatctgatatatactgtctgagcgggntcggcgaagcgcatagnnnnnnn

SEQ ID NO: 295384 - DNA, 364 bp, Homo sapiens
  misc_feature: GYAE6OF01ECYPD.44.1.A01.1.454.CMB.1.raw
  modified_base (362)..(364): a, c, t, g, unknown or other
  misc_feature (362)..(364): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcggctggcaaggcgcatagnnn

SEQ ID NO: 295385 - DNA, 362 bp, Homo sapiens
  misc_feature: GYAE6OF01DNB4J.44.1.A01.1.454.CMB.1.raw
  modified_base (361)..(362): a, c, t, g, unknown or other
  misc_feature (361)..(362): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcacatctgtcttcatcttcccgccatctgatatatactgtctgagcggctggcaggcgcatagnn

SEQ ID NO: 295386 - DNA, 399 bp, Homo sapiens
  misc_feature: GYAE6OF01ALL1B.44.1.A01.1.454.CMB.1.raw
  modified_base (388)..(388): a, c, t, g, unknown or other
  misc_feature (388)..(388): n is a, c, g, or t
  modified_base (391)..(399): a, c, t, g, unknown or other
  misc_feature (391)..(399): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgctaacttatactgccaacagtataagagttattctactagtagttttggccgtaggggaccaaggctggagatcaaacgactgtggcgtgcaccatctgttctcattccttcccgcctactctgtaacttatattaccttgtcttgacggcgggtctgggacacggcgcgatagngtnnnnnnnnn

SEQ ID NO: 295387 - DNA, 407 bp, Homo sapiens
  misc_feature: GYAE6OF01DBMO5.44.1.A01.1.454.CMB.1.raw
  modified_base (398)..(407): a, c, t, g, unknown or other
  misc_feature (398)..(407): n is a, c, g, or t
tcagacagtatatacacgaccggtgctcgatttagacgtctcatcagggccttaggggcattccctggtatcagcagaaaccagggaatgcccctaaggtcctgatctataaggcgtctagttttagaaagtggggtcccatcaaggttcagcggcagtggatctgggacagaattcactctcaccatcagcagcctgcagcctgatgtatttgactaacttattactgccaaacagtataagagttattctcagtagttttggaccgtaggggaccaagctaggagatacaaacgactgtggctgaccacctatctgttctttacacttccttccccgactacttcctagtattattattactgtctggacggtcgggctggcaaggccgatatagnnnnnnnnnn

SEQ ID NO: 295388 - DNA, 375 bp, Homo sapiens
  misc_feature: GYAE6OF01EDSLW.44.1.A01.1.454.CMB.1.raw
  modified_base (369)..(375): a, c, t, g, unknown or other
  misc_feature (369)..(375): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaagtgggtcccatcaaggttcagcggcagtggatctgggacagaattcactctcaccatcagcagcctgcagcctgatgattttgctaacttattactgaccaacagtataagagtttattctcagtagtttggccaggggaccaagctggagatacaaacgactgtggctgcaccatctgtcttcacttcctcccgcatctgatatatactgtctgaggtcggctggcgaaggcgacatagnnnnnnn

SEQ ID NO: 295389 - DNA, 413 bp, Homo sapiens
  misc_feature: GYAE6OF01AK0W2.44.1.A01.1.454.CMB.1.raw
  modified_base (284)..(284): a, c, t, g, unknown or other
  misc_feature (284)..(284): n is a, c, g, or t
  modified_base (389)..(413): a, c, t, g, unknown or other
  misc_feature (389)..(413): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaagtgggtcccatcaaggttcagcggcagtggatctgggacagaattcactctcaccatcagcagcctgcagcctgatgattttgcaaactttattactgaccaaacagtataagtagtttattctcagtagtttttggccaggggaccaagctgganatcaaagactgtggctgcaccatctgtcttcatccttccgccactctctatatactactgttacgtgagggtcggtctaggacgtaacggccgaccgtatagcgnnnnnnnnnnnnnnnnnnnnnnnnn

SEQ ID NO: 295390 - DNA, 371 bp, Homo sapiens
  misc_feature: GYAE6OF01C14TK.44.1.A01.1.454.CMB.1.raw
  modified_base (363)..(371): a, c, t, g, unknown or other
  misc_feature (363)..(371): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatatcttttttatccgtacagttttggccaggggccaagctggagatcaaaggaactgtggctgcaccatctgtcttcatccttcccgcatctgatatatactgtctgagcgggctggcaaggcgcatagnnnnnnnnn

SEQ ID NO: 295391 - DNA, 366 bp, Homo sapiens
  misc_feature: GYAE6OF01AXD70.44.1.A01.1.454.CMB.1.raw
  modified_base (357)..(357): a, c, t, g, unknown or other
  misc_feature (357)..(357): n is a, c, g, or t
  modified_base (363)..(366): a, c, t, g, unknown or other
  misc_feature (363)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcggcggcagtggatctgggacagaattcactctcaccatcagcagcctgcagcctgatgattttgctaacttattactgaccaacagtataagagttattctcagtagttttggccaggggaccaagctggagatcaaacgactgtaggctgcaccatctgtctcatcttcccgctatctgatatatactgtctgagcggctgcaggcncatagnnnn

SEQ ID NO: 295392 - DNA, 367 bp, Homo sapiens
  misc_feature: GYAE6OF01BIE9D.44.1.A01.1.454.CMB.1.raw
  modified_base (278)..(278): a, c, t, g, unknown or other
  misc_feature (278)..(278): n is a, c, g, or t
  modified_base (361)..(367): a, c, t, g, unknown or other
  misc_feature (361)..(367): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctgganatcaaacgactgtggctgcaccatctgtcttcatcttcccgcatctgatatatactgtctgagcggctggcaaggcgcatagnnnnnnn

SEQ ID NO: 295393 - DNA, 427 bp, Homo sapiens
  misc_feature: GYAE6OF01B2WPH.44.1.A01.1.454.CMB.1.raw
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (381)..(427): a, c, t, g, unknown or other
  misc_feature (381)..(427): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgctaacttattactgccaacagtataagagttattctcagtagttttggccagggaccaagctggagatcaaacgaactgtgctgcaccatctgtctcatccttcccgctatctagatactatactgtactgagcggtctggacaaggcgactagtagtcgntcgntannnnnnnnnnnnnnnnnnnnnnnnnnnnnnnnnnnnnnnnnnnnnnn

SEQ ID NO: 295394 - DNA, 369 bp, Homo sapiens
  misc_feature: GYAE6OF01BFX0D.44.1.A01.1.454.CMB.1.raw
  modified_base (346)..(346): a, c, t, g, unknown or other
  misc_feature (346)..(346): n is a, c, g, or t
  modified_base (361)..(369): a, c, t, g, unknown or other
  misc_feature (361)..(369): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccagggaccaagctggagatcaaacgaactgtggctgcaccatctgtcttcatcttcccgcatctgatatatactgtctgagcgggntggcaggcgcatagnnnnnnnnn

SEQ ID NO: 295395 - DNA, 599 bp, Homo sapiens
  misc_feature: GYAE6OF01BQU5Y.44.1.A01.1.454.CMB.1.raw
tcagacagtatatacacgaccggtgctcgatttagacgtctcatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcaatatttatgctatgcaggtgggtgcgccgacggcccccggacaaaggcttgaggtggatgggatggatcgaacgctggcaagtggtagacacgaagatatcacagaagttccgagggcagacgtcaccattaccagacgacacactccgcgacgcacacgacctacatggagcctgacgcacgcctggaagtactacgtagaaacgaccgtacgggtcttagttaattatttaagttggtacggacgggtaaagggtaaggggtaaaggggggtaaactacggggtaaaccgttaaaccgggttaaacctttaaccccgttagtttaacctttaaaccgttaacgttaaaccg

SEQ ID NO: 295396 - DNA, 372 bp, Homo sapiens
  misc_feature: GYAE6OF01ECF35.44.1.A01.1.454.CMB.1.raw
  modified_base (249)..(249): a, c, t, g, unknown or other
  misc_feature (249)..(249): n is a, c, g, or t
  modified_base (324)..(324): a, c, t, g, unknown or other
  misc_feature (324)..(324): n is a, c, g, or t
  modified_base (363)..(372): a, c, t, g, unknown or other
  misc_feature (363)..(372): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctnacgagttttggccaggggaccaagcctggagatcaaacgactgtggctgcacatctgtctcatcttcccgcatcngactatactactgtctgacgcggctggcaaggcgcatgnnnnnnnnnn

SEQ ID NO: 295397 - DNA, 383 bp, Homo sapiens
  misc_feature: GYAE6OF01B5S6X.44.1.A01.1.454.CMB.1.raw
  modified_base (377)..(383): a, c, t, g, unknown or other
  misc_feature (377)..(383): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgctaacttattactgccaacagtataagagttattctcagtagttttggcctaggggaccaagctggagatacaaacgaactgtggctgcaccatctgtcttcacttccttcccgcctatctgtatatatactgtctgagcgggctaggcgaacggcgacagtagnnnnnnn

SEQ ID NO: 295398 - DNA, 619 bp, Homo sapiens
  misc_feature: GYAE6OF01A6WM4.44.1.A01.1.454.CMB.1.raw
  modified_base (205)..(205): a, c, t, g, unknown or other
  misc_feature (205)..(205): n is a, c, g, or t
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactgggtgaagccttcggagaccctgtccctnacctgcactgtctcgtggtggctccatcagcagtagtagttactacgtgggctggactccgccacgcccccgaggggaacgggctgggacgtggagttgggagtatctattagtagtgggagcacctactaccaacccgtcctacaagagtcgagtacacatatacgagtacgaacacgtaccaagaacctacgtttcctaccctagaacgtctagaacgtccttcgtggttccgaacccggccggaccggaccgaccgggtccgttaggttacttacgtggtcggacggtaagtaggttacgggcgtacggttccgtaccgtaacctaacgttacgtttcgacccgtaggtccggggacccgaacgggtaacccgtcgggtacccaccggttacctcccgtccgcgtaccccg

SEQ ID NO: 295399 - DNA, 556 bp, Homo sapiens
  misc_feature: GYAE6OF01AR0E7.44.1.A01.1.454.CMB.1.raw
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggactccgccacgcccccgaggggaaggggctgggagtggagttgggagtatctattagtagtgggagcacctaactaccaacccgtccctcaagagtcgagtacaccatatcagtagacacgtaccaagaacctagttcctcccagaacgctgagctctgtcgccgccgcggacacggccgtgtattctgtcgcgagaggtggctaggttccgtcaccctaactacgttcgaccgtacggtacggggcccaacggggaacccttcgggtacccaccggttcctccctgtaccgtccccg

SEQ ID NO: 295400 - DNA, 386 bp, Homo sapiens
  misc_feature: GYAE6OF01COEGW.44.1.A01.1.454.CMB.1.raw
  modified_base (366)..(366): a, c, t, g, unknown or other
  misc_feature (366)..(366): n is a, c, g, or t
  modified_base (374)..(386): a, c, t, g, unknown or other
  misc_feature (374)..(386): n is a, c, g, or t
tcagacagtatatacacgaccggtgctcgatttagacgtctcatcagggccttaggggcattccctggtatcagcagaaaccagggaatgcccctaaggtcctgatctataaggcgtctagttttagaaagtggggtcccatcaaggttcagcggcagtggatctgggacagaattcactctcaccatcagcagcctgcagcctgatgattttgctaacttattactgtacaaaagtacaacagtcgcccctcacctactttcggccctgggacccaaagtggataatcaaacgaactgtggctgcaccatctgtcttcatccttccgcctatcctgatatatactgtctgagcggctgcgaggcnctagtagnnnnnnnnnnnnn

SEQ ID NO: 295401 - DNA, 537 bp, Homo sapiens
  misc_feature: GYAE6OF01A7MN6.44.1.A01.1.454.CMB.1.raw
  modified_base (484)..(484): a, c, t, g, unknown or other
  misc_feature (484)..(484): n is a, c, g, or t
  modified_base (487)..(488): a, c, t, g, unknown or other
  misc_feature (487)..(488): n is a, c, g, or t
  modified_base (491)..(491): a, c, t, g, unknown or other
  misc_feature (491)..(491): n is a, c, g, or t
  modified_base (493)..(537): a, c, t, g, unknown or other
  misc_feature (493)..(537): n is a, c, g, or t
tcagacagtatatacacgaccggtgctcgatttagacgtctcatcagggccttaggggcattccctggtatcagcagaaaccagggaatgcccctaaggtccctgatctataaggcgtctagtttagaaagtgggtcccatcaaggttcagcggcagtggatctgggacagaattcactctcaccatccagcagcctgcagcctgatgattttgctaacttattactgccaacagtaataacgagtttattccgtctaggtagtttttcgggcccgtaagggggtacccaaaggtccgttagggaacgaacttaccaaaaacggaaacccgttagtcgggccttcggaccaacccattccgttcggtcctttcaacttccctttcccccggcctaacttccgtacgaattacttaacttaacctcggttccttggaacggtccggggtcctacgggtaccgaaaggggtccgtacctaagtagntcnntcncnnnnnnnnnnnnnnnnnnnnnnnnnnnnnnnnnnnnnnnnnnnnn

SEQ ID NO: 295402 - DNA, 372 bp, Homo sapiens
  misc_feature: GYAE6OF01C3J2H.44.1.A01.1.454.CMB.1.raw
  modified_base (365)..(372): a, c, t, g, unknown or other
  misc_feature (365)..(372): n is a, c, g, or t
tcagacagtatatacacgaccggtgctcgatttagacgtctcatcagggccttagggcattccctggtatcagcagaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttattactgccaacagtataagacgttattctcagagttttggaccagggtaccaagtctggagatcaaacgaactgagctgcaccatctgtcttcatcttcccgcatctgatactatacctgtactgagcgggctggctaaggcgcatgnnnnnnnn

SEQ ID NO: 295403 - DNA, 369 bp, Homo sapiens
  misc_feature: GYAE6OF01EHC7K.44.1.A01.1.454.CMB.1.raw
  modified_base (362)..(369): a, c, t, g, unknown or other
  misc_feature (362)..(369): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttatactgccaaacagtataagagttattctcagagttttggccaggggaccaagctgagatcaaacgaactgtaggctgcaccatctgtcttcatctcccgcatctgatatatactgtctgagcgggctggcaaggcgcatagnnnnnnnn

SEQ ID NO: 295404 - DNA, 388 bp, Homo sapiens
  misc_feature: GYAE6OF01CG1FO.44.1.A01.1.454.CMB.1.raw
  modified_base (130)..(130): a, c, t, g, unknown or other
  misc_feature (130)..(130): n is a, c, g, or t
  modified_base (216)..(216): a, c, t, g, unknown or other
  misc_feature (216)..(216): n is a, c, g, or t
  modified_base (291)..(291): a, c, t, g, unknown or other
  misc_feature (291)..(291): n is a, c, g, or t
  modified_base (300)..(300): a, c, t, g, unknown or other
  misc_feature (300)..(300): n is a, c, g, or t
  modified_base (360)..(388): a, c, t, g, unknown or other
  misc_feature (360)..(388): n is a, c, g, or t
tcagacagtatatacacgaccggtgctcgatttagacgtctcatcagggttcagcggcagtggatctgggacagaattcactctcaccatcagcagcctgcagcctgatgtattttgactaattattacncgaccaaacaagttaataaagtagtttaacttctacgtaaggttacggtttggacccggaacgggggaaccaaggccgtagggganaacgtaaaccaaaacggtaacgtggtgggactacggccaaacctgttcgtattccttctaacttcccgttacccnctatcgtanaacttattaactcgttcgtgtacggcgggcggcggtaggaccgaaggccgtagaatggcnnnnnnnnnnnnnnnnnnnnnnnnnnnnn

SEQ ID NO: 295405 - DNA, 805 bp, Homo sapiens
  misc_feature: GYAE6OF01AZ73I.44.1.A01.1.454.CMB.1.raw
tcagacagtatatacacgaccggtgctcgatttagacgtctcatcaggggacccaacaaccacatccctcctcagaacgcccccaggagcacaactcctacaccatcggactggacctggaggattccttcgtttttggtggcagcacgaccacgaggtcgcccacctcccgagtcccagtcttgtgactaggtcggtggggtctaggagggtagaaggacgcccggtgggtcctacgacggttacggtaacgtttccgtaggacgtaacggttcctttacgtacgtacttaaccgtaccttagtaaatttagttagtctacctagtacgtcgtagggtcggtacgcccggacccgtacccgggaacccccggtaacgtaacggttaccggttaggaacgggtagggtaacgggtagggtagtcggtaacgtaaccggtaaccgggtcgtacgggtactaagggttacggacgtaaacggaaccaaacggttaacttaacttaaccggaaacgtaacgttaaaccgggtttcggaaaccggtaagtaaccgtaaaccgtacccgtaaaccgttaccgtaaaccgaaccgtaaccgtaacccgaacgtacccgtaacccggacgaacccgtaaccgaccgtaactaccgtaccgtacgacggtacgttacggacgaccgtacgaccgtccgtacgtaacgtataccgaagacggtacgagttaccgtagtacgttacgttagtagaggtaggagggtagggaagggtacgtacgtacgtacgtacttactatactacgtagtaacg

SEQ ID NO: 295406 - DNA, 649 bp, Homo sapiens
  misc_feature: GYAE6OF01AWG73.44.1.A01.1.454.CMB.1.raw
  modified_base (237)..(237): a, c, t, g, unknown or other
  misc_feature (237)..(237): n is a, c, g, or t
  modified_base (516)..(516): a, c, t, g, unknown or other
  misc_feature (516)..(516): n is a, c, g, or t
  modified_base (524)..(524): a, c, t, g, unknown or other
  misc_feature (524)..(524): n is a, c, g, or t
  modified_base (533)..(533): a, c, t, g, unknown or other
  misc_feature (533)..(533): n is a, c, g, or t
  modified_base (542)..(542): a, c, t, g, unknown or other
  misc_feature (542)..(542): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (557)..(557): a, c, t, g, unknown or other
  misc_feature (557)..(557): n is a, c, g, or t
  modified_base (612)..(612): a, c, t, g, unknown or other
  misc_feature (612)..(612): n is a, c, g, or t
  modified_base (637)..(637): a, c, t, g, unknown or other
  misc_feature (637)..(637): n is a, c, g, or t
tcagacagtatatacacgaccggtgctcgatttagacgtctcatcagggccttaggggcattccctggtatcagcagaaaccagggaatgcccctaaggtcctgatctataggcgtctagtttagaagtgggtcccatcaaggttcaggcggcagtggatctggacagaattcactctcaccatcgagccagccctgcacgcctgattgattttgacctaacttatactcgaccaanacgttaataagtgttatcgtacgagttagtttcggaccgtaacgggacccaaggccttagggacgaacttaccgaaaaacggaacgttgttagggacctttcggaccctaaccgacgtttacctcggttacctttccgttaacctttccccgttccccccggaccttacgttacccggttcgaaacgtttaccttaagttaccgttacgttcggtacggtaccgggtccgggtcgttacggaacggtaacccggcggtagtaactaacgagttccaagngttacatntgtcacgtnagtgatacnggtntactancgtcnctcgacgtatcgtcgacgcgtacgtacatactacgtacgtgtacgtcggtacgtnttcgacgtagtagtcgtccgagtanactacgtagtcg

SEQ ID NO: 295407 - DNA, 366 bp, Homo sapiens
  misc_feature: GYAE6OF02GY6A5.44.1.A01.1.454.CMB.1.raw
  modified_base (363)..(366): a, c, t, g, unknown or other
  misc_feature (363)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatatctttttatccgtacagttttggccaggggaccaagctggagatcaaaggaactgtggctgcaccatctgtcttcatcttcccgccatctgatatatactgtctgagcgggctggcaaggcgcatagnnnn

SEQ ID NO: 295408 - DNA, 365 bp, Homo sapiens
  misc_feature: GYAE6OF02GUTVO.44.1.A01.1.454.CMB.1.raw
  modified_base (363)..(365): a, c, t, g, unknown or other
  misc_feature (363)..(365): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaaggcgcatagnnn

SEQ ID NO: 295409 - DNA, 370 bp, Homo sapiens
  misc_feature: GYAE6OF02GR7M8.44.1.A01.1.454.CMB.1.raw
  modified_base (364)..(370): a, c, t, g, unknown or other
  misc_feature (364)..(370): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgccatctgatatatactgtctgagcgggctggcaaggcgcatagnnnnnnn

SEQ ID NO: 295410 - DNA, 363 bp, Homo sapiens
  misc_feature: GYAE6OF02GJVN8.44.1.A01.1.454.CMB.1.raw
  modified_base (361)..(363): a, c, t, g, unknown or other
  misc_feature (361)..(363): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgactgtggctgcaccatctgtcttcatcttcccgcatctgatatatactgtctgagcggctggcaaggcgcatagnnn

SEQ ID NO: 295411 - DNA, 366 bp, Homo sapiens
  misc_feature: GYAE6OF02GHAGB.44.1.A01.1.454.CMB.1.raw
  modified_base (363)..(366): a, c, t, g, unknown or other
  misc_feature (363)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgactgtggctgcaccatctgtcttcatcttcccgccatctgatatatactgtctgagcgggctggcaaggcgcatagnnnn

SEQ ID NO: 295412 - DNA, 368 bp, Homo sapiens
  misc_feature: GYAE6OF02IVVWK.44.1.A01.1.454.CMB.1.raw
  modified_base (248)..(248): a, c, t, g, unknown or other
  misc_feature (248)..(248): n is a, c, g, or t
  modified_base (363)..(368): a, c, t, g, unknown or other
  misc_feature (363)..(368): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagatttcactctcaccgtcagcagcctgcagcctgaagatgttgcaacttattactgtcaaaagtataacagtgcccctnacactttcggccctgggaccacagtggatatcaagcgaactgtggctgcaccatctgtcttcatcttcccgccatctgatatatactgtctgagcgggctggcaaggcgcatagnnnnnn

SEQ ID NO: 295413 - DNA, 366 bp, Homo sapiens
  misc_feature: GYAE6OF02IYVRK.44.1.A01.1.454.CMB.1.raw
  modified_base (361)..(366): a, c, t, g, unknown or other
  misc_feature (361)..(366): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatatctttttatccgtacagttttggccaggggaccaagctggagatcaaaggactgtggctgcaccatctgtcttcatcttcccgcatctgatatatactgtctgagcgggctggcaaggcgcatagnnnnnn

SEQ ID NO: 295414 - DNA, 371 bp, Homo sapiens
  misc_feature: GYAE6OF02IWS46.44.1.A01.1.454.CMB.1.raw
  modified_base (364)..(371): a, c, t, g, unknown or other
  misc_feature (364)..(371): n is a, c, g, or t
tcagacagtatatacacgaccggtgctcgatttagacgtctcatcagggccttagggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaaagaactgtggctgcaccatctgtcttcatcttcccgccatctgatatatactgtctgagcggctggcaaaggcgcaatagnnnnnnnn

SEQ ID NO: 295415 - DNA, 307 bp, Homo sapiens
  misc_feature: GYAE6OF02HAECM.44.1.A01.1.454.CMB.1.raw
  modified_base (274)..(274): a, c, t, g, unknown or other
  misc_feature (274)..(274): n is a, c, g, or t
  modified_base (280)..(307): a, c, t, g, unknown or other
  misc_feature (280)..(307): n is a, c, g, or t
tcagacagtatatacacgaccggtgctcgatttagacgtctcatcgagggggtcccctcgaggttcagtggcgagtggatctgcgacagatttcaccctcaccatcaatagcctggaagctgaagatgctgcaacgtattactgtcatcagagtagtagttacctcggcacttttggccaggggaccaagctggagatcaaacgactgtggctgcaccatctgtcttcatcttccgccatctgatatatactgtctgagcgggctggcaaggcncatagnnnnnnnnnnnnnnnnnnnnnnnnnnnn

SEQ ID NO: 295416 - DNA, 363 bp, Homo sapiens
  misc_feature: GYAE6OF02FF0IS.44.1.A01.1.454.CMB.1.raw
  modified_base (362)..(363): a, c, t, g, unknown or other
  misc_feature (362)..(363): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgactgtggctgcaccatctgtcttcatcttcccgccatctgatatatactgtctgagcgggctggcaaggcgcatagnn

SEQ ID NO: 295417 - DNA, 364 bp, Homo sapiens
  misc_feature: GYAE6OF02IAMJE.44.1.A01.1.454.CMB.1.raw
  modified_base (361)..(364): a, c, t, g, unknown or other
  misc_feature (361)..(364): n is a, c, g, or t
tcagacagtatatacacgaccggtgctcgatttagacgtctcatcagggccttagggcattccctggtatcagcagaaaccagggaatgcccctaaggtcctgatctataaggcgtctagtttagaaagtggggtcccatcaaggttcagcggcagtggatctgggacagatttcactctcaccatcagcagtctgcaacctgatgattttgcaacttattactgccaacagtataagagttattctcagagttttggccaggggaccaagctggagatcaaacgaactgtggctgcaccatctgtcttcatcttcccgcatctgatatatactgtctgagcgggctggcaggcgcatagnnnn

SEQ ID NO: 295418 - DNA, 367 bp, Homo sapiens
  misc_feature: GYAE6OF02GA69D.44.1.A01.1.454.CMB.1.raw
  modified_base (364)..(367): a, c, t, g, unknown or other
  misc_feature (364)..(367): n is a, c, g, or t
tcagacagtatatacacgaccggtgctcgatttagacgtctcatcagggccttaggggcattccatggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccatctgtcttcatcttcccgccatctgatatatactgtctgagcgggctggcaaggcgcatagnnnn

SEQ ID NO: 295419 - DNA, 373 bp, Homo sapiens
  misc_feature: GYAE6OF02JVHK3.44.1.A01.1.454.CMB.1.raw
  modified_base (362)..(373): a, c, t, g, unknown or other
  misc_feature (362)..(373): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacacatttcactctcaccatcagcagcctgcagcctggagatttcgcgacttattactgccaacaatatctttttatccgttacagttttggcctaggggaccaagctggagatcaaaggaactgtggctgcacatctgtctcatcttccgcatctgatatatactgtctgagcgggctggcaaggcgacatagnnnnnnnnnnnn

SEQ ID NO: 295420 - DNA, 536 bp, Homo sapiens
  misc_feature: GYAE6OF02HWHP5.44.1.A01.1.454.CMB.1.raw
tcagacagtatatacacgaccggtgctcgatttagacgtctcatcaggggacccaacaaccacatccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcaatatttatgctatgcagtgggtgcgccaggcccccggacaaaggcttgagtggatgggatggatcgaacgctggcaatggtgacacaagatattacacagaagttccagggcagagtcacattaccagcgacacatccgcgagcacagcctacatggagctgagcagcctagagatcgtagaacgacgacggctagtaattattattgtaggacggtaaggaacgggtaagggaaggtaagttaggaacgttacgggtaaaccttacccgttacttaacgttacctaacg

SEQ ID NO: 295421 - DNA, 441 bp, Homo sapiens
  misc_feature: GYAE6OF02JYN0Y.44.1.A01.1.454.CMB.1.raw
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (413)..(413): a, c, t, g, unknown or other
  misc_feature (413)..(413): n is a, c, g, or t
  modified_base (423)..(441): a, c, t, g, unknown or other
  misc_feature (423)..(441): n is a, c, g, or t
tcagacagtatatacacgaccggtgctcgatttagacgtctcatcagggccttagggcagttccatggtatcagcagaaccagggaatgcccctaaggtcctgatctataaggcgtctagtttagaaagtggggtcccagtcaaggttcagcggcagtggatctgggacaggaattcactctcaccatcagcagcctgcagcctgatgattttggcaacttattactgacctaacagtataaagagtttaattctcagtagttttaggcctaggggaccctaaaggccttagggaatatcgaaaacgaattggtaggctaggcaaaccntctgtccttcatccttccgcctagtcctgattntactactgtactggtacgcgggtactcgggctaagggcctacgaagttagntcagtcagtnnnnnnnnnnnnnnnnnnn

SEQ ID NO: 295422 - DNA, 614 bp, Homo sapiens
  misc_feature: GYAE6OF02G27MI.44.1.A01.1.454.CMB.1.raw
tcagacagtatatacacgaccggtgctcgatttagacgtctcatcaaaggaaggaagggtaccctgagactctcctgtgcagcctctggattcaccttcaggtagctactggatgcactgggtccgccaagctccacggaaagggcctgatgtgggtctcacgtattaacaccgatgggactatcactggttactcagacgccgtgaagggccgattcatcatctccagacgacaatgtcgaaaacacggtgtaattacaaatgaacagtctaagagtcgaggacacggctgtctactattgtgtgagaccttatgatttcacttgggggattatcgttgggccacactggggccagggaccttggtcgtcgtctcctcacgcttccaccaagggccccagtccggtccttcccccgtggccgccctgcctccgacggacgccaccttcgtcgggggccaccgacgccggccccgtggggcctcggcccgttgggtccgaaagggtaccttaccgttcccgttacggtaacttccggtacgtttccgtcgggtaacggtccgggggaccttcggggaccgtaaacgggtccggaccgtaacgttacggctgtcg

SEQ ID NO: 295423 - DNA, 532 bp, Homo sapiens
  misc_feature: GYAE6OF02G09KD.44.1.A01.1.454.CMB.1.raw
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagtagtagttactactggggctggatccgccacgcccccagggaagggctggagtggagttgggagtatctattatagtgggagcacctactacaacccgtccctcaagagtcgagtcaccatatcagtagacacgtaccaagaaccagttcctccctgaagctagagctctgtcgaccgccgcggacaccggtccgtttattctgtcgcgaggcgagacttggtctttacatcgtagtcggggtccgtcggcctacccgtggtccacgttcgtctccgtcacgtccttccaacccgg

SEQ ID NO: 295424 - DNA, 365 bp, Homo sapiens
  misc_feature: GYAE6OF02G2PSP.44.1.A01.1.454.CMB.1.raw
  modified_base (362)..(365): a, c, t, g, unknown or other
  misc_feature (362)..(365): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatatctttttatccgtacagttttggccaggggaccaagctggagatcaaaggaactgtggctgcaccatctgtcttcatcttcccgcatctgatatatactgtctgagcgggctggcaaggcgcatagnnnn

SEQ ID NO: 295425 - DNA, 364 bp, Homo sapiens
  misc_feature: GYAE6OF02IA0F1.44.1.A01.1.454.CMB.1.raw
  modified_base (361)..(364): a, c, t, g, unknown or other
  misc_feature (361)..(364): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgattttgcaacttattactgccaacagtaataagagttattctcagagtttttggccaggggaccaagctggagatcaaacgaactgtggctgcaccatctgtcttcatcttcccgcatctgatatatactgtctgagcggctggcaagcgcatgnnnn

SEQ ID NO: 295426 - DNA, 381 bp, Homo sapiens
  misc_feature: GYAE6OF02ING35.44.1.A01.1.454.CMB.1.raw
  modified_base (366)..(381): a, c, t, g, unknown or other
  misc_feature (366)..(381): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagtttttggccaggggaccaaagctggagatcaaacgaactgtggctgcaccatctgtcttcatcttcccgccatctgatatatactgtctgagcgggctggcaaggcgcatagnnnnnnnnnnnnnnnn

SEQ ID NO: 295427 - DNA, 368 bp, Homo sapiens
  misc_feature: GYAE6OF02IXL9X.44.1.A01.1.454.CMB.1.raw
  modified_base (74)..(74): a, c, t, g, unknown or other
  misc_feature (74)..(74): n is a, c, g, or t
  modified_base (363)..(368): a, c, t, g, unknown or other
  misc_feature (363)..(368): n is a, c, g, or t
tcagacagtatatacacgaccggtgctcgatttagacgtctcatcagggccttaggggcattccctggtatcancagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattatcagagttttggccaggggaccaagctggagatcaaacgaactgtggctgcaccatctgtcttcatcttcccgcatctgatatatactgtctgagcgggctggcaaggcgcatagnnnnnn

SEQ ID NO: 295428 - DNA, 381 bp, Homo sapiens
  misc_feature: GYAE6OF02IK46U.44.1.A01.1.454.CMB.1.raw
  modified_base (367)..(381): a, c, t, g, unknown or other
  misc_feature (367)..(381): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgactgtggctgcacatctgtcttcatccttcccgcctatcctgatatatactgtctgagcgggctggcaaggcgacagtagnnnnnnnnnnnnnnn

SEQ ID NO: 295429 - DNA, 519 bp, Homo sapiens
  misc_feature: GYAE6OF02IZEZ7.44.1.A01.1.454.CMB.1.raw
  modified_base (418)..(418): a, c, t, g, unknown or other
  misc_feature (418)..(418): n is a, c, g, or t
  modified_base (513)..(513): a, c, t, g, unknown or other
  misc_feature (513)..(513): n is a, c, g, or t
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtcccctcacctgcactgtctctggtgctccatcagcagtagtagttactactggggctggatccgccagcccccagggagggctggagtggattgggagtatctattatagtgggagcactactacaacccgtcctcaagagtcgagtcaccatatcagtagacacgtaccaagaaccagttcctccctgaacgctgagctctgtcgaccgccgcggacnccggccgtgtacttctgtgcgagagtagggcagttcgcaccacttactttagacctacgtcggggccacgggtaccctggtccaccgtctcctcncgtccc

SEQ ID NO: 295430 - DNA, 375 bp, Homo sapiens
  misc_feature: GYAE6OF02F2A2F.44.1.A01.1.454.CMB.1.raw
  modified_base (370)..(375): a, c, t, g, unknown or other
  misc_feature (370)..(375): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgctaacttattactgccaacagtataagagttattctcagagttttggccaggggaccaagctggagatcaaacgaactgtggctgcaccatctgtcttcatcttcccgccatctgtatatatactgtctgaggcggctggacaaggtcgacagtagnnnnnn

SEQ ID NO: 295431 - DNA, 372 bp, Homo sapiens
  misc_feature: GYAE6OF02GMHPO.44.1.A01.1.454.CMB.1.raw
  modified_base (363)..(372): a, c, t, g, unknown or other
  misc_feature (363)..(372): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatacaaacgaactgtggctgcaccatctgtcttcatctcccgccatctgatatatactgtctgagcggctggcaaggcgcatagnnnnnnnnnn

SEQ ID NO: 295432 - DNA, 543 bp, Homo sapiens
  misc_feature: GYAE6OF02FZTVL.44.1.A01.1.454.CMB.1.raw
  modified_base (343)..(343): a, c, t, g, unknown or other
  misc_feature (343)..(343): n is a, c, g, or t
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccggcagccccccagggaggggaatggagtggattggtgacatccattatactggggcgacgtactactctccgtccctcaagngtcgtctcactatttcgaggacacgtccatgaaccgcttctcctagaactcgacctccgtcgacccgccgcgacgacggtccgtttattctgtcgcgtagcgagacttggtctttcaactctagtcggggccgttggcctacccgttggtcctacgtcgtccttcctccgcgtccttccacccgtacggtccctaaccgg

SEQ ID NO: 295433 - DNA, 362 bp, Homo sapiens
  misc_feature: GYAE6OF02ICUWL.44.1.A01.1.454.CMB.1.raw
  modified_base (355)..(355): a, c, t, g, unknown or other
  misc_feature (355)..(355): n is a, c, g, or t
  modified_base (361)..(362): a, c, t, g, unknown or other
  misc_feature (361)..(362): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataaagagttattctcagagttttggccaggggacaagctgagatcaaacgaactgtggctgcaccatctgtcttcatcttcccgcatctgatatatactgtctgagcggctggcaaggcncatagnn

SEQ ID NO: 295434 - DNA, 370 bp, Homo sapiens
  misc_feature: GYAE6OF02F2JDS.44.1.A01.1.454.CMB.1.raw
  modified_base (252)..(252): a, c, t, g, unknown or other
  misc_feature (252)..(252): n is a, c, g, or t
  modified_base (364)..(370): a, c, t, g, unknown or other
  misc_feature (364)..(370): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgaagattttgcaacttactactgtcaacagagttatactgcccccgttnacgttttggtcgggggaccaagctggagatcaaacgaactgtggctgcacatctgtcttcatccttccgccatctgatatatactgtctgagcggctggcaaggcgcatagnnnnnnn

SEQ ID NO: 295435 - DNA, 395 bp, Homo sapiens
  misc_feature: GYAE6OF02I3G8R.44.1.A01.1.454.CMB.1.raw
  modified_base (335)..(335): a, c, t, g, unknown or other
  misc_feature (335)..(335): n is a, c, g, or t
  modified_base (380)..(395): a, c, t, g, unknown or other
  misc_feature (380)..(395): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtgggtcccatcaaggttcagcggcagtggatctgggacagaattcactctcaccatcagcagcctgcagcctgatgtattttgctaacttattactgaccaaacagtaataagtagttattctcagtagttttggaccgaggggaccaagctaggagatacaaacgaactggtgctgcacatctgtcttcatcctccgctatctnactatatactgtctgaggcggctggaccgaaggccgacaagtagnnnnnnnnnnnnnnnn

SEQ ID NO: 295436 - DNA, 365 bp, Homo sapiens
  misc_feature: GYAE6OF02FS3M0.44.1.A01.1.454.CMB.1.raw
  modified_base (362)..(365): a, c, t, g, unknown or other
  misc_feature (362)..(365): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagagttttggccaggggaccaagctggagatcaaacgaactgtggctgcaccgatctgtcttcatcttccgccatctgatatatactgtctgagcggctggcaggcgcatagnnnn

SEQ ID NO: 295437 - DNA, 383 bp, Homo sapiens
  misc_feature: GYAE6OF02GXSK5.44.1.A01.1.454.CMB.1.raw
  modified_base (377)..(383): a, c, t, g, unknown or other
  misc_feature (377)..(383): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaaacaattattcttttttatccgtactagttttggccaggggaccaagctggagatacaaagactgtgctgcaccatctgtcttcacttccttacccgcctatctagatatattactgtctgtggcggtctggacaagggcacgatagnnnnnnn

SEQ ID NO: 295438 - DNA, 375 bp, Homo sapiens
  misc_feature: GYAE6OF02IE966.44.1.A01.1.454.CMB.1.raw
  modified_base (371)..(375): a, c, t, g, unknown or other
  misc_feature (371)..(375): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagtagttttggcctagggggaccaagctggagatacaaacgaactggtgctgcacctatctgtcttcatcttcccgcatctgatatatactgtctgacgcgggctggcaaggcgtacatagnnnnn

SEQ ID NO: 295439 - DNA, 372 bp, Homo sapiens
  misc_feature: GYAE6OF02F1K83.44.1.A01.1.454.CMB.1.raw
  modified_base (364)..(372): a, c, t, g, unknown or other
  misc_feature (364)..(372): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagtagttttggccaggggaccaagctggagatcaaaacgaactgtggctgcacatctgtcttcatcttcccgccatctgatatatactgtctgagcggctggcaaggcgcatagnnnnnnnnn

SEQ ID NO: 295440 - DNA, 570 bp, Homo sapiens
  misc_feature: GYAE6OF02G08O1.44.1.A01.1.454.CMB.1.raw
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
  modified_base (452)..(452): a, c, t, g, unknown or other
  misc_feature (452)..(452): n is a, c, g, or t
tcagacagtatatacacgaccggtgctcgatttagacgtctcatcaggggatgctttctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactacgtggggctggatccgccacgcccccgagggacgggctgggagtggagttgggagtntcgtattagtagtggagtcacctactaccacccgtcctacaagacgtcgacgtcacatactcagtacacacgtaccaagaacctagttcctccctagaacgcaganctcgtgtacgacccgccgcgaccgcggtccgtgttacttcgngtgcgagagtagggactacgttcgaccgaccctaacttacgttacggtaacctacggttccggggacctaacgggtacccgtcggtacccgtaccgtcctacccgtcaccgtaccccg

SEQ ID NO: 295441 - DNA, 633 bp, Homo sapiens
  misc_feature: GYAE6OF02JC9YR.44.1.A01.1.454.CMB.1.raw
  modified_base (275)..(275): a, c, t, g, unknown or other
  misc_feature (275)..(275): n is a, c, g, or t
tcagacagtatatacacgaccggtgctcgatttagacgtctcatcagggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggcaaacgcccccaaatcatgattcatgatgtcagtaatcggccctnaggggtttctggtcgcttctctggctccagtctggacaacgacggcctcccgtagacctatctcgtggcctccaggctggaggacgaggtctgacctagttacgtgcacgctactaataaataaaagagaccaactacttagtttatacgttcgggacggacgggaaccaagtccgtacggacccgttaccgtacggtaccaccggacccgaaagggtcccgtacccggtccccccgtttacgggtaccctaccgttacccgtcccgggtttcccccccgtccccgttacccttacctttaactttacccgttaccttcggttcccgtaggtccgggtacccggggtccttaccgggg

SEQ ID NO: 295442 - DNA, 380 bp, Homo sapiens
  misc_feature: GYAE6OF02HATIP.44.1.A01.1.454.CMB.1.raw
  modified_base (321)..(321): a, c, t, g, unknown or other
  misc_feature (321)..(321): n is a, c, g, or t
  modified_base (367)..(380): a, c, t, g, unknown or other
  misc_feature (367)..(380): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatattcttttttatccgtatagttttggccaggggaccaagctggagatcaaaggaactgtaggctgcaccatctgtctcatccttccnctatctgatatatctgtctgagcgggctggacgaaggcgcataggnnnnnnnnnnnnnn

SEQ ID NO: 295443 - DNA, 365 bp, Homo sapiens
  misc_feature: GYAE6OF02GX9V2.44.1.A01.1.454.CMB.1.raw
  modified_base (357)..(357): a, c, t, g, unknown or other
  misc_feature (357)..(357): n is a, c, g, or t
  modified_base (362)..(365): a, c, t, g, unknown or other
  misc_feature (362)..(365): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagtagttttggccaggggaccaagctaggagatcaaacgactgtggctgcaccatctgtcttcatcttcccgcatctgatatatactgtctgagcggctggcaggcgnatagnnnn

SEQ ID NO: 295444 - DNA, 285 bp, Homo sapiens; identical to SEQ ID NO: 295362
  misc_feature: GYAE6OF02F36L5.44.1.A01.1.454.CMB.1.raw
  modified_base (280)..(285): a, c, t, g, unknown or other
  misc_feature (280)..(285): n is a, c, g, or t

SEQ ID NO: 295445 - DNA, 293 bp, Homo sapiens
  misc_feature: GYAE6OF02GNCH3.44.1.A01.1.454.CMB.1.raw
  modified_base (220)..(220): a, c, t, g, unknown or other
  misc_feature (220)..(220): n is a, c, g, or t
  modified_base (283)..(293): a, c, t, g, unknown or other
  misc_feature (283)..(293): n is a, c, g, or t
tcagacagtatatacacgaccggtgctcgatttagacgtctcatcaggggtcccctcgaggttcagtggcagtggatctgcgacagatttcaccctcaccatcaatagcctggaagctgaagatgctgcaacgtattactgtcatcagagtagtagttacctcggcacttttggccaggggaccaaagctggagatcaaacgaaactgtgcctgcaccanctgtcttcatcttccgccatctgatatataactgtctgagcgggctggcaaaggcgcataagnnnnnnnnnnn

SEQ ID NO: 295446 - DNA, 374 bp, Homo sapiens
  misc_feature: GYAE6OF02HX2K1.44.1.A01.1.454.CMB.1.raw
  modified_base (366)..(374): a, c, t, g, unknown or other
  misc_feature (366)..(374): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgctaacttattactgccaacagtaataagagttattctcagagttttggcctagggaccaagctggagatcaaacgactgtgctgcacatctgtcttcatcttcccgctatctgtatataatctatctgagcggtctggcaaggcgactatagnnnnnnnnn

SEQ ID NO: 295447 - DNA, 383 bp, Homo sapiens
  misc_feature: GYAE6OF02GQ49A.44.1.A01.1.454.CMB.1.raw
  modified_base (342)..(342): a, c, t, g, unknown or other
  misc_feature (342)..(342): n is a, c, g, or t
  modified_base (345)..(345): a, c, t, g, unknown or other
  misc_feature (345)..(345): n is a, c, g, or t
  modified_base (370)..(383): a, c, t, g, unknown or other
  misc_feature (370)..(383): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctggagatttcgcgacttattactgccaacaatatcttttttatccgtacagttttggccaggggaccaaagctggagatacaaacgaactgtggctgccaccatctagtcttcatcttcccgcctatctgatatatactntcngagcgggctggcaaggcacagtagnnnnnnnnnnnnnn

SEQ ID NO: 295448 - DNA, 448 bp, Homo sapiens
  misc_feature: GYAE6OF02G1J1L.44.1.A01.1.454.CMB.1.raw
  modified_base (200)..(200): a, c, t, g, unknown or other
  misc_feature (200)..(200): n is a, c, g, or t
  modified_base (238)..(238): a, c, t, g, unknown or other
  misc_feature (238)..(238): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (425)..(448): a, c, t, g, unknown or other
  misc_feature (425)..(448): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcancctgatgtattttgactaactttattactgacccaaanagtaataaggtatttacttctacgaagttaggttttcgggacccgaggggaaccaagctggaagtatacgaaaacgtactggtaggctagcacctaattctgtccttcacgttcccttcccgccattcgtacgtaatactattacngttcctggtacggnggtcgtagcgaagggtcactaagtgannnnnnnnnnnnnnnnnnnnnnnn

SEQ ID NO: 295449 - DNA, 416 bp, Homo sapiens
  misc_feature: GYAE6OF02G10KZ.44.1.A01.1.454.CMB.1.raw
  modified_base (314)..(314): a, c, t, g, unknown or other
  misc_feature (314)..(314): n is a, c, g, or t
  modified_base (320)..(320): a, c, t, g, unknown or other
  misc_feature (320)..(320): n is a, c, g, or t
  modified_base (390)..(390): a, c, t, g, unknown or other
  misc_feature (390)..(390): n is a, c, g, or t
  modified_base (399)..(400): a, c, t, g, unknown or other
  misc_feature (399)..(400): n is a, c, g, or t
  modified_base (402)..(416): a, c, t, g, unknown or other
  misc_feature (402)..(416): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgtattttgctaaactttattactgacccaaactaagtaataagtagttattctactagtaggttttggaccgaggggaccaagcgtggagatacaaacgactggtgcngccacnctctcgtcttcacttcctcccgctctctagatatactacgtgtcgtgacggcggtacgtcggtacacggngcgtatcgnngnnnnnnnnnnnnnnn

SEQ ID NO: 295450 - DNA, 403 bp, Homo sapiens
  misc_feature: GYAE6OF02G4G5F.44.1.A01.1.454.CMB.1.raw
  modified_base (389)..(403): a, c, t, g, unknown or other
  misc_feature (389)..(403): n is a, c, g, or t
tcagacagtatatacacgaccggtgctcgatttagacgtctcatcagggccttaggggcattccctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgctaacttattactgccaactagtataagagttattctacagtagttttggccaagggggaccaagctagggacattacgaaaacgaactggtaggctggccaccatctagtcttcattccttcccgcatctgatatatactgtctgacggcggctaggcgaaggctacaagtacgnnnnnnnnnnnnnnn

SEQ ID NO: 295451 - DNA, 678 bp, Homo sapiens
  misc_feature: GYAE6OF02H28Q4.44.1.A01.1.454.CMB.1.raw
  modified_base (239)..(239): a, c, t, g, unknown or other
  misc_feature (239)..(239): n is a, c, g, or t
  modified_base (539)..(539): a, c, t, g, unknown or other
  misc_feature (539)..(539): n is a, c, g, or t
  modified_base (541)..(541): a, c, t, g, unknown or other
  misc_feature (541)..(541): n is a, c, g, or t
  modified_base (553)..(553): a, c, t, g, unknown or other
  misc_feature (553)..(553): n is a, c, g, or t
  modified_base (585)..(585): a, c, t, g, unknown or other
  misc_feature (585)..(585): n is a, c, g, or t
  modified_base (596)..(596): a, c, t, g, unknown or other
  misc_feature (596)..(596): n is a, c, g, or t
tcagacagtatatacacgaccggtgctcgatttagacgtctcatcagggccgttaggggcattccctggtatcagcagaaccaggaatgcccctaaggtcctgatctataggcgtctagtttagaagtgggtcccatcgaaggttcagcggcagtggatcgtgggacagaattcactctaccaccgatccagcagcctgctagcctgagtgtacttttgacctaagtttacttaacgtnacccgtaaataacgttaataaaggttacgttatttccttagtaggttaggttttcgggacccggaaggggaaccctaggaccggtggtacggtaattacccaaaacggacgttggttacggcgttcgaccgacccttattcgtttacgttccttaacttcgttccccgttccccggtactacgtacgttacgtaaccttagttaaccttcggtttaacgtccggtagggtaccgggacggtttccgaacggggttaccggaaacggggtcctaaacgtgtaaacgggtcaccttcggaancnctacgtctagtntagatcgtcgtacgtcgtcgcgcgtacgtacngagtcgactancgacgtactatacgtactacctacgtcgatagtagtacgacgacgtagtacgtcgacgttacacgttacgtagtcgtcgtcg

SEQ ID NO: 295452 - DNA, 785 bp, Homo sapiens
  misc_feature: GYAE6OF02HLR1T.44.1.A01.1.454.CMB.1.raw
  modified_base (162)..(162): a, c, t, g, unknown or other
  misc_feature (162)..(162): n is a, c, g, or t
tcagacagtatatacacgaccggtgctcgatttagacgtctcatcaggggatgctttctgagagtcatggacctcctgtgcaagaacatgaagcacctgtggttcttcctcctgctggtggcggctcccagagtgggtcctgtcccagctgcagctgcaggngtccggccaggacgtggtgaacgcccttacggacgacccttgtcccctcaccgtgcctacgtcgtctcgtggtcgcttccatcgacgtcgtaagttaggttacgttacgtacggtggggtcttaggacctcccggaccgtaccggccccccggaggggtaacgggtcctaggggtacggtagggtacggttagggtagttacgttacgttagttaaggttagggtagggaacaccgtaaacccgtaccgtaacccgtacccgtaccgtacgaacgtcgtacgtaacgtaccaactaactacgtacgaagtacgaaccgtacgtacctaagtaaccgtacgtttcctaccgtaagaactcgttacgacgtcctcggtacgtaccggacccggcgacggtccgaacggtccgtagttacgttacggtacgtacgacgggtacggtacggtacgggttaacctacggttcccgtaaacgtacccgttaaacgtttacccggttttaccggaacccggtaaccggggtttcccggggaacccgttaaaacccgggggacccttttaccgggtaaccccgtaacccggttacccctttccccggtacgtaaccccggttaacccccgg

SEQ ID NO: 295453 - DNA, 656 bp, Homo sapiens
  misc_feature: GYAE6OF02HGTTR.44.1.A01.1.454.CMB.1.raw
  modified_base (477)..(477): a, c, t, g, unknown or other
  misc_feature (477)..(477): n is a, c, g, or t
  modified_base (489)..(489): a, c, t, g, unknown or other
  misc_feature (489)..(489): n is a, c, g, or t
  modified_base (493)..(493): a, c, t, g, unknown or other
  misc_feature (493)..(493): n is a, c, g, or t
  modified_base (517)..(517): a, c, t, g, unknown or other
  misc_feature (517)..(517): n is a, c, g, or t
  modified_base (625)..(625): a, c, t, g, unknown or other
  misc_feature (625)..(625): n is a, c, g, or t
tcagacagtatatacacgaccggtgctcgatttagacgtctcatcaggccttaggggcattccctggtatcagcagaaaccagggaatgcccctaaggtcctgatctataaggcgtctagtttagaaagtggggtcccatcaaggttcagcggtcagtggatctgggacagaattcactctcaccatcagcagcctgcagcctgatgattttgctaacttattactcgtccaaacgtagtaacttaagtagttaattctacagtagttttggaccgtaggggaccaagtcgtggacgactacaaacggaactgttggacttgaccacgtactcgttacgtcgttactaacttccgttaccccgtccgtaactcccgttaaggtaacttacgttaacgtttacgttaccgttcgtttacggaacgggtccggggtacgttacgggacccgtaagggtcccggtacgtaaggtaaacgngttacgaagttnacgnggttcaagtcctaggtcaccggancgttacgtacgtagctcgtactgtacgtacgtactcggtacgacgtacgtagcgttacgacgtcgactcggtactacgtacgtaaccgtacgtagtacgtacgtaacncggtaataccgtacgaacgttccggtcaacg

SEQ ID NO: 295454 - DNA, 874 bp, Homo sapiens
  misc_feature: GYAE6OF02FXXJS.44.1.A01.1.454.CMB.1.raw
  modified_base (207)..(207): a, c, t, g, unknown or other
  misc_feature (207)..(207): n is a, c, g, or t
tcagacagtatatacacgaccggtgctcgatttagacgtctcatcagggcctgggctctgctattcctcaccctcctcactcagggcacagggtcctgggcccagtctgccctgactcagcctgcctccgtgtctgggtccacctggacagtcgatcaccatctcctgcattggaaccagcagtcgactagttggtagttataactntgtctctgaccaacacaccagacaaacgccccaaatcatgacttcatgatgtcaagttaactccggcccttacggtacggggtttctaggttccgtacgttccgtcggtcggccttacccgaagttcgtacggaccgtaaacgacccgggtcccttaccccgtacgaacctacgtttcctccgttaccggggccttaccggagggtcctaagggtaccgggaacggtaacggtacctaacggttaaaccgtttacgttttaaccgtcggtaacgtaaccggttaccttaacgtaaaactttaaaacggtaaaaaacggtaaacccgaacgtaaaaacccgtttacggtttaacggttttaaacgttaaacccgggtttacggggacccgggggtaaaacggtaacccggtaaacgggtacccggttaaccgggtaaccccgttaccggttaaccgggtaaccccggaaccggtaaccccggtaacggggtttaccccgtacccccgggtttacccccgggtaccgggttaccccttacccggtttaccccgttccccgggttaacccccgttaccccgtttacccgtttaaccctaaccgtttaacccgtttaccgtttaccggttaaccggttcccgggacgggttccggggttaccgtaccgggg

SEQ ID NO: 295455 - DNA, 562 bp, Homo sapiens
  misc_feature: GYAE6OF01DL9T6.45.62.F07.1.454.CMB.1.raw
  modified_base (305)..(305): a, c, t, g, unknown or other
  misc_feature (305)..(305): n is a, c, g, or t
  modified_base (364)..(364): a, c, t, g, unknown or other
  misc_feature (364)..(364): n is a, c, g, or t
  modified_base (376)..(376): a, c, t, g, unknown or other
  misc_feature (376)..(376): n is a, c, g, or t
tcagacgcgatcgacacgaccggtgctcgatttagtagtcgcataaagggaaaggggggggtcacaagaggcagcgctctcgggacgtctccaccatggcctgggctctgctgctcctcactctcctcacgtcaggacacagggtcctgggcccagtctgccctgactcagcctgcctccgtgtctgggtctcctggacagtcgatcaccatctcctgcactggaaccagcagtgatgttggattataaccttgtctcctggtaccaacagcaccaggacaaacgcccccaaactcatgatttanggaggcagtagcggccctgtagggtttcaatcgcttctctggctccaagtctggcaacncggtcctcccgngacatctctgggcctccgaggctgaggacgaggctgatttattactgctgctcatatgacgtagggttagttagttacgttttgggtgttcggggacggtagggaaccctagccgtcggtacccggttccgttagggccacggaccccgtaacgggtccctccggtccccccgtggtccctacccg

SEQ ID NO: 295456 - DNA, 980 bp, Homo sapiens
  misc_feature: GYAE6OF01CAIEP.45.62.F07.1.454.CMB.1.raw
  modified_base (924)..(924): a, c, t, g, unknown or other
  misc_feature (924)..(924): n is a, c, g, or t
tcagacgcgatcgacacgaccggtgctcgatttagtagtcgcataaaggggaaggggggggtcacaagaggcagcgctctcgggacgtctccaccatggcctgggctctgctgcctcctcactctcctcactcgaggacacgagggtcctgggcccctaggtcctcggccctagtacctcacggccttcgcccgttcggtcgttccgtcgggtccctccggtaggaccgtagttccgaactcccgacctagttccctccgtagacccaccggtaacggaaccctagtaccgtaggttagtacggttaggggtttacgggtaaacttttaaccgttaaccgttcgttccctaccgttaaccggtaaaccacgaaccgaccgaacccgaaccggaaacccgaaacccgtaaccccctaaacgtcggtaaagttacttaaccggttaagtcggggtaacgtcggtaaacggttacccgggtccgtaccccggttacgggtaacgggttttaacccttacggtcgttaacccttccggttaacgtaccggtccgtttaaccggacgttaacgtccggaaaccgtaacccggtaccccgttccgtttaccccgtaaacttaaacccgttaagtttccccgggacgggttaccccgggtacccgtaaccgggtaaccgggttcggtaaacccgggtaacgggtacccgggttaacggtccgttaacgggtttaaacggtttaccgtttaacgtaccgttacggttaccgttaacctcccgttaaagttccgggtaagtacggtttaacgggtttacggtttacggtttcggtttaaccgggttggggacccgggtaacgggttaaccgggaaccggtacgttacccggtaaccggttacgggtcccgtttaacgggccccggtaaacccnccgggtaaccccgtcggttcccccgtaacccggttcggttaacccccgttacccgg

SEQ ID NO: 295457 - DNA, 511 bp, Homo sapiens
  misc_feature: GYAE6OF01BQCKP.10.59.F04.1.454.CMB.1.raw
  modified_base (229)..(229): a, c, t, g, unknown or other
  misc_feature (229)..(229): n is a, c, g, or t
  modified_base (340)..(340): a, c, t, g, unknown or other
  misc_feature (340)..(340): n is a, c, g, or t
  modified_base (502)..(502): a, c, t, g, unknown or other
  misc_feature (502)..(502): n is a, c, g, or t
tcagcatagtagtgcacgaccggtgctcgatttagtacacacacttagggattgggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcacatctctgcactggaaccagcagtnatgttggtggttatgactttgtctcctggtaccacagcagccaggcgaagccccaaattcatgatttatgatgtcagtgcgcggccctcgggggtccctgatcgcttcgtntcggctccaagtctggcaacacggcctccctgaccatctctgcctcagtcctgaggatggagctagtattacttactgttagctcatatgacgaggcgtaccgcgttggggtgttcgggacgggtagggacccaagccgtacggacccgttccgacggttcnggtaccccg

SEQ ID NO: 295458 - DNA, 823 bp, Homo sapiens
  misc_feature: GYAE6OF01DNNTA.10.59.F04.1.454.CMB.1.raw
  modified_base (195)..(195): a, c, t, g, unknown or other
  misc_feature (195)..(195): n is a, c, g, or t
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctccggngcgtcgcgtacaccactctcctcgcacctacggaaccgaacgcgacgtaggtagttaggttgggttgggtttagttagttacgttttacgttttccgttcccttcggttaccgtaaaccaacgacgacgaccgacggacggaaccgaacccccgaaacccttaactacgtagtacgttttaattacgtagttagttcgtacgtaggtccggccgggtccccggtcccgggggttccccggtcgtagtccgtccgtttccttcgtcggtccgtcctaacgtacgttcggacgaacctaaccggcccgtacccctcgaaccgacttcgttccgttcgggccgtaccctacgggccgttggaaacggggaaccggtacggacgtttacgtaagtttttaaacgttttagtttacggtcgaaccgttaccggttaccttaagttaaacttaaacctaaaacccgaaaaccctaaaacggttaacgtttttcggttaaacgttaacggtttacccggggttaacccgggggaaaccgggttaaacccggtaaaaaccccttacgggtacccccggtttaccccgttttacccggttaccgaaacccggaccccggtaaaccggggttaccccg

SEQ ID NO: 295459 - DNA, 419 bp, Homo sapiens
  misc_feature: GYAE6OF01DNBNA.10.59.F04.1.454.CMB.1.raw
  modified_base (345)..(345): a, c, t, g, unknown or other
  misc_feature (345)..(345): n is a, c, g, or t
  modified_base (416)..(419): a, c, t, g, unknown or other
  misc_feature (416)..(419): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtacttttaccactggggccagggagccctggtcaccgtctcctcagcctccaccaagggcccatcggtcttccccctggcgccctgctccaggagcacctccgagngcacagcggcctgggctgcctggtcaaggctactcccatactatgctgagcgggctggcaaggcgcatagnnnn

SEQ ID NO: 295460 - DNA, 532 bp, Homo sapiens
  misc_feature: GYAE6OF01A7RTM.10.59.F04.1.454.CMB.1.raw
  modified_base (367)..(367): a, c, t, g, unknown or other
  misc_feature (367)..(367): n is a, c, g, or t
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtgttatgactttgtctcctggtaccagcaccaccaggcaaacgcccccaaactccttgttttgaggtcagtaacgcggccctcgaggacgtccctgactcggttctctcgcctcaagtctggcaacncggccctccctgaccgtctcgtgggcctccgaggctggaggatggacgtctgtacttactactgcagcgctatactcgacggacccaacgtgggttgttcgggcggtcggacgtaggtcgaccgtcgtcggtcacgccgacggctccgcccctcgtccgcgtccg

SEQ ID NO: 295461 - DNA, 666 bp, Homo sapiens
  misc_feature: GYAE6OF01D4KBQ.10.59.F04.1.454.CMB.1.raw
  modified_base (265)..(265): a, c, t, g, unknown or other
  misc_feature (265)..(265): n is a, c, g, or t
  modified_base (299)..(299): a, c, t, g, unknown or other
  misc_feature (299)..(299): n is a, c, g, or t
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttgtgtatgtacttgtctctggtaccaanagcagccaggcgaacgccccaaatcatgatttangatgtcagtgccgcggcccgtcggggtccctggtactcgtcttcgtcgtcggtacctccgtaacgtcgttacggacctaaccgacccgggtccccttaccccgtacgaacccctacgttcccgttccgtccgggtcccctcccgaacgtcccgttaggacgggtattacgggaacggtcttaggtaactttaactttacgttcggtttcgtaccgttactagttaacgtcggaccgtacgggtccggttacccggtccggttttacgggggtcggtttcccggggacggggtaccggggaaccctaaagggtcccgtacgggtaccccgttacccggtaacgggttcccgaaccgggtaacccccgg

SEQ ID NO: 295462 - DNA, 460 bp, Homo sapiens
  misc_feature: GYAE6OF01BCD1V.10.59.F04.1.454.CMB.1.raw
  modified_base (224)..(224): a, c, t, g, unknown or other
  misc_feature (224)..(224): n is a, c, g, or t
  modified_base (266)..(266): a, c, t, g, unknown or other
  misc_feature (266)..(266): n is a, c, g, or t
  modified_base (440)..(460): a, c, t, g, unknown or other
  misc_feature (440)..(460): n is a, c, g, or t
tcagcatagtagtgcacgaccggtgctcgatttagtacacacacttagggagtgggacgtggagtggattggccttacacattatagtgggactacccactacaaccgtccctcaggagtcgagtcaccatctcactagacacgtccaggaatcacctctccctgacggtgacctctgtgaccgccgcggacacggccgtgtattattgtgcgagagaccccgntgaagattcctcaatgtactttgaccacgtgggggccagggngccctgggtccaccgtctcctcagcctccaccaagggccccagtccggtctccccctggccgccctgcctccgacggagccacctccgagacgcacgagcggccctgggctgcctggtcaaggactacttcccatactatgcctggacgcgggctaggcaaggcgcgactaggnnnnnnnnnnnnnnnnnnnnn

SEQ ID NO: 295463 - DNA, 421 bp, Homo sapiens
  misc_feature: GYAE6OF01BWSGF.10.59.F04.1.454.CMB.1.raw
  modified_base (414)..(421): a, c, t, g, unknown or other
  misc_feature (414)..(421): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgaccccgctgaagattcctcaatgtactttgaccacgtggggccagggacgccctggtcaccgtctcctcagcctcaccaagggccccatcggtctcccctggcgccctgctccaggagcacctcgagagcacagcggccctgggctgcctgtcaagctactcccatacatgctgagcgggctggcaaggcgcatagnnnnnnnn

SEQ ID NO: 295464 - DNA, 533 bp, Homo sapiens
  misc_feature: GYAE6OF01CP8L7.10.59.F04.1.454.CMB.1.raw
  modified_base (401)..(401): a, c, t, g, unknown or other
  misc_feature (401)..(401): n is a, c, g, or t
  modified_base (457)..(457): a, c, t, g, unknown or other
  misc_feature (457)..(457): n is a, c, g, or t
  modified_base (504)..(504): a, c, t, g, unknown or other
  misc_feature (504)..(504): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtgctccatcaacagtggtgacaactggtggggctgggtccgccagcccccagggatgggactgggagtggattggccttacacattatagtgggactacccactacaacccgtccctcaggagtcgagtcaccatctcactagacacgtccaggaatcacctctccctgacggtnacctctgtcgaccgccgcggacacggccgtgtattattgtcgcgagacgaccccgntgaagcttcctcaatcgtactttcgaccctagtcggggccaggggancccgtggtccaccgtcctccgtcgtaccg

SEQ ID NO: 295465 - DNA, 549 bp, Homo sapiens
  misc_feature: GYAE6OF01BGKT0.10.59.F04.1.454.CMB.1.raw
  modified_base (460)..(460): a, c, t, g, unknown or other
  misc_feature (460)..(460): n is a, c, g, or t
  modified_base (516)..(516): a, c, t, g, unknown or other
  misc_feature (516)..(516): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtgctccatcaacagtggtgacaactggtggggctgggtccgccacgcccccagggatgggactggagtggattggcctttacactattatagtgggactacccactacaacccgtccctcagagtcgagtcaccatctcactagacacgtccaggaactcacctctccctgacgtgacctctcgtcgaccgccgcggacacgggccgtgtattattgtgcgagacgtaccccgntcgaacgtcttccgtctaatcgttactttcggaccctaggtcgggcccgagggacnccccgtggtccctacccgtcttcccgtcgaccg

SEQ ID NO: 295466 - DNA, 523 bp, Homo sapiens
  misc_feature: GYAE6OF01ALUBX.10.59.F04.1.454.CMB.1.raw
  modified_base (227)..(227): a, c, t, g, unknown or other
  misc_feature (227)..(227): n is a, c, g, or t
  modified_base (321)..(321): a, c, t, g, unknown or other
  misc_feature (321)..(321): n is a, c, g, or t
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
  modified_base (459)..(459): a, c, t, g, unknown or other
  misc_feature (459)..(459): n is a, c, g, or t
  modified_base (517)..(517): a, c, t, g, unknown or other
  misc_feature (517)..(517): n is a, c, g, or t
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtggttatgtactttgtctcctggtaccagcaccaccaggcaaacgccccaaactccttgttttgagtcagtaagcggcctnaggagtccctgactcggttctctcgcctccaagtctggcaacgcggccctcctgaccgtctcgtggcctccgaggctgagntgaggtctgattactactgcagcgnatactcgacggcccaagtgggtgttcggcggnggtactaggtcgaccgtcgtgggtccacgcccgaacggtctccgccccgttcggtccncgtccg

SEQ ID NO: 295467 - DNA, 530 bp, Homo sapiens
  misc_feature: GYAE6OF01EXLJW.10.59.F04.1.454.CMB.1.raw
  modified_base (289)..(289): a, c, t, g, unknown or other
  misc_feature (289)..(289): n is a, c, g, or t
  modified_base (455)..(455): a, c, t, g, unknown or other
  misc_feature (455)..(455): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcacatctcctgcactggacccagcactgatgttggcattataaccttgtctcctgtatcaacacgcccagacaaacgcccccanactcttgatttatgaagtcagtaagcggccctcgaggggtttctagtcgcttctctcgcctcaagtctggcaacacggcttccctgacctatctccgggctccacgctgaggacgaggctcgattactactgcagctacatactacaccgagggcacgtctcgtanacgtagttccgggcggagggtaccgtcggcctacggacccgtacccgtacgtaccgacggccccgaaggtccccg

SEQ ID NO: 295468 - DNA, 574 bp, Homo sapiens
  misc_feature: GYAE6OF01C9F9V.10.59.F04.1.454.CMB.1.raw
  modified_base (408)..(408): a, c, t, g, unknown or other
  misc_feature (408)..(408): n is a, c, g, or t
  modified_base (439)..(439): a, c, t, g, unknown or other
  misc_feature (439)..(439): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccagcagtgatgttggtgttatgtactttgtccttcctaggtacccaacagcagccaggaccgaacgcccccaaattccaatcgtatttatgtatgtcagtcgcggccggtccgtcggggtcctgactcgtcttctcgtcggctccgaagtcgtcgaccacgccggtccctcccgacgaccncgtcctcgtcggcctccgacgccgtggagtntggacgtctagtatttacgttcgttgttcgtctatatatcggacgtaacgggtcggtacccgtcgggttggggtcggttcgggaccgggacggaccgagtcgtaccgtacgtaccgtacggtccgacggacccgg

SEQ ID NO: 295469 - DNA, 630 bp, Homo sapiens
  misc_feature: GYAE6OF01BQO5P.10.59.F04.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (265)..(265): a, c, t, g, unknown or other
  misc_feature (265)..(265): n is a, c, g, or t
  modified_base (404)..(404): a, c, t, g, unknown or other
  misc_feature (404)..(404): n is a, c, g, or t
tcagcatagtagtgcacgaccggtgctcgatttagtacacacacttagggagttgggggggtctcaggaggcagcactctcgggacgtctccaccatggcctgggctctgctcctctcagcctcctcactcagggcacaggatcctgggctcagtctgccctgactcagcctcgctcagtcgtccgggtctccgtgggcagtcagtcacatctcctgcactggaaccngcagtnatgttggtgtatgtacttgtctctgtacaangcagcaggcaacgcccaattcatgtattatgatgtcagtcgcggccgtcccgtcggggtcctgactcgtcttcgtcgtcggtcctaccgaagtccgtacggaccgaacgtacccgggtccctcccgtacgtaacccctnttcccgtccgttccggaccccttaccgacgttcccgtaggaacggtacgtcggaacggtctagtaactttacgtttacgtggttacgtaccttactaacgtaacgtcgaccgtacgggtaccggttaccggttcgggtttcggggtcggttcggggaccgggtaacgggaacccgtaaggtcccgtaggtaccccggttaggacggttccgaaccggtaaccccgg

SEQ ID NO: 295470 - DNA, 426 bp, Homo sapiens
  misc_feature: GYAE6OF01CJZ84.10.59.F04.1.454.CMB.1.raw
  modified_base (423)..(426): a, c, t, g, unknown or other
  misc_feature (423)..(426): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagacccccgctgaagattcctcaatgtactttgaccactggggccaggggagccctggtcaccgtctcctcagcctccaccaagggcccatcggtcttccccctggccgccctgctccaggagcacctccgagagcacagcggccctgggctgcctggtcaaggactacttcccactactatgctgagcgggctggcaaggcgcatagnnnn

SEQ ID NO: 295471 - DNA, 701 bp, Homo sapiens
  misc_feature: GYAE6OF01C6IHL.10.59.F04.1.454.CMB.1.raw
tcagcatagtagtgcacgaccggtgctcgatttagtacacacacttagggagttggggggggtctcaggaggcagcactctcgggacgtctccaccatggcctgggctctgctcctcctcagcctcctcactcagggcacaggatccgtgggctcagtctgccctgactcagcctcgctcagtcgtccgggtctccgtgggcagtcagtcacatctcctgcactggaaccagcagtgtacgttttgtgtacttaataactattcgtctccgtaggtaccacgccaaccaccgaacggaaccaaaccgtaccccctaaaactttccgtttaggttttacggaacggttacctaaacggtaacgtcccgggtacctacgaacgggtaccgtcccgtgtacgttccggtttaccgtcgtcgtcccttaccgaacggtccgtacgggacctaaacccgaccggtcccttacccggtcgtacccgttcgtacggtccggtaccgtacgacggtcgtaggaacggtagtcggacgtcgttagtaacttacacgtcgagtacgcgtactaagtaccgtacgtaccgacccgtaagggttacgggttcggttacgggccgggtacggtaaccggtaaggccggtacccggttcggtacggccaccggaccggtacgtccgtacccggtcccgtcggtcctccgttcccg

SEQ ID NO: 295472 - DNA, 665 bp, Homo sapiens
  misc_feature: GYAE6OF01CAPNI.10.59.F04.1.454.CMB.1.raw
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctcctgcactggaaccagcagtgactttgtgcttataactatgtctcctgtaccagcaccaccagacaacgccccaactccttgttttgacgtcagtacgcgcctgaggtactccctgactcgtctctcgctcagtctgacacgcggcctccgtcgccgtctcgtcgggcctcccgagtccgtaggacggagttcgacgggtccttacggtaaactttaccgtaaccgtcggaccgacggtccgtaacctaattacgttacccgaaccgggtaccccgaacgggttagggggtttcggtttccgggggaccgggtaccggggttaaaccgttaacggggttacccgggtcccgggttacccggtacgggggtacccgtaaccgggacccccgttaaacgggtccccgttcccgggtaccccccccggttcgggtaccccgttaccgttcccccgg

SEQ ID NO: 295473 - DNA, 633 bp, Homo sapiens
  misc_feature: GYAE6OF01BO6A5.10.59.F04.1.454.CMB.1.raw
  modified_base (228)..(228): a, c, t, g, unknown or other
  misc_feature (228)..(228): n is a, c, g, or t
  modified_base (310)..(310): a, c, t, g, unknown or other
  misc_feature (310)..(310): n is a, c, g, or t
  modified_base (317)..(317): a, c, t, g, unknown or other
  misc_feature (317)..(317): n is a, c, g, or t
tcagcatagtagtgcacgaccggtgctcgatttagtacacacacttagggattgggggggtctcaggaggcagcactctcgggacgtctccatcatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgatggttggtggttatgtactttgtctcctggtaccacagcagccgaggcgaacgacccctaaattcatgtatttangatgtcngtgcgcggcccgtcggggtccctgactcgtcttctcgtcgctccgagtcgtcggacaaccgccggtccctacccgtcgtaccctatccttcgtacggtcccctaccgacgtccgtaggacggtagtggacggtacttggtaactttaacgttacgttggttacgcttactacgttagtcgtaccggtacggggttcccggtaaccggttccgggtttggggttcgggtttacccgggggcggggtaacggggtaacccgaacgggtcccggttaccggacccgggtttacccggttagggtcccggtaaccccggg

SEQ ID NO: 295474 - DNA, 587 bp, Homo sapiens
  misc_feature: GYAE6OF01AB2Y5.10.59.F04.1.454.CMB.1.raw
  modified_base (168)..(168): a, c, t, g, unknown or other
  misc_feature (168)..(168): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (268)..(268): a, c, t, g, unknown or other
  misc_feature (268)..(268): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactnagcctcgctcagtgtccggtctccgtgggcagtcagtcaccatctcctgcactggaaccngcagtnatgtggtggtatgtacttgtctcctggtaccacngcagccaggcgaacgccccaattcatgatttatgatgtcagtcgcggcgtcccgtcgggtccctgactcgcttctcgtgctcgagtctggcaacgcggtcctcctgaccgtctcgtggcctcgaggtctacggaggtatcggacgcgttagtacttacgtcgtgactaggtccgactacgttaccttaccgaaccgggtccctaacggtggggttcgttaccgggggcggtacggggtaaccgttacggggttacccgtacccggttacccggttacggggacccaaccgggtcccgaaacgggtcccgttaccccggg

SEQ ID NO: 295475 - DNA, 527 bp, Homo sapiens
  misc_feature: GYAE6OF01AKAB2.10.59.F04.1.454.CMB.1.raw
  modified_base (375)..(375): a, c, t, g, unknown or other
  misc_feature (375)..(375): n is a, c, g, or t
  modified_base (403)..(403): a, c, t, g, unknown or other
  misc_feature (403)..(403): n is a, c, g, or t
tcagcatagtagtgcacgaccggtgctcgatttagtacacacacttagggattggggggggtctaaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggcccgtcggggtcccctgatcgctttctctggctccagtctggcacacggcctccngaccatctctcggcctccagcctgaggntgaggtctgatttattctgttcgcttctatatggacagggtccggtaccgtcgtttgggtcggttcgggcgggacgggccgaagtcgtacggtacccgttcgtaggtcacggcccgtaaccggg

SEQ ID NO: 295476 - DNA, 419 bp, Homo sapiens
  misc_feature: GYAE6OF01ACMHR.10.59.F04.1.454.CMB.1.raw
  modified_base (321)..(321): a, c, t, g, unknown or other
  misc_feature (321)..(321): n is a, c, g, or t
  modified_base (410)..(419): a, c, t, g, unknown or other
  misc_feature (410)..(419): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagacccccgctgaagattcctcaatgtactttgaccactggggccagggagccctggtcaccgtctcctcagcctccaccaagggcccatcggtcttccccctggcnccctgctccaggagcacctcgagagcacagcggcctgggctgcctggcaggctactcccactcatgctgagcggctggcagcgcatagnnnnnnnnnn

SEQ ID NO: 295477 - DNA, 538 bp, Homo sapiens
  misc_feature: GYAE6OF01CV3L0.10.59.F04.1.454.CMB.1.raw
  modified_base (238)..(238): a, c, t, g, unknown or other
  misc_feature (238)..(238): n is a, c, g, or t
  modified_base (391)..(391): a, c, t, g, unknown or other
  misc_feature (391)..(391): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttggataccctgtccctcagttgcgctgtctctggtgctccatcaacngtggtgacaactggtgggctgggtccgccagcccccagggatgggactggagtggattggccttacacattatagtgggactaccgactacacccgtcctcaggatcgagtcacctatcctcactagacacgtcagatcacctctcctgcgtnacctctgtcgccgccgcggacacggccgtgtacttagttgtcgcgacgacgccccgctagaacgtacttcccataatcgttactttgacccgagtcggggcccaggggaccgtcccgtagggtcccaccgttcctccgtcgtacccg

SEQ ID NO: 295478 - DNA, 634 bp, Homo sapiens
  misc_feature: GYAE6OF01A96I7.10.59.F04.1.454.CMB.1.raw
  modified_base (227)..(227): a, c, t, g, unknown or other
  misc_feature (227)..(227): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcacatctctgcactggaaccngcagtgatgtgtgtatgacttgtctctggtaccaacagcagccaggccgaacgccccaaattcatgtatttatgatgtcagtgcgcggcccgtcggggtccctgacgtccgcttctcgtcgcctcgaagtcctggacaaccgtaccggccctcccgtcgaccctactcctcgtcggtccctccgacgtcctggacggtagtcggacggtcttggtaactttacgttaacgttcggtttcgtaccttcgtaacgttacgtcggacgtacgggtacccgggttacccggtccgggtttcgggggttaccggttccggggtaccgggggtaccgggtaacccgtaacgggttccggttaccggtaccccggttacccggttaacgggtcccgaacccgggtaaccccggg

SEQ ID NO: 295479 - DNA, 579 bp, Homo sapiens
  misc_feature: GYAE6OF01EYWBD.10.59.F04.1.454.CMB.1.raw
  modified_base (243)..(243): a, c, t, g, unknown or other
  misc_feature (243)..(243): n is a, c, g, or t
  modified_base (409)..(409): a, c, t, g, unknown or other
  misc_feature (409)..(409): n is a, c, g, or t
  modified_base (488)..(488): a, c, t, g, unknown or other
  misc_feature (488)..(488): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggccggccccagatgggtcctgtcccagctgcagctgcatgagtcgggcccaggactggtgacggccttcggactacccgtgtccctctagttgcgctgtctctggtgctccatcaacngtggtgacaacgtgggtgggctgggtccgccacgcccccgagggatcgggactggagtgggattcggccttacactattagtagtgggactacccactacaacccgtcctcaggatcgagtcacatctcactacgacacgtcaggaactcaccttctcctgacgtnacctctgcgaccgccgacggacaccgggtccgtgttacttagttcgtgcgacggacgaccccgctgaacgtcttacctnaacttgtaacctttcggaaccctacgggtcggggaccctaggggaccctcccggttacggtacccacccgttccttcccgcgtaaccccgg

SEQ ID NO: 295480 - DNA, 712 bp, Homo sapiens
  misc_feature: GYAE6OF01E0QFS.10.59.F04.1.454.CMB.1.raw
  modified_base (274)..(274): a, c, t, g, unknown or other
  misc_feature (274)..(274): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctggctcagtctgccctgactcagcctcgctcagtgtccgggtctccgtgggcagtcagtcacatctctgcactggaaccagcagtgatggttggtggttatgtactttgtcttccgtacggtaccaanacgcagccgaggaccgaaccgacccctaaattccatagtacttttatgtatgtcaggtgccgccggcccgtcgggggtccctgacgtccgtctttcctcgtcggtcctacctaacggtcgtacggacctaaacccggtcccggtacccccttcccgtaccggaaccctacgtttcccgtacccgttcggaccccttacccgacggtcccgtaaggaacgggtcgtaggtacggttcgtagttaactttacgtttaacgttgtttactacgttacttaacttacgacggtacgtacggggttacccggttacccgggttcggggtttcgggggttcgggtttaccgggggcccggggttaaacgggacccgtaaacgggttcccgttaccggggtaaccccgttaccggttaccgggtaccgtacccggtaaccccggg

SEQ ID NO: 295481 - DNA, 439 bp, Homo sapiens
  misc_feature: GYAE6OF01E0VUT.10.59.F04.1.454.CMB.1.raw
  modified_base (406)..(406): a, c, t, g, unknown or other
  misc_feature (406)..(406): n is a, c, g, or t
  modified_base (415)..(415): a, c, t, g, unknown or other
  misc_feature (415)..(415): n is a, c, g, or t
  modified_base (421)..(439): a, c, t, g, unknown or other
  misc_feature (421)..(439): n is a, c, g, or t
tcagcatagtagtgcacgaccggtgctcgatttagtacacacacttagggatgggactggagtggattggccttacacattatagtgggactacccactacaacccgtcccctcaggagtcgagtcaccatctcactagacacgtccaggaatcacctctccctgacggtgacctctgtgaccgccgcggacacggccgtgtattattgtgcgagagaccccgctgaagattcctcaatgtactttgacccacgtggggccaggggacgccctggtcaccgtctcctcagcctccaccaaggcccatcggtctccccctggcgccctgcctccaggagcacctccgagagcacagccggcctgggctcgcctggtcaaggctactcccactactatgctgagcggntggcaggcncatagnnnnnnnnnnnnnnnnnnn

SEQ ID NO: 295482 - DNA, 518 bp, Homo sapiens
  misc_feature: GYAE6OF01CZEN8.10.59.F04.1.454.CMB.1.raw
  modified_base (224)..(224): a, c, t, g, unknown or other
  misc_feature (224)..(224): n is a, c, g, or t
  modified_base (500)..(518): a, c, t, g, unknown or other
  misc_feature (500)..(518): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagacgaccccgntgaagtattcctcaatgtactttgaccacgtggggccaggggagcccgtggtccaccgtcctcctcacgcctaccaccgaacgggcccagttccggtcccttcccccgtggcccgccctcgcctccgaggcgccacccgtccgagacgccacgacggtccggccccgtggggcctcggcccgtgggtaccgaaacggaccctttacccgttccccaacgttaactagtcgacgttggacggccgggtcgtcgggacgaagggccgacgaattaggnnnnnnnnnnnnnnnnnnn

SEQ ID NO: 295483 - DNA, 574 bp, Homo sapiens
  misc_feature: GYAE6OF01CV22M.10.59.F04.1.454.CMB.1.raw
  modified_base (267)..(267): a, c, t, g, unknown or other
  misc_feature (267)..(267): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccagcagtgatgtggtgtatgacttgtctctggtaccaangcagcaggcaacgcccaatcatgtattangatgtnagtcgcggccggtcccggtcggggtcctgactcgtcttctcgtcgccttcgaagtctacggacaacgtaccggccctccgtacgtaccctattccctcgtcggtccctccgacgtccgtaggacgagtcggagtcttaggtactttaattacgttggttctcgtatagttcgtgcggaggtaccggtccgtcggttggggttcggtacgggacgggaccggtaacgaacggtcgtaccggtacccgttcgtaacggtcgaccggtaacccgg

SEQ ID NO: 295484 - DNA, 564 bp, Homo sapiens
  misc_feature: GYAE6OF01D9S2E.10.59.F04.1.454.CMB.1.raw
  modified_base (483)..(483): a, c, t, g, unknown or other
  misc_feature (483)..(483): n is a, c, g, or t
tcagcatagtagtgcacgaccggtgctcgatttagtacacacacttagggattgggggctttctgagagtcatggacctcctgtgcaagaacatgaatcacctgtgttcttcctcctgctggtggcggcccccagatgggtcctgtcccagctgcagctgcatgagtcgggcccaggactggtgaggccttcggataccctgtccctcagttgcgtctgtctctggtggctccatcaacgagtggtgacaacgtgggtggggctgggtccgccacgccccccgaggggatggggactgggagtgggattcggccttacactattatagtgggacctacccactactaacccgtcctcaggagtcgagtccacatctcactagacacgtccaaggaactcacctcctccgtgacggtcacctctcgtcgacccgcgaccggacgacggtccgtagttattagttgtgacgagaccgaccccgtntagaactacttccacgtattcgttacttcgacctacggtcggggcagggccgcccgtggtaccaccgtctccgtctacccg

SEQ ID NO: 295485 - DNA, 675 bp, Homo sapiens
  misc_feature: GYAE6OF01ANFDN.10.59.F04.1.454.CMB.1.raw
  modified_base (248)..(248): a, c, t, g, unknown or other
  misc_feature (248)..(248): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcgccccagatgggtcctgtccagctgcagctgcatgagtccgggcccaggactggtgaggtccttcggactaccctgtccctcgagttcgcgtctcgtctcgtggtcggcctccatacaacnggtggtagacaacgtgggtgggctggggtccaccgacggcccccgaggggagtgggtacctgggagttacggtagtttcgggccttaacaactaagtttagttacggtacgggaacctaaccccaacgttaacccaaccccgttcctacgagggtacgtacggactaccaaccgtactcctaccaactaggacccacggttaccaaggtaactcctaacccgtcctacccgtaggaccggttactaccgttcgtacggtaccgacccgccggtaccggaccgtaccggtcccgtttagtagttcgttaggtcgaccggtacgaccgtacccccgtgtacgaacgtccttaccgactattcgtaccttcgaaaccgtggtccgggacacgggcctcccgtacggtccctaccggtctccgcgtacccg

SEQ ID NO: 295486 - DNA, 675 bp, Homo sapiens
  misc_feature: GYAE6OF01A5HUG.10.59.F04.1.454.CMB.1.raw
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctcgccctgactcagcctcgctcagtcgtccgggtctccgtgggcagtcacgtcacctattcctccgtgccacgtcggaaccagcagtgtactttgttcgacttataactatcgtcttcctggtaccacgccaaccaccgacggaccaaaccgtccccctaaacttccgtttggttttacgacggtcgtaaggtacgcccggtacctcgacggtacgtccgtaggtacgttccggttctctcggcctaccgtaacgtccgcgaccaccgtaccggtccctccgtacggtccgtcgtcgtcggtctccggtaggtcgtacggaggtacgtcggagtcgttgtaacgttacgtcgtcgcgtacgctataagttccgtacgtacccggtacccgtaaggtacgggggttcgtccgggcgggtacggtaccggttacggtccggtcccggtacggcggttacgaccgggtcccgtaacggtccccgtacccggttaccccgacgttccgtcccgttaccccg

SEQ ID NO: 295487 - DNA, 837 bp, Homo sapiens
  misc_feature: GYAE6OF01C12KZ.10.59.F04.1.454.CMB.1.raw
  modified_base (321)..(321): a, c, t, g, unknown or other
  misc_feature (321)..(321): n is a, c, g, or t
  modified_base (693)..(693): a, c, t, g, unknown or other
  misc_feature (693)..(693): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggccggcccccagatgggtcctcgtcccagctgcagctgcatgaggtccgggcccaggactgggtgacggcccttcggactacccctcgtcccctcgtaggttcgccgtcttgtcttccgtgggtcggcctccatacaacgtggtggtgaactaacgtggggtggggccgtcgggtcccgccaccgcccccgagggngtgggacgtgggtaggtggtacgttcgggtcccttaacgaacctaagttttagtaagggttacgggaaccctaaccccgtaaccgtaacccctaacccccggttccccgtccgtaaggggtaccggtaccggtaacggttaccctaacccgtacttaccctacaaccgtaacgaacctaccgttaccgaacgggtaaacctcccgtaaccccttcccgttaccccgttcggaaaccggttccgtaacccgttacgttccggtacccggaccccgggcccgggtacccgggtaacccgtacccggggtccggtttacggtttaacttttacggtttcggtaccgaccggtaaccggaccccggtaacccccgngttaacgaaccgttccttacccgttaacgtaacgtttcggttaacctttcggaaaccccgtacgggttacggggaccccggttaggggacccggtccccgttcgggtaccccgtaccggtttccctcccgtccgtaacccccgg

SEQ ID NO: 295488 - DNA, 725 bp, Homo sapiens
  misc_feature: GYAE6OF01A2BUQ.10.59.F04.1.454.CMB.1.raw
  modified_base (199)..(199): a, c, t, g, unknown or other
  misc_feature (199)..(199): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (233)..(233): a, c, t, g, unknown or other
  misc_feature (233)..(233): n is a, c, g, or t
tcagcatagtagtgcacgaccggtgctcgatttagtacacacacttagggagttggggggggtctcaggaggcagcactctcgggacgtctccaccatggcctgggctctgctcctcctcagcctcctcactcgagggcacaggactccgtggctcgagtctgccctgactcagcctcgctcgagtcgtccggtctcgnggctagtcagtcactntctcngcacgtagaaccngcgagtgagttgtggtgtatacgtactttcgtctcgtacggtaccaacgacgcgacggtaccgaggtaaccgaaccgtacccctaaagttccgagttacgttatttacgtgtagttacgtcgtaggtcggaccgtcccggtacccggttccggtaccgtaggttaccgttccgtcccgtttcgtaccgtccggttaccgtacccgtaacggttccgtaacggtacccgtaaccggtacccggtacccgtaccccggttaaccaccgttaaccgttcccgtaccggtcccgtacccgtaccgaccgtaccgttaggacgttagtaacggtacgttaccgttaagttactttacgtacggttcggttatcgttaaactgtaacgtcgccggtacggtacccgggttcgtagggtttcggtacgggtagccggggtacggtaaccgtcggtaccgttaaccgtcccggtacgtacccggtcgccggtaaccccgg

SEQ ID NO: 295489 - DNA, 709 bp, Homo sapiens
  misc_feature: GYAE6OF01DE2KK.10.59.F04.1.454.CMB.1.raw
  modified_base (240)..(240): a, c, t, g, unknown or other
  misc_feature (240)..(240): n is a, c, g, or t
  modified_base (350)..(350): a, c, t, g, unknown or other
  misc_feature (350)..(350): n is a, c, g, or t
  modified_base (662)..(662): a, c, t, g, unknown or other
  misc_feature (662)..(662): n is a, c, g, or t
tcagcatagtagtgcacgaccggtgctcgatttagtacacacacttagggagttggggggggtctcaggaggcagcactctcgggacgtctccaccatggcctggctctgctcctcctcagccctcctcactcgagggccacaggatccgtggctcagtctgccctgactcagcctgctcagttcggtccggtctccgtggccagtcagtccaccgatcctccgtgcctacgtggaaccngcaggtcgtagtggttggttggttatgtactttcgtccttccgtacgtaaccaacgtcgacacggccgacggaccgaaacgacccctaaagtctaagtacgttatttagngtacgttacgtcgtacgtcggcggtaccggtcccggtcggggtccctaggtacttccggttccgtttccgtcgtaccggtccgttaccgtaacggtccgttacggaacccgtaccgtaccccggtccctacccgtacgacccttacgttcctccggtacggtcccctccggaccgtcggtacggacggtagtacgggtacggtaccttagttaacgtttacgtttaacgttcggttcgtacttgtaacttaggtacggtccgtaacgggtccggtacgttcgggttgggttacgggtacggacggggtaacnccggtaagtcccgtcggtacccgttccgtacgccgtcccgtaaccgg

SEQ ID NO: 295490 - DNA, 560 bp, Homo sapiens
  misc_feature: GYAE6OF01EGGC1.10.59.F04.1.454.CMB.1.raw
  modified_base (493)..(493): a, c, t, g, unknown or other
  misc_feature (493)..(493): n is a, c, g, or t
  modified_base (553)..(553): a, c, t, g, unknown or other
  misc_feature (553)..(553): n is a, c, g, or t
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcacgcctcgctcagtcgtccgggtctccgtgggcagtcagtcaccatcctcctgccactcggaaccagcagtgattgttggtgttatgtactttgtctcctgtaaccaacaacaccagacaaacgccccaaactcagtgtattttgattgtactaagtaacgtccggtaccctacggtacggggttttctaaacgttcgtacttctcgtcgtcctcctaagtcgtcgacacgaccgtccctccgtacgacctatccgtcgtcggtcctccgagtcgtaggacggacgtagtcgtgtacttactactgcagctacatactacacancatcctatctagtacgtcggtcgggacgacgtagctacgaccgtcgtacggcacgtccgnggtcccg

SEQ ID NO: 295491 - DNA, 606 bp, Homo sapiens
  misc_feature: GYAE6OF01BIF63.10.59.F04.1.454.CMB.1.raw
  modified_base (257)..(257): a, c, t, g, unknown or other
  misc_feature (257)..(257): n is a, c, g, or t
  modified_base (523)..(523): a, c, t, g, unknown or other
  misc_feature (523)..(523): n is a, c, g, or t
  modified_base (551)..(551): a, c, t, g, unknown or other
  misc_feature (551)..(551): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggccggcccccagagtcgggtcctgtcccagctgcagctgcatggaggtccgggcccaggacgtggtgacggtccttcggactacccgtcgtccctctggttcgcgtcttgtctcgtggtcgctccatacaanggtggtgactaacgtgggtcgggcgtcgggtccgaccgaccggccccgaggaggtacgggacggtagggaggtggtagttcggtaccttacactattaggtacgtacgggtaccctacccgaacctaacccgaacccgttccctacgacggacgtacggacgtaccaccctactcctacacgtaaccgactacgtaccgaacgtactacctcctcctccgtacgacggtctactcgtcgcgccgcgccgacgcgtctgtatagtgngacgcgaccgccacgtacgactctctanctcgtatacgcgtagcggcgcggccgtaccgtgccgtacctcgtcctcgtacccg

SEQ ID NO: 295492 - DNA, 588 bp, Homo sapiens
  misc_feature: GYAE6OF01EA0TV.10.59.F04.1.454.CMB.1.raw
  modified_base (241)..(241): a, c, t, g, unknown or other
  misc_feature (241)..(241): n is a, c, g, or t
  modified_base (247)..(247): a, c, t, g, unknown or other
  misc_feature (247)..(247): n is a, c, g, or t
  modified_base (459)..(459): a, c, t, g, unknown or other
  misc_feature (459)..(459): n is a, c, g, or t
  modified_base (468)..(468): a, c, t, g, unknown or other
  misc_feature (468)..(468): n is a, c, g, or t
  modified_base (479)..(479): a, c, t, g, unknown or other
  misc_feature (479)..(479): n is a, c, g, or t
  modified_base (496)..(496): a, c, t, g, unknown or other
  misc_feature (496)..(496): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgacggccttcggactaccctgtccctcagttgcgctgtctctggtgctccatcaacngtggtnacaactggtgggctgggtccgccacgcccccgaggggatcggggacgtgggaggtgggtacgtttcgggcccttaacactatttaagtaggtcgggaacctacccaactaccaaccccgtcctcgaggacgtcgagtccaccatcctcactagacacgtcaggtaactccaccttctcccgtgacggtcacctctgtcgaccgccgcggacncggtccgtnttattagttgngacgagaccgccccgtnacgtaagacttccgactaagttcgtacgtttcgaaccgtaggtcggggccacggggcgtccccgtggccctaccgttcctccctgtaccccg

SEQ ID NO: 295493 - DNA, 904 bp, Homo sapiens
  misc_feature: GYAE6OF01CSI1T.10.59.F04.1.454.CMB.1.raw
  modified_base (237)..(237): a, c, t, g, unknown or other
  misc_feature (237)..(237): n is a, c, g, or t
tcagcatagtagtgcacgaccggtgctcgatttagtacacacacttagggattggggggggtctcaggaggcagcactctcgggacgtctccaccatcggcctgggctctgctcctcctcagcctcctcactcagggcacaggactccgtgggctcagtctcgccctgactcacgcctcgctcagtcgtccgggtctcgtgggcagtcagtcacctatcctcctgcacgtggaaccngcagtgagttggttggtggttatcgtacgttttgtccttaccgtacggtaaccaacgtaagccgaacggtacccgaacggggtacccgaaaccggtacccccgtaaaagtttccgaacgtttacggttaaatttttacgtacgtacgttacggttacgtaacgggttccggtacccggggtcccgggttacccccggggttcccggggggttaccccttacgggtaccggtttcccgttcgtttacccgtcggtttacccgggtccctttaacccggtaaacgggttccgtaccgggtaaccctaacccggtaacccgggttcccccttacccggtaccggaacccctaacgttcccgtcccggttaccgggtacccttaccccggtaaccgggtcccggttaagggtaaaccgggtcgtaacgggtacggtcgtttaacgttaagtttttacccggtttaacgtcggtttaacgtcctttaacggtaactttaacggtccgggtaacggtaccggggtttacccgggttaccggtttccgggtttacggggggtttaccgggttccggggaaccggggtaaccgggtaccgaaaccgggttcccgggtacccggttaaccgggttcccggtaaaccgggttcccggtaaccccggggtaaccccgg

SEQ ID NO: 295494 - DNA, 477 bp, Homo sapiens
  misc_feature: GYAE6OF01C3EH8.10.59.F04.1.454.CMB.1.raw
  modified_base (224)..(224): a, c, t, g, unknown or other
  misc_feature (224)..(224): n is a, c, g, or t
  modified_base (330)..(330): a, c, t, g, unknown or other
  misc_feature (330)..(330): n is a, c, g, or t
  modified_base (460)..(477): a, c, t, g, unknown or other
  misc_feature (460)..(477): n is a, c, g, or t
tcagcatagtagtgcacgaccggtgctcgatttagtacacacacttagggatgggactggagtggattggccttacacattatagtgggactacccactacaacccgtccctcagtagtcgagtcaccatctcactagacacgtccaggaatcacctctccctgacggtgacctctgtgaccgccgcggacacggccgtgtattattgtgcgagagacccccgntgaaagatttccctcaatgtactttgacccactgggggccaggggagccctggtcaccgtctcctcacgcctccaccaagggcccatcggtccttccccctggccnccctgctcccgaggcgccacccgtccgacgagcacacggccggcccgtcgggctcgccgtggtcgaaggtacctaccttcccacttaccgtatgctggacggccgggtctggaccgaaggcgacatacgnnnnnnnnnnnnnnnnnn

SEQ ID NO: 295495 - DNA, 672 bp, Homo sapiens
  misc_feature: GYAE6OF01BWQZK.10.59.F04.1.454.CMB.1.raw
  modified_base (181)..(181): a, c, t, g, unknown or other
  misc_feature (181)..(181): n is a, c, g, or t
  modified_base (555)..(555): a, c, t, g, unknown or other
  misc_feature (555)..(555): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtggctcgagtctgccctgactcgagcctcgctcngtcgtccgggtcctcgtgggcagtcagtcaccatcctcctcgcactcggaacctgctagtgtagttggttggttgttaatgttactttcgtcctccgttacggtaaccaacacgacgagcccgaggaccgaaccgacccctaatttcattgttatttacgtgtattcgtcgtagtcggcccggccggtcccgggttcgggtcctgtactccgtcttcgtcgtcggtacctaccgtacgtcggacgtacccgaaccgtccggtaccccttcccgtacgaaccccttacgtcccttaccggtccggtacccctacccggcgtccgtaggtagacgtcggtacgtctagtactacgtcgcgtcgtacgtctaacgtnttaccgtaccggaccgtaccgtaacgggtagggtttcggtacgggtaccggacgggttacgtacggtcccgggtaccgttacgggccgaaccggtccgtacccggtcgggtaccccg

SEQ ID NO: 295496 - DNA, 956 bp, Homo sapiens
  misc_feature: GYAE6OF01DCTII.10.59.F04.1.454.CMB.1.raw
tcagcatagtagtgcacgaccggtgctcgatttagtacacacacttagggagttggggggggtctcaggaggcagcactctcgggacgtctccaccagtggcctgggctctgctcctcctcacgcctcctcactcgagggcacgaggtactccgtggctcgacgtctcgccctgactcgacgcctcgctcgacggtccggttcccgggttcgtaccggtgggacagttacgacgtccaacctacttccgtccgtcgaccgtaaccggtacggaaacccacggtccgtaagtggttagtttcgggttagggttagttacgttcgttacgtttcgtaccgtccgtaaccggtaaccaagtcgacgacgaccgaacggtaccgaaacccgacccgttaactacgtaagttagttaactttaggtactagtcgtacgtacggtccggcggtccccggtacccggtccggggttcctaggttccgtccgttacgttccgtcgtacggtacctaccgttacggtacccggacggacccgtaaccgtcccggttaccctaccgtaaccgtaccgtctttaccccggtccggttacccgtacccgttaccggacccgttacgggttacggtaaaccgggtacggtaaccgggtacggtttaacggtaacgtttttaaccgtttaaccggtttacgggtttcccggtaacgttacccggttaaacgtttaacggttaccgggtaacccgggtaaccggggtttacccgggggtaaaccccgggttttcccgggggtttagggtttccccgggggggtaacggttttaaccccggggggggaacccggtaaaaaccccggggttcccggtaaaaaccggggttttcccccgttaacccggggttaaacccggggtttaccccggtaacggggtttaacccccggcccgggttaaaaacccccgggg

SEQ ID NO: 295497 - DNA, 820 bp, Homo sapiens
  misc_feature: GYAE6OF01B9XEA.10.59.F04.1.454.CMB.1.raw
tcagcatagtagtgcacgaccggtgctcgatttagtacacacacttagggagttgggggctttctgagagtcatggacctcctgtgcaagaacatgaatcacctgtggttcttcctctgctggtggccggccccagagtgggtcctgtcccagctgcagctgcatgagtcgggcccaggactggtgaggtcctttcggactaccctgtccctcagttgcgctgtctcgtggtcgcctccatacaaacgtggtggtcgaactaacgttgggtcggggcgtcgggtcccgccgaccggacccccgagggagtcgggactggagtcggtattcggaccttacactaagttagtaggtacggtacctaaccctacctaaccgaaccccgttccgtacgaagggtacgtaccggacgtaccaaccctaacgttctaccgtaacgtaagaacccgaccgttaccgaacggtaaacttcccgaaccctttccgtaccccgttaggtaaaccccgggttcgtaaacccgtttcgtaacgggttaccgggaacccccgggccccgggtaaccgggaaaccccgtaccgggttaccccggtttaggtttaacgttttaaccggtttgggtaccgaaccgggtacggtaacccggacccccggtagtagtaaaacggtccttaccgttaccgtaaagtttccggtttaaccgtttaccggaacccgtaacgggtccggggggtaacccgaaacgggggttccccggtaccccgtttacggggtaaccccctaaccccgggttcccgttacccgtacccggttaaaccccgg

SEQ ID NO: 295498 - DNA, 814 bp, Homo sapiens
  misc_feature: GYAE6OF01AXZ5U.10.59.F04.1.454.CMB.1.raw
  modified_base (147)..(147): a, c, t, g, unknown or other
  misc_feature (147)..(147): n is a, c, g, or t
tcagcatagtagtgcacgaccggtgctcgatttagtacacacacttagggagttggggggggtcgtcaggaggcagcactctcgggacgtctccaccatggcctgggctctgctcctcctcacgcctcctcactcgagggcacaggntccgtgggcctcagtctcgcccttgacctcgacgcctcgtctcgacgttcggtccgggtctccggtgggcctagtccgacgtccaaccctagttccctcgttcgcctaacgtaccgggaaaccctagtaccgtacggtgtacgttggttcggttaggttacttgttacgtttcgtcgttccttagggtaacccaacgtacgcgtaacggtccgaacgggtacccgtaaacccgtaaccccgtaaacgttctaacgtacgtattttacgaacggttactcggttacgtacgggttacggtcccgggtccgggtccccgggttaccggggttacccgtaggtaacccttccggttacccgtttcgtcccggtacggtcccggttaaacccgtacggtttaccgcgggtaacccgtaaccggtaccccggttcccgtacccgtaccggtacctaccgttacccgtaccgtccggtaccctaccgtacccgttcggtacggacggtacggtacggcggtacgtacgttacggttacgtttacgttcgttccgttacgttacgtattacggtcgtacgtaccggcggttaccgtcgggttagggtccgtcgggggacggacggtacgtacggtccgtacggtacccttacgggtcgaccggtacggacccgg

SEQ ID NO: 295499 - DNA, 787 bp, Homo sapiens
  misc_feature: GYAE6OF01ETGAO.10.59.F04.1.454.CMB.1.raw
  modified_base (256)..(256): a, c, t, g, unknown or other
  misc_feature (256)..(256): n is a, c, g, or t
  modified_base (647)..(647): a, c, t, g, unknown or other
  misc_feature (647)..(647): n is a, c, g, or t
tcagcatagtagtgcacgaccggtgctcgatttagtacacacacttagggattgggggggggtctcaggaggcagcactctcgggacgtctccaccatggcctgggctctgctcctcctcacgccctcctcactcgagggcacgaggactccgtggctcagtctcgcctagactcacgcctcgctcgtaggtcggtcccgggtctccggtgggcacgtcacgtacacctactcctccgtcgaccacgtacgaaccngacgtagtgtaggttggtttacgggtaggttactcgttaccgtttcgttcccttccggtaacggtaaccaacggtacgccgaaccgccggaacggaacccgtaacccgtaaccccttaagtccttagttatttaacgttagtagtacgttcgtaacgtcgggcggtccccgggtcccggggtcccgggttccggggtcctacgtccggttccgtctttccgtccggtacggtacctaaccgttacggtcgtacccggaaccaacccgggtccgtcccccgttaccgtacgaccttcgtccgttccgtaccgtcccgtaccgacgggtccgaggtaacgcggttccggtagtacggttgttaactttacgtttcgtacggtctacgttaacncgttcgacgggtcggttaccgggttaccggttttagggccgggtttcggggttcggaaccggggtacgggtaacgggacccgttagggtaccccgtacggtacccggttccggtaacggaccccgtacgggtaccccggg

SEQ ID NO: 295500 - DNA, 1010 bp, Homo sapiens
  misc_feature: GYAE6OF01DYT6L.10.59.F04.1.454.CMB.1.raw
  modified_base (120)..(120): a, c, t, g, unknown or other
  misc_feature (120)..(120): n is a, c, g, or t
  modified_base (263)..(263): a, c, t, g, unknown or other
  misc_feature (263)..(263): n is a, c, g, or t
tcagcatagtagtgcacgaccggtgctcgatttagtacacacacttagggagttgggggggtctcaggaggcagcactcgtcgggacgtctccaccatggcctggctctgctcctcctcngcctctcactcgagggcacgaggtactccgtgggtcctctacgtctcgccctgacctcgacgtcctcgtcctcgtacggtcggtcccggtcgtccgtcgggctagtcacgtcacctactccgtcgtacgctacgtcgaaccgngcgtagtcgtagttcggtttagggtgttagtcgttaccgtttcgtaccgttaccgtaaccggtaacaacgtacgtaccggtaccggtaccggaacgggtaacccccgtaaaccgttaacccccgtttaaaggtttacccggtaaacggttttcttttaacggttttacgacgggtttacgtttacgggtaccgggttaaccgggttccggtaccccggggttccccggggttaacccccggggttttaacccgggggtttcccttaaacgggtttacccggtttccggtttacccgttttccggtacccggttttaccgggcccgtttaaaccggttaccgggttacccgttaaccgggtaaacccccgttaacccggttaccccggttacccccgttaccgttacccggtaccgttaccccgttttcgggtaccccgttaccccgggttaacccgtaaccggttcccggttaaggggaccccgttacgggggtaacttaccggggttacgttacgggttttaaccgttaacgtttttccggtaaccggttttcggtaacccgttcgttaaccgttacggttcgggacccgggttaacggttccccgggttaaccgggtccggttttacgggttccggggttaacccggggtcgggggaaacccggtaccggaaaccgttcggttacccgggttaaccccgttaaccggggttcctaaccgggtaccccgcccgggttaaaccccgg

SEQ ID NO: 295501 - DNA, 517 bp, Homo sapiens
  misc_feature: GYAE6OF02IFHKU.10.59.F04.1.454.CMB.1.raw
  modified_base (227)..(227): a, c, t, g, unknown or other
  misc_feature (227)..(227): n is a, c, g, or t
  modified_base (346)..(346): a, c, t, g, unknown or other
  misc_feature (346)..(346): n is a, c, g, or t
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtggttatgactttgtctcctggtaccaacagcagccaggcgaagcccccaaaattccatgatttatgatgtcagtgcgcggccctcgggggtccctgatcgcttcnctggctccaagtctgcaacacggcctccctgaccatctctcggcctccacgccttgaggtatgacggctgattattacttgttgctcatatgctaggcgtacgcgtttgggtgttccggcgggagggacccaaggtccgtggacccgttcgtaacggtccgagtaccccgg

SEQ ID NO: 295502 - DNA, 506 bp, Homo sapiens
  misc_feature: GYAE6OF02F8OI8.10.59.F04.1.454.CMB.1.raw
tcagcatagtagtgcacgaccggtgctcgatttagtacacacacttagggattgggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctgctcaagtctggcaacacggcctcctgaccatctctcggcctccagcctgagatgagctgatttatacttgttgctcatatgcaggtccgtacgtcgttggggtgttccgggcggagggaccaaggtccgtcggacccgttcctacgggtcacgtacccg

SEQ ID NO: 295503 - DNA, 433 bp, Homo sapiens
  misc_feature: GYAE6OF02IY4WQ.10.59.F04.1.454.CMB.1.raw
  modified_base (333)..(333): a, c, t, g, unknown or other
  misc_feature (333)..(333): n is a, c, g, or t
  modified_base (421)..(433): a, c, t, g, unknown or other
  misc_feature (421)..(433): n is a, c, g, or t
tcagcatagtagtgcacgaccggtgctcgatttagtacacacacttagggatgggactggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcagcctccaccaagggcccatcggtcttccccctggcgccctgctccaggngcacctccgagagcacagcggccctggggctgcctggcaaggactacttcccactactatgctgagcgggctgggcaaggcgcatagnnnnnnnnnnnnn

SEQ ID NO: 295504 - DNA, 558 bp, Homo sapiens
  misc_feature: GYAE6OF02G01KS.10.59.F04.1.454.CMB.1.raw
  modified_base (460)..(460): a, c, t, g, unknown or other
  misc_feature (460)..(460): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggcctttcggataccctgtccctcagttgcgctgtctctggtgctccatcaacagtggtgacaactggtggggctgggtccaccagccccccagggatggggactgggagtggattggccttacacattatagtgggactacccactacaacccgtcctcaggagtcgagtcaccatctcactagacacgtccaggaactcacctctccctgacggtgacctctgtcgaccgccgccggacacggccgtgtattattgtgcgagacgaccccgntagaagacttcctacaattgtaacttttcggaaccctacggttcggggcccaggggacgtccccgttgggtcccacccggttcctcccgtctacccgg

SEQ ID NO: 295505 - DNA, 546 bp, Homo sapiens
  misc_feature: GYAE6OF02GFWWG.10.59.F04.1.454.CMB.1.raw
  modified_base (263)..(263): a, c, t, g, unknown or other
  misc_feature (263)..(263): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgtggtgtatgacttgtctctgtaccangcagcaggcgaagccccaattcatgatttatgatgtcagtgcgcggcccgtcgggggtccctgactcgcttctctgtctccagtctggaccaacgaccggccctcccgtgaccctagtcctcgtcggcccttccacgtccctggaggtactggacgtctaggtactttatactgtttcgcttactattatcgacgtacggtcggtaccgtgttacggggtgttccgggacgggtacgggtaccgaagtccgtcggtaccgttccggtaggtccgacgtacccg

SEQ ID NO: 295506 - DNA, 577 bp, Homo sapiens
  misc_feature: GYAE6OF02H5WIL.10.59.F04.1.454.CMB.1.raw
  modified_base (408)..(408): a, c, t, g, unknown or other
  misc_feature (408)..(408): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtgctccatcaacagtggtgacaactggtggggctgggtccgccagccccccagggatgggactgggagtggattggcctttacacacttatagtggggacttacccactaccaacccgtccctcaggagtcgagtcaccatctcactagacacgtccaggaatcacctctcccctgacggtnacctctcgtcgaccgccgcggacacggccgtgtatattgngcgagacgaccccgntagaacgtacttacctcaaacttgttaaccgtttttcggaaccctacggttcgggggacccagggggacgtccccgttgggttacccacccggttccttcccgtcgtaacccgg

SEQ ID NO: 295507 - DNA, 634 bp, Homo sapiens
  misc_feature: GYAE6OF02JX37M.10.59.F04.1.454.CMB.1.raw
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (228)..(228): a, c, t, g, unknown or other
  misc_feature (228)..(228): n is a, c, g, or t
tcagcatagtagtgcacgaccggtgctcgatttagtacacacacttagggattgggggggttctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccntcncctgcactggaaccngcagtgatgtgtgttatgactttgtctccgtgtaccacagcagtccaggtcgaacgcccgaaattcatgatttatgatgtcagtcgcggccggtcccgtacgggggtccctgacgtcgctttcgtcgtggcctccgaacgttccgtcggccaaaccgccggccctcccgtcgacccattcctccgtcggaccccttcccacgccgttagacgggtaacttcggacggtctggtaactttacttaccgttgttacgtaccttacctaagtactcggaccgtacgggtcccgggttacccgtcggttacgggggtttccggtttaccggggaccgggtaacgggtaacccgaacggtccgtaccgggtaccccggttccgtaaccggggttccgaccggtaaccccgg

SEQ ID NO: 295508 - DNA, 566 bp, Homo sapiens
  misc_feature: GYAE6OF02FXY1U.10.59.F04.1.454.CMB.1.raw
  modified_base (268)..(268): a, c, t, g, unknown or other
  misc_feature (268)..(268): n is a, c, g, or t
  modified_base (360)..(360): a, c, t, g, unknown or other
  misc_feature (360)..(360): n is a, c, g, or t
  modified_base (374)..(374): a, c, t, g, unknown or other
  misc_feature (374)..(374): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccggtctcctgggcagtcagtcaccatctcctgcactggaaccagcagtgatgttggtggttatgactttgtctcctggtaccanagcagccaggcgaacgcccccaaattccatgatttatgatgtcagtgcgcggccgtcggggtcctgactcgcttctctgctcagtctgcacncgcctcctgacctntctctcggccctccgacgtcctgaggtatggacgtctagtatttattacttgttgtctctattacgtcggaccgtagggtccggttacccgtcggtttcggggttcggtttaccggggaccgggtaacggggtaacccgaacggtccgttaccggtacccggttaccggtacggtacccgacgtacccccgg

SEQ ID NO: 295509 - DNA, 529 bp, Homo sapiens
  misc_feature: GYAE6OF02H2GYN.10.59.F04.1.454.CMB.1.raw
  modified_base (240)..(240): a, c, t, g, unknown or other
  misc_feature (240)..(240): n is a, c, g, or t
  modified_base (359)..(359): a, c, t, g, unknown or other
  misc_feature (359)..(359): n is a, c, g, or t
  modified_base (396)..(396): a, c, t, g, unknown or other
  misc_feature (396)..(396): n is a, c, g, or t
  modified_base (402)..(402): a, c, t, g, unknown or other
  misc_feature (402)..(402): n is a, c, g, or t
  modified_base (447)..(447): a, c, t, g, unknown or other
  misc_feature (447)..(447): n is a, c, g, or t
  modified_base (459)..(459): a, c, t, g, unknown or other
  misc_feature (459)..(459): n is a, c, g, or t
  modified_base (498)..(498): a, c, t, g, unknown or other
  misc_feature (498)..(498): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggcctttcggataccctgtccctcagttgcgctgtctctggtgctccatcaacngtggtgacaactggtgggctgggtccgccagcccccagggatggggactggagtggattggccttacgacattatagtgggactaccactaccaaccgtcctcagatcgagtcacatcncactagacacgtccaagatcacctctccctgacggtnacctcngtcgaccgccgcggacacggcctgtatattgtgcgagcgacccgntagaagattccnctaatcgttacttcgacctacgtcggggaccaggggtcncccgttggtccaccggtctcccgtctacccg

SEQ ID NO: 295510 - DNA, 533 bp, Homo sapiens
  misc_feature: GYAE6OF02GDOZE.10.59.F04.1.454.CMB.1.raw
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctctggtgctccatcaacagtggtgacaactggtgggctgggtccgccacgcccccgagggactgggactggagtggagttcggccttacactattatagtcgggactacccactaccaacccgtccctcaggagtcgagtcaccatctacactagacacgtccaagaactcacctctccctgacggtcacctntgtcgaccgccgcgacncgcgtgtattattgcgcgacgacgacccgctagaancttccanaattgtacttcgacctacgtcgggaccaggtcgcccgtggtccaccgtctcctctaccg

SEQ ID NO: 295511 - DNA, 531 bp, Homo sapiens
  misc_feature: GYAE6OF02HLZEJ.10.59.F04.1.454.CMB.1.raw
  modified_base (271)..(271): a, c, t, g, unknown or other
  misc_feature (271)..(271): n is a, c, g, or t
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgtactttgtctcctggtaccaanagcagccaggcgaacgccccaaattcatgtatttatgatgtcagtgcgcggcccgtcggggtcctgactcggtctctcgcctcagtctcggacacgacggccctccgtgaccgtctcgtcggctccgaggctggaggngtggagtctgtattacgtactgacagcnctattactcacggacccaagtgggttgttcgggcggtcgggtacgtacggtcgtaccgtcggtcggccgacgacccgaaggccgtccgtccccg

SEQ ID NO: 295512 - DNA, 604 bp, Homo sapiens
  misc_feature: GYAE6OF02ILGTH.10.59.F04.1.454.CMB.1.raw
  modified_base (237)..(237): a, c, t, g, unknown or other
  misc_feature (237)..(237): n is a, c, g, or t
  modified_base (275)..(275): a, c, t, g, unknown or other
  misc_feature (275)..(275): n is a, c, g, or t
tcagcatagtagtgcacgaccggtgctcgatttagtacacacacttaggggattggggggggtctcaggaggcagcactctcgggacgtctcccaccatggcctgggctctgctcctcctcagcctcctcactcagggcacaggatcctgggctcagtctgccctgactcacgcctcgctcagtcgtccgggtactccgtgggcctagtccagtcaccatctcctgcactggaaccngcagtgatggttgtgttatgacttgtctctcgtaccancgcagccaggcgaacgaccccaattcatcgatttatgtatgtacagtcgcgccggtcccgtcggggtcctgactcgtcgttctcgtcgctaccgtagtcgtcgacaccgccggtcccctaccgtcgacctcgttactccgtacggtccctaccgacgtaccgtgacggttatcggtacgcttagtactttagttaccgttgttcgtacttcgtactttagaccggtacgtacgggtcccggttacgtcggtttcggggtggttccgggacggtacgggacccgtaacggtccgttacggtacccggtccgtaggtcccgaacgtcccgg

SEQ ID NO: 295513 - DNA, 548 bp, Homo sapiens
  misc_feature: GYAE6OF02HE017.10.59.F04.1.454.CMB.1.raw
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (307)..(307): a, c, t, g, unknown or other
  misc_feature (307)..(307): n is a, c, g, or t
  modified_base (365)..(365): a, c, t, g, unknown or other
  misc_feature (365)..(365): n is a, c, g, or t
  modified_base (393)..(393): a, c, t, g, unknown or other
  misc_feature (393)..(393): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccngcagtgatgttggtggttatgactttgtctcctggtaccaacngcagccaggcgaacgcccccaaattcatgattttangatgtcagtgcgcggcccgtcgggggtcctgactcgcttctctgctccagtctgcacncgccctcctgaccatctcgtcgccctcncgcctgacgtatggagtctagtatttacttaccgttgttcgtcttctagttagtcgacgtacgggtccggttacccgtggtttcggggtcggttcgggcgggaacgggtaccgaaggtccgtacggtccgttaccgtaggtcccacggtacccgg

SEQ ID NO: 295514 - DNA, 670 bp, Homo sapiens
  misc_feature: GYAE6OF02IONT1.10.59.F04.1.454.CMB.1.raw
  modified_base (229)..(229): a, c, t, g, unknown or other
  misc_feature (229)..(229): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtcgtccggtctccgtggcagtcagtcacatctcctgcacgtcggaaccngcagtgattggttggtggttatgtactttgtcctcgtggtaaccaacagcacgccaggacgaaccgacccctaaattcaatgtactttagtgtatcgtacagtcgccgcggtcccggtcggggtcctggtacgtcgtccttacgtcgtcggtcctacctaacgttccgtacgacctaaccgtacccggtccctacccgtcgacctacgttccgtacgtcgtccctcccgagtccgtagtacggtagtacggacgtcgtacgttaagttttacgttaccgtttggtttaccgcgttaactagttacggtcgaccggtacggttaccggtaccgttgggtttcgggtaacgggtttccggggaccgggtaacgggtaacccgaagggttcccgtaaccgggttacccggttaccggtaacggttacccgaccggtaaccccgg

SEQ ID NO: 295515 - DNA, 737 bp, Homo sapiens
  misc_feature: GYAE6OF02I5VUO.10.59.F04.1.454.CMB.1.raw
tcagcatagtagtgcacgaccggtgctcgatttagtacacacacttagggattggggggggtctcaggaggcagcactctcgggacgtctccaccatggcctgggctctgctcctcctcgccctcctcactcagggcacagggtcctgggcccagtctgccctgactcagcctccctccgcgtccgggtctcctggacagtcagtccaccatcctcctgccactggaaccagcagtgtactttgttgcttaataactatgtctcctggtaccagccaccacccaggaccaaacgcccccctaaacttcccgtttagtttttacggacggttcaaggttaacggccggccctacgacgggtacttcccctggacttcggttctctcggcctccgaagtctggacctaacgcggcctccgtcgaccctcgtcgtcgggtcctccgtaggcctgggaacggtagtcggacggtcttacgtaactttaccgtacgttcggaccgtacggcgtaccgtaacttacgtttccggaaccggtaccccgtaaacggtagggggtttcggtttacggggccgggtaaccggggttaacggtaacgggttccggaacccggttccgggtacgggttaccgaccgggtaaccccggtaaggccccggttacccggtaccccccggttcggtacccttaaccgttcccggttacccggtttaccccctacccggttcccctaaccccgg

SEQ ID NO: 295516 - DNA, 559 bp, Homo sapiens
  misc_feature: GYAE6OF02GSS81.10.59.F04.1.454.CMB.1.raw
  modified_base (229)..(229): a, c, t, g, unknown or other
  misc_feature (229)..(229): n is a, c, g, or t
  modified_base (362)..(362): a, c, t, g, unknown or other
  misc_feature (362)..(362): n is a, c, g, or t
  modified_base (386)..(386): a, c, t, g, unknown or other
  misc_feature (386)..(386): n is a, c, g, or t
  modified_base (425)..(425): a, c, t, g, unknown or other
  misc_feature (425)..(425): n is a, c, g, or t
  modified_base (433)..(433): a, c, t, g, unknown or other
  misc_feature (433)..(433): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctccgtgggcagtcagtcaccatctcctgcactggaaccngcagtgatgttggtggttatgtactttgtctcctggaccaagagcagccaggcgaacgcccccaaatcatagtatttatgatgtactagtcgcgccggcccgtcgggggtcctgacgtcgtcttctcgtcgcnctagtctcgcaacgaccgcctccngaccagtctcgtcggcctccgcgccgttgaggtcgtagngtctagtnttacgttacgttgttcgcttacaagttgtacgcgtacgggccgttcgtcggttgggttcggtcgggtaccgggtaaggtaccgtaaggtcgtacggacccggttacggtacggtcccgtagcccgg

SEQ ID NO: 295517 - DNA, 620 bp, Homo sapiens
  misc_feature: GYAE6OF02IOQH7.10.59.F04.1.454.CMB.1.raw
  modified_base (386)..(386): a, c, t, g, unknown or other
  misc_feature (386)..(386): n is a, c, g, or t
tcagcatagtagtgcacgaccggtgctcgatttagtacacacacttagggattgggggggtcgtcaggaggcagcactctcgggacgtctccaccatggcctgggctctgctcctcctcagcctcctcactcagggcacaggatcctggactcagtctgccctgactcagcctcgctcagtgtccgggtctcctgggcagtcagtcaccatctcctgcactggaaaccagcagtgattgttggtggttatgacttgtctctggtacaacagcagccaggcgaacgcccccaaagttcatagactttatcgattgtcagtgcgcggccctcgggggtcctgactcgcttctcgtgctccaacgtctggtccaacgacgcccttaccncgacccattccgtcgtcggtccctccgacgtcccgtcggaacggtatcgggaacggctacggacgtttaactttacctaggtttcgccttccgtaattacgttacggcgtacgggtcccgttaaccggtcgtttcgggggttacggtttccgggcggggtaaccgggtaaccgtaaagggtcccgttagggtaccccggttaccggttacgggtaccgtaccggtaaccccggg

SEQ ID NO: 295518 - DNA, 603 bp, Homo sapiens
  misc_feature: GYAE6OF02JC2NX.10.59.F04.1.454.CMB.1.raw
  modified_base (397)..(397): a, c, t, g, unknown or other
  misc_feature (397)..(397): n is a, c, g, or t
tcagcatagtagtgcacgaccggtgctcgatttagtacacacacttagggattggggggggtctcaggaggcagcactctcgggacgtctccaccatggcctgggctctgctcctcctcagccctcctcactcagggcacaggatcctgggctcagtctgccctgactcagcctcgctcagtcgtccgggtctccgtgggcagtcagtcaccatctcctgcactggaaccagcagtgattgttggtggttatgtactttgtctctggtaccaacagcagccaggacgaacgccccctaaattcatgtactttatgatcgtcagtgcgcggcccgtcggggtccctgacgtcgtcttctcgtgcctaccgaagtctcggacaaccgaccgccctcccncgaccctactccgtcgtacggtccctccgacgtccgtaggtacgtagtcggacggtcctaggttaactttacgtttaccgttaggtttccgtaccttactaacgttagtcggacgtacgggtccggttaccgttggttacgggggttcgtccgggacgggacgtaccgaggtcgtacggtcccgttacgtggtaccagtaccccgg

SEQ ID NO: 295519 - DNA, 581 bp, Homo sapiens
  misc_feature: GYAE6OF02FV87E.10.59.F04.1.454.CMB.1.raw
  modified_base (489)..(489): a, c, t, g, unknown or other
  misc_feature (489)..(489): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggataccctgtccctcagttgcgctgtctcgtggtggctccatcaacagtggtgacaactggtggggctgggtccgccgacgccccccgagggacgtggggacctgggaggtgggaagtttcgggcccttacgacctaattataggtgggacctacccactaccaacccgtccctcgacggagtcgagtccaccatctacactacgacacgtccaaggatccacctcctcctgacgtcgacctctgtcgaccgccgcggacgcggccgtagtattattgtcgcgagaccgacccgngtagaacgtacgttccactattcgtactttagacctacgtcggggccgacgggacgcccgttcggtacctaccggttcctccgtcgtacccg

SEQ ID NO: 295520 - DNA, 579 bp, Homo sapiens
  misc_feature: GYAE6OF02FK3XI.10.59.F04.1.454.CMB.1.raw
  modified_base (348)..(348): a, c, t, g, unknown or other
  misc_feature (348)..(348): n is a, c, g, or t
  modified_base (365)..(365): a, c, t, g, unknown or other
  misc_feature (365)..(365): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttgtggtatgactttgctcctggtaccaacacgcagccaggcgaacgccccctaaattccatgatttatgatgtcagtgcgcggcccgtcggggtcctgactcgcttctcngctcagtctcgcaaccncgtcctcctcgacctagttcctcgttcggccctccgacgccgttaggacggtactaggcggttctagtaacgtttattacttggtttcgacttacgtataagtgccgtacggaccgttacccggagtttcggggtcggttacgggaccggggtacgggtaaccgaacggtaccgttcgggacccgttaccggtacggtaccgacgtaaccccgg

SEQ ID NO: 295521 - DNA, 713 bp, Homo sapiens
  misc_feature: GYAE6OF02JC6CO.10.59.F04.1.454.CMB.1.raw
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgactttgtgcttataactatgtctcctggtaccagccaccaccagcaaacgccccaactccttgttttgagtcagtacgccggcctcgaggacgtcctgacgttccggttctctcgtcctccgtaacgttccgtacggacctaaaccgaccggcccttacccgtcgtacccgttccgtccgtacgggtcctcccgtacggtccgttacgggacggtacgtcggacggtccgttaggtaactttaccgtaacgtcgaccgtagggaccgtaccgtaacttaccgtaccgaaccggtacccccgtaaacgggttcggggttacggtttaccggggtaccggggtaccggggttaaccggtaaacgggttcccggtaacccgggttaccgggttacggggttacccgaacccggtaccccggtaaacgggtcccgttacccgggtacccccggtttaccgggtcccttaacccgtttccccgg

SEQ ID NO: 295522 - DNA, 900 bp, Homo sapiens
  misc_feature: GYAE6OF02JD9OD.10.59.F04.1.454.CMB.1.raw
  modified_base (156)..(156): a, c, t, g, unknown or other
  misc_feature (156)..(156): n is a, c, g, or t
tcagcatagtagtgcacgaccggtgctcgatttagtacacacacttagggattggggctttctgagagtcatggacctcctgtgcaagaacatgaatcacctgtggtcttcctcctgctggtggcgcccccagagtgggtcctgtcccagcttcgngactgcatgagtcgggcccgacggactacgggtggaggcccgttccggtacgtaacccgtcccccccgttgaaccggttttcgacgttccgtcgggtcccttccgttgggttccggcgtttccccgaagtttcccaaaaccgaccggttacgggttacgacgtaacggtacgggttacggggtccgtcggggggttcccggtccggtaccgggtcccccccggaaggggaccccgtacgggggggaaccgttcggggtaaccggttgggggaaacgttcgggaccccgttttacggaccggttaacctttaacgtaacggtttacgggtaacccttaaccggtaaccgttaaccccgaacccccggtacccctacccgtaccggtaccgttaccgggacggttacccgtacccgtacttacccgacctaccgtacgaacctacggtacccgaaccgggtacctaccgaaccttccgtaccccgacggttacccgtaccgtacccgttcgtccgtacccggtacccgtaccgggaccggaacccgcggggtacccgttacggtaccgtttacgttcggttacggtccggtaacggtacccggacccggtacgtaccggaaccggttaccttacccgtacgtaaacctttcgtaacgtttccgtaacctacggtcgggaaaccccggtgggacccgtcccgggtggtaccccgtacgtcccgttacctaccgtccgtcccgtaccg

SEQ ID NO: 295523 - DNA, 653 bp, Homo sapiens
  misc_feature: GYAE6OF02GTQC1.10.59.F04.1.454.CMB.1.raw
  modified_base (210)..(210): a, c, t, g, unknown or other
  misc_feature (210)..(210): n is a, c, g, or t
  modified_base (228)..(228): a, c, t, g, unknown or other
  misc_feature (228)..(228): n is a, c, g, or t
  modified_base (500)..(500): a, c, t, g, unknown or other
  misc_feature (500)..(500): n is a, c, g, or t
tcagcatagtagtgcacgaccggtgctcgatttagtacacacacttagggattgggggggggtctcaggaggcagcactctcgggacgtctccaccatggcctgggctctgctcctcctcagcctcctcactcagggcacaggatcctgggctcagtctgccctgactcagcctcgctcagtgtctgggtctctggacagtcgatcaccntcctcctgcactgaaccngcagtgacgttggtggttatactatgtctcctgtaccaacaacacccaggccaaacgacccccaatcatgtattttgatgtacagtaatccggacccttcgtagggttctaatcgtaccttctcgtcggtctccgaaagttccgtcgacaaccgtaccggtaccccttcccgtaccgtacccgtacttccgttaccggttacgggccttcccggtaacggtcgtcggtaacgggaccggaacgggttcgtagtaaactttacgtttaaccgngtaccgtacgtaccttacaacgttaactaacccaaccacggtacaccggctaccgttaccgtagtttccggttacggggaccggtaacgggaccgaaggccgttacggtacccggtccgttaccggcccgtaccgcccggtaacggtccccgg

SEQ ID NO: 295524 - DNA, 699 bp, Homo sapiens
  misc_feature: GYAE6OF02GWY1T.10.59.F04.1.454.CMB.1.raw
tcagcatagtagtgcacgaccggtgctcgatttagtacacacacttagggattggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatcctcctgcactcggacccactagttacagttaggtaactaatgaatatcgtcttcctggtaccaacgacgtacccaggtaccaaacgcccccaaaactgacttagatttagtcgattcgtacagtaatccgtaccctgtacggggtttctgtactccgtctttcttcgtccctaccgaacggttcctagggaaccaacgtaccggcccttacccctggaccctatcccgttccgtcgggtcccttaccgacgaccgtgggaacggtacgacggtactggtatttacttacgtcgacgtacgtacctacaacgtaataaccggacgtaccggtacggacggttcggggtttcgggttacgggttccggggaccggggtacctacgaccgtcggacccgttaccggtacgggtacgtacccggaccgtaaccggttccgtacccggtccccgttacggtcccgtacgttcccgtacccgtttaccccccg

SEQ ID NO: 295525 - DNA, 715 bp, Homo sapiens
  misc_feature: GYAE6OF02GZPUF.10.59.F04.1.454.CMB.1.raw
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (311)..(311): a, c, t, g, unknown or other
  misc_feature (311)..(311): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtgggctcagtctgccctgactcagcctcgctcagtcgtccggtctcgtgggcagtcagtcacntctccngcacgtgaaccagcagtgattggttggtaggtatgtacttgtctcgtagtacaacngcagccaggcgaaccgcccctaaattcagtgtatttagngtatgtcgagtcgcgccggccgtcggggtcctgatccgtctcgtcgtcgtacctacgtacggtcgtacgaccgtaaccgaccggtacccgtcccgtaccgtacccgtacttccgtaccgttccggtaccctacccggtaccgtccgttacgggtacggtaacggtacggtacgggttacgttacgttaactttaacgtttaacgttcggttacgttaccgtttaccgtaacgttacgtacgtaccggtaacggggtccccggttaccgggttccgggtttacgggggtttccgggttaccgggggtaccgggggtaacccgggtaacccggttaaccggtccggttaacccgggtaccccggttaacccgggttacccggttacccggaacccggtaacccggg

SEQ ID NO: 295526 - DNA, 706 bp, Homo sapiens
  misc_feature: GYAE6OF02IKBY1.10.59.F04.1.454.CMB.1.raw
  modified_base (293)..(293): a, c, t, g, unknown or other
  misc_feature (293)..(293): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcgagggcacaggatcctgggctcagtctcgccctgactcagcctcgctacagttcgtcccgggtctccgtgggctagtccagtcacatctcctgcacgtaggaaccagtcagtgacttggttggtcggttatgtacgtttcgtacctcgtacggaacctaanacgtacacgaccgacgggaccgaaccgaccccctaaattacgtactagtaacttttagtacgtattgtactaggtccgccggtccgggtaccccggtccgggggttacctggacctaccggtcttacgtccgtacgtcctaccgaacggttccgtacgtacccgtaaaccgtccggtccccttacccgtacgtacccgtacttccgtccggtccgtcccgtacccgacgtccggtaaggtacgggtacgttaaggtaccgttacgttaggttaactttacgttacgttacgttagtcgttactagttacgtacgtaccgtacggttacgtccggttcggttcgggttcggttacgggaccggtaacggccgtaaggtccgtacggtccgttacggacgttccggactacccgg

SEQ ID NO: 295527 - DNA, 919 bp, Homo sapiens
  misc_feature: GYAE6OF02JU91U.10.59.F04.1.454.CMB.1.raw
  modified_base (201)..(201): a, c, t, g, unknown or other
  misc_feature (201)..(201): n is a, c, g, or t
tcagcatagtagtgcacgaccggtgctcgatttagtacacacacttagggattggggggggtctcaggaggcagcactctcgggacgtcaccaccatggcctgggctctgctcctcctcaccctcctcactcgaggcacgagggtcctgggcccagtctgccctgactcagcctccctccgcgtccgggtctcctaggacngtcacgtccacctatctccgtgccgaactcggaaccgcgtacgtcgtacgttttcggtcgtacttaactaacgttcgttcggttaaccttccgttacgggttaacccacggtaacccaaccccgaaccccggtaaacggacccgtaaaacccggtaaccccccttaaaccgtttcccgttttaggtttttacggaacggttaccgaaggtttaaaccggcccggtaccttacggacggggtaccgttacccgtggttaccgtttacggttcctacgtacggttaccctacgtaacgttcgacgggtctaaacccggaccggtacccttaccggtcggttaacccgtcgtccggttccgggtaccgtaccggtcgggtaccggtacggtaacgggtacgtacgggtacggttaccgtaacggttaaccttacgttaaccgggtaccgttaccggaacgttacccggtaacgttaacgttaacctacccgggtaacccgtaaaccccggttagggtaacccgggtttcgggttaacccggggtacgggtaaccgggttacggtaaacccgggttaccgtaccccggggttacggttccggggtaaccgtaacccgggttaacccggacggttacccgtaccggttaccccgttaccggtcccgttaaccggtacccgtttaccccggttaccccgtaccccgtttcccgttaaaccccgg

SEQ ID NO: 295528 - DNA, 743 bp, Homo sapiens
  misc_feature: GYAE6OF02IDSAP.10.59.F04.1.454.CMB.1.raw
  modified_base (148)..(148): a, c, t, g, unknown or other
  misc_feature (148)..(148): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (232)..(232): a, c, t, g, unknown or other
  misc_feature (232)..(232): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcgaggcacaggatccgnggctcagtctcgccctgactcacgcctcgctcagtcggtccggtctccgtggcngtcagtcacntcctctgcacgtacgaaccngctagtgattggttggtgttatgtactttcgtactccgtacggtaaccaagcgtcgacgccgacggaccgtaaaccgtaccccctaaagttccacgttacgttaacgttttatgtaacgttcgttacgaggtccggccgggtaccggtccccggttccgggggtaccctggtaccgttccgtcggtttactccgttcggtacccttaccgtaacggttccggtacgggtaacccgtaaacccggtacccggttccccgtaacccgtaccggtaaccttaccgtttacccgttacccgtccggttccccgtaccggtaccgtaccggttacgggtaacggtacgttaccgggtaacgtcgttacggttaacgttttacgttcgttcgtcgtacctacgtagttacgcgaccggttacggtccgtacgggttcggttcggggtacggttacgggaccggtaacggaacctcggtacgtccgtaccggttacggtacgccgtacgtaacccggg

SEQ ID NO: 295529 - DNA, 820 bp, Homo sapiens
  misc_feature: GYAE6OF02IZOQZ.10.59.F04.1.454.CMB.1.raw
tcagcatagtagtgcacgaccggtgctcgatttagtacacacacttagggattgggggctttctgagagtcatggacctcctgtgcaagaacatgaatcacctgtggttcttcctcctgctggtggcggcccccagagtgggtcctgtcccagctgcagctgcatgaggtccgggacccaggacgtggtgacggccgttcggactacccctcggtcccctacgtagttcgccggtctcgtcgttcgttgggtcggtccttacccactaccaaacgtaggtggtacgaacgtaaccgtgggggtcggggtcggtcggggtcccgcccgaccggccccccggaagggacgtcggggtaccgtgggaggtcggtagttcggtaccttaacactagttagtagggtacggtaaccctaaccctaacctacccgtaaccccgtccctacgaagggacgtccgaacgtccaccgtactcctaacctacgtaacgtaccgtaaccgtaccgaacggtaactacccgtaacccctttccctacccggtaccggtaccgggtaccgtacccgttcgttacgggaccccggtacccgggcccgggtacccggaacccgggtcccggtaccggttacgttaaccgttttacgttaccgggcgtaccgggacggaaacccgtaccccgtagtaaccggtaaacgtaccctttaacccgtacgttaaccgttacgtttacgttaccggtaccggtaacggtaccgggaccgtaagggtcccgttacccgggttacggttacccgtcccggtcccttacccgaggtaacccccg

SEQ ID NO: 295530 - DNA, 780 bp, Homo sapiens
  misc_feature: GYAE6OF02IYIBY.10.59.F04.1.454.CMB.1.raw
  modified_base (154)..(154): a, c, t, g, unknown or other
  misc_feature (154)..(154): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
tcagcatagtagtgcacgaccggtgctcgatttagtacacacacttagggattgggggggggtctcaggaggcagcactctcgggacgtctccaccatggcctgggctctgctcctccgtcacgcctctacactcgaggccacgaggattccgngggcctgagtcgtaccgcccgtgactcgcgtccncnctctaggtcggttccggtccttccggtcggtacgactacgtacgtaccaacgtacctccttaccggtactaccgacgtaaccggaaccgacgtacgaaggtgttaagttggttagggttaggtttaactacggttactttcgttaccgtcgttaccggtaacacggtaccgagtaccgccgtaacggtaaccggaacctaccgtaaacttcggtaattacgtactttagagtacgtagacgtaggtcgacggtccgggtccgtaccggggtctaaccggtgtccgtcgttacgtactacccggtctaaacccgtacgtcggttaaccgaacccgtaaccgcccggtttacccgtaccggtacctaaccgtcccgtaccgtaccggttcccgtacccttaccggtacgtaacccggtaggtaacgttacggaccggttggacgttaacggtttaacgttacgtttacggttagtttaccggccttactaaagttcgacggtaacgacggttaccggtcggtacggttacggtcgggtaccggtacggaacggtagaccggtcgtaacgcggttacgaacgtcacgtaccgg

SEQ ID NO: 295531 - DNA, 872 bp, Homo sapiens
  misc_feature: GYAE6OF02FXUQ6.10.59.F04.1.454.CMB.1.raw
  modified_base (207)..(207): a, c, t, g, unknown or other
  misc_feature (207)..(207): n is a, c, g, or t
  modified_base (247)..(247): a, c, t, g, unknown or other
  misc_feature (247)..(247): n is a, c, g, or t
  modified_base (280)..(280): a, c, t, g, unknown or other
  misc_feature (280)..(280): n is a, c, g, or t
tcagcatagtagtgcacgaccggtgctcgattttagtacacacacttagggattgggggggggtctcaggaggcagcactctcgggacgtctccaccatggcctgggctctgctattcctcaccctcctcactcagggcacgagggtcctgggcccagtctgccctagactcacgcctgacctccgtgtctgggtcctccgtggacngtcgactcactatcctcctgaccacgtcggaccaacgacncgaggtacactagtacggtgtaccttataactnttacgttcctaccgtacggtaacccaacgaaccacccgacggacccaccggacccccagaccttacaacttcctacttttcgtaggtacttacgtacctaggttacggtaaccgttcccgggttaccggtttttacgggttaacttttaccgttaaacgtttcccggtacctttccgtttcccgttacgcccctttaacggaacgttttccgcggttaacccgaacccggtttaccgtaccgtttacccgtaacgtaccctaccgttacccggggtcccggtaccctcccgtaacggtaccggttacgggaaccgggtacggtaccgtacctttacgttatttaacgttaccggtagacgttaccgtactaccgtaaacgttaaccggacccccggtaaagaacccgggttacccctaggttaccccgtttacggtacggttaaccggtttaccggggtttcccgggaacggggggtttaaccccggggtaccggtttaccggggtttaaccccggtcccggggtttaaacccggtttaccccgggtaaacccggtccccggaacccggggttacccgttaacccccggggg

SEQ ID NO: 295532 - DNA, 812 bp, Homo sapiens
  misc_feature: GYAE6OF02JTTL9.10.59.F04.1.454.CMB.1.raw
  modified_base (173)..(173): a, c, t, g, unknown or other
  misc_feature (173)..(173): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggatccgtgggctcgagtctcgaccctgactcngcctcgtactcgagtcgtccggtctccgtggctagtcngtaccnctatccgtacctgcctaacgtcggaccacgccgtaaggttcgacgttggtttacggttagttacgtacggtttaccgttttacggttccgttaccgtttaggtaaaccccgtaagtaccggtaccgtacggttaacccgaacgggacccggtaacccggttaaccccctaaaacggtttccgtaaacgttacggttaacgttttaacgtacggtaacgtttccggtacgtaccgggtacgtccccgggttccggtaaccccgggtttcggggtaccctaggtaccgtccgtttcttccgtacgtcgtaccgttaccgacggttcgacgacgtccgtaccggtcccgtacctacccgtaacgtaccgttcgtccgtcgttaccctcgtaccgtcgtacggtagtccgtaggacgttaccgtagttacgttacgttacggttacttacggtaccttacgtacggttaaccgaacgtccggtaaccggttcccggtacgtttacggttccgggcggtttaccgggccggttaaaccgggaccgttacggtaccgtcccggtaccggtaccgtttacgggacccgtacccggtaacccg

SEQ ID NO: 295533 - DNA, 744 bp, Homo sapiens
  misc_feature: GYAE6OF02HRQAE.10.59.F04.1.454.CMB.1.raw
tcagcatagtagtgcacgaccggtgctcgatttagtacacacacttagggagttggggggggtctcaggaggcagcactctcgggacgtctccaccatggcctgggctctgctcctcctcagcctctcactcgagggcacaggactccgtgggctcagtcctcgcctgtactcacgcctcgctcgacgtcggtccggtctccgtggcagtcagtcacatcctctgcatcgacagctagtgagttggttggtagttagtcgtacgtttgtccttccgtacggttaaccaacgacgtacacggaccgtacggaccgaaccgtacccccgtaaattccgtacgtacgtacgtttactgtacgtgtcgtaaggtcggaccggtccggtcccggttccggggttcccgtagtacgtccgttacgttccgtcgtcggtacctacgtacggttccgtacggtaccgtaaccgtaccggtccccttacccgtacgtaaccctacgttacccgttcggtaccggaccctaccggtaacgtcccgttaaggacgggtacgtcgggaccgtctaaggttaccgtttaacgtacgttccggaccgttacgttcctacgttaaacctaaccgtaaaccgacgtaaccggactaccgttacttacccggtttacggtaccgtaaccggggttaccgggaccggttaaaccgggtcccgaaggtttacccggaccggttacccggttcgttaacccggg

SEQ ID NO: 295534 - DNA, 717 bp, Homo sapiens
  misc_feature: GYAE6OF02F1BFG.10.59.F04.1.454.CMB.1.raw
  modified_base (218)..(218): a, c, t, g, unknown or other
  misc_feature (218)..(218): n is a, c, g, or t
  modified_base (239)..(239): a, c, t, g, unknown or other
  misc_feature (239)..(239): n is a, c, g, or t
  modified_base (285)..(285): a, c, t, g, unknown or other
  misc_feature (285)..(285): n is a, c, g, or t
  modified_base (332)..(332): a, c, t, g, unknown or other
  misc_feature (332)..(332): n is a, c, g, or t
tcagcatagtagtgcacgaccggtgctcgatttagtacacacacttagggattggggggggtctcaggaggcagcactctcgggacgtctccaccatggcctgggctctgctcctcctcagcctcctcactcagggcacaggactccgtgggctacaggtctcgccctgacctcagcctcgctcagtcgtccggtctacgtgggcagtcagtcacctntctcctgcctacgtcgaaccngcagtgattgttggtgtatgtactttgtactccgtacgtaccaacngtcacgccgacggacgaaccgacccctaaattcgagtagtatttacngtactacggtcgtaggtcgaccggtccgggtcccggttcgggggtccctggtactcccgggtcttccgtcgtcgaccgttaccgtacgtcgtaccggaccgtaaccgacccggtccctcccgtacggtaccctacttccgtaccgggttcccgtccctacccggtaccgtcggttacggacggtacgtagggtacgtcgtttaacgtaacgtttacgttcgttacgttccgtacgttcgtaagtttaaccgtcggttaacgtcgggggttacccttcggggttacggtttcggggttaccggttacggggaccgggttaagggaccggtaggtacccggtccgggttaacccggccggtttaccgggaccgtaccggtaacccgg

SEQ ID NO: 295535 - DNA, 608 bp, Homo sapiens
  misc_feature: GYAE6OF02INTST.10.59.F04.1.454.CMB.1.raw
  modified_base (216)..(216): a, c, t, g, unknown or other
  misc_feature (216)..(216): n is a, c, g, or t
  modified_base (227)..(228): a, c, t, g, unknown or other
  misc_feature (227)..(228): n is a, c, g, or t
  modified_base (233)..(233): a, c, t, g, unknown or other
  misc_feature (233)..(233): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
tcagcatagtagtgcacgaccggtgctcgatttagtacacacacttagggattggggggggtctcaggaggcagcactctcgggacgtctccaccatggcctggctctgctcctcctcagcctcctcactcagggcacaggactcctgggctcagtctcgccctgactcacgcctcgctcagtcgtccggtctcgtggcagtcagtcacatctccngcactcgaacnncagtnagtgtgtagttatgtacttcgtctcgtacgaacacagcgacgtaccgacggaccgaaccggtacccctaactcgacgtgtatttagacgtactgtacgtacggtcgccggtccggtccggtccggggtcctgtaccgtctccgttcgtcgtcgcctaccgtacgtcgtcgacgaaccgccgtcccgtaccgtacgccgtactccgtcgtccgcctccgacgtccgtaggacgtacgnggtcgtntacgttacttacttggttacgtgcttactatacgtcgacgtacgggtcgtaccgtcggttcgggtcggtacgggaccggtaccggacgtaaccgtcggtaccgttccgacgtaccggtacacccggtaccg

SEQ ID NO: 295536 - DNA, 630 bp, Homo sapiens
  misc_feature: GYAE6OF02HTY3Y.10.59.F04.1.454.CMB.1.raw
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (325)..(325): a, c, t, g, unknown or other
  misc_feature (325)..(325): n is a, c, g, or t
tcagcatagtagtgcacgaccggtgctcgatttagtacacacacttagggattgggggggtctcaggaggcagcactctcgggacgtctccaccatgcctggctctgctcctcctcaccctcctcactcagggcacaggtcctgggcccagtctgccctgactcagcctccctccgcgtccgggtcncctggacagtcagtcaccatctcctgcactggaaccngcagtgacttttgtgctttataactatgtctcctgtaccagccaccaccaggacaacgccccaaactcctttagtttgagtcagtagcgcctcagactccngactcgttctctcgcctcatctggacaacgacgcctcctcgtaccgtcttcgtcggtcctccgtagccgtaggagagtggagtctagactttactctgtcagccactatacttaccgaccggaccccgaaaggttggttacggtttcggaccggggtacgggttaacgtaacgggtccggttaacccggttccgttacggggttacccaccgggacccgtaacgggtcctccccggtaccccccgttgggttaccctaccgtttcccgttacccgttccccccggttccctttcccctaaccccc

SEQ ID NO: 295537 - DNA, 666 bp, Homo sapiens
  misc_feature: GYAE6OF02G8PLO.10.59.F04.1.454.CMB.1.raw
  modified_base (245)..(245): a, c, t, g, unknown or other
  misc_feature (245)..(245): n is a, c, g, or t
tcagcatagtagtgcacgaccggtgctcgatttagtacacacacttagggattgggggctttctgagagtcatggacctcctgtgcaagaacatgaatcacctgtggttcttcctcctgctggtggcggcccccagatgggtcctgtcccagctgcagctgcatgagtcgggcccaggactggtgaggccttcggactaccctgtcccctcagtttgcgtctgtctcgtggtcgctccatcaacngtggtgacaacgtggtcgggctgggtccgccacgccccgagggacgtgggactggagtggagttcggccttacacaattagtagtgggacctacccgactaccacccgtcctacgacgacgtcgactcgacctctctcactacgacacccgtcgaacggacctcctaaccctccgttaccccgtaggacccggttacgacccgttcgtacggtccgacccgggaccggtccgggtaccgaacccgggtccggttaagtacgttttaacgtggttcggaccgtacggaccgtaaccccgcgttaagtaaacgtccttaccgtacgtagttaccgttattccggaacccgtaccgggttcggggaaccgttacggggggcctacccgtcgggtaccctcggttacccttcccgtacaccccgg

SEQ ID NO: 295538 - DNA, 620 bp, Homo sapiens
  misc_feature: GYAE6OF02FJON6.10.59.F04.1.454.CMB.1.raw
tcagcatagtagtgcacgaccggtgctcgatttagtacacacacttagggattggggggggtctcaggaggcggccctctcgggacgtctccaccatggcctgggctctgctattcctcaccctcctcactcagggcacagggtcctgggcccagtctgccctgactcagcctgcctccgtgtctgggtctctggacagtccatcaccatctcctgcactggacccaccagttacattggtaataatgaatatgtctcctggtaccaacagtacccaggcaaacgccccccaaatgatgatttatgatgtcagtaatccgaccctcgaggggtttctgatcgtctttcgttgaccctcctaagtcctgggacaacgaccggccctcccgtcgacctatcctcgtcgggtcctcgagactggaggacgaggctagtattagttactgacaggtcctacactaatacgaagtaccggacacgggtacgggttcgggttcgggttaccggggacgggggaccgacgtaccggtacggacccgttcggtacggtaccgacggtaccccgtaaggcccgtccggtcccccgtacggtaccctaccgttccgtcccgttccccccg

SEQ ID NO: 295539 - DNA, 845 bp, Homo sapiens
  misc_feature: GYAE6OF02JZSU4.10.59.F04.1.454.CMB.1.raw
tcagcatagtagtgcacgaccggtgctcgatttagtacacacacttagggattggggggggtctcgaggaggcagcactcgtcggacgtctccaccatggcctggactctgctcctcctcgacgtcctcctcactcgagggccacacggatccgtgggctacgtagtctacgcctgtccgtcgtacgtcctacggcctacgtaggttccggttccgggtaccgttccgttcggggtacctacgggttaactaccggttccaaccgttacgttccgttacccgtacggtaccgtaaccggttacggaacccgtaaacggttcggtaaccgggttacttaacggttcgggtttacggtttacggtttacgttaccggttacgtttaccgttaccgttaccggttaaccggtaaccgtaaccgtacgtaccggacgtaccggtacggtaccgtaaccgtacccgttaacgtacgtacgtacgttacgttacgtacgtacgtcgtacgtacggtcgtccggtaccggtccggtacggtcgtacgtacgtcgtcgtcgtcgtacgtcgtacgtacgtacgtcgacgtacggtacctaccgtaccgtacgtaccgtacgtccgttacgtaccgtacgtacgtccgtacggtacgtacgtacggtacggttcgtacgtttacgtacgtttaacgttacgttcgttaccgtaacgtacgttaaccgtacggtaccggtacggtacggtaccggttcggttacggttacgggtcgggtaccggtaccgggttaaccgtacggtacggttacggaccgttaccggtaaccggtaccggtaccgtaccggtacccg

SEQ ID NO: 295540 - DNA, 841 bp, Homo sapiens
  misc_feature: GYAE6OF02FXQO6.10.59.F04.1.454.CMB.1.raw
  modified_base (130)..(130): a, c, t, g, unknown or other
  misc_feature (130)..(130): n is a, c, g, or t
tcagcatagtagtgcacgaccggtgctcgatttagtacacacacttagggattgggggggggtctcaggaggcagcactctcgggacgtctccaccatggcctgggctctgctcctcctcagcctcctcnctcgagggcacgaggatccgtgggctcagtctcgccctgtacctcacgcctcgctcgaggttcggtccggtacctcgtggcctagtccagtaccacctacttcgtccgtcgacgtaaccgttacgaacctacggctaggttgtaacggttgggtttgggttcgttaagttcgttacgttttcgttaccgttaccgtaacggtaaccgtaaaccgtacggaccgtacggaccggtaacgggaaccggtaaaccccgtaccccttaaattcctagttaacgtttaacgtttaacggtaccggttattcgttacgtacgggtaccggtccgggtaccccggggtcccgggttcccggggtaacccgtcggttaaccgttcccggtttccgtttacccggtttccgtcgggttaaccgttaccggtaacggtcccggttaaccggaccgtaacccggttccggtaccccctaccggtaccggaaccctttaccgtccgttaccgggtacccgtaacccgtacggtccgtaccgttagggacgtacggttacggacgttacgtttacggtaactttttaccggtagttcgttactaaccttgaacgtgtaccgtaggtacggtacggttcgtcggttacgggttccggagggtacccggagaaccggtaggtcgtacccgttaccggggtaccctacgggtacccacgggtacccg

SEQ ID NO: 295541 - DNA, 458 bp, Homo sapiens
  misc_feature: GYAE6OF01B1VKE.47.45.E01.1.454.CMB.1.raw
  modified_base (450)..(458): a, c, t, g, unknown or other
  misc_feature (450)..(458): n is a, c, g, or t
tcagagctcacgtacacgaccggtgctcgatttagtgagtcagtaagggaaaggggctggagtgggtttcatacattagtagtgacactagtgttagtcctggtagtacaatttactacgcagactctgtgaagggccgattcaccatctccagagacgatgccaggacctcactgtatctgcaaatgaacagcctgagagacgaagacacggctgtgtattactgtgcgagagaacgtggatactacaatggttactaccactactacggtatggacgtctggggccaagggaccacggtcaccgtctcctcagcctccaccaagggcccatcggtcttccccctggcaccctcctccaagacgcacctctgggggcacagcgcctgggctgcctggtcaaggactacttcctacgtgagctcgtgagcgggctggcaaggcgcatagnnnnnnnnn

SEQ ID NO: 295542 - DNA, 455 bp, Homo sapiens
  misc_feature: GYAE6OF02FVQO4.47.45.E01.1.454.CMB.1.raw
  modified_base (449)..(455): a, c, t, g, unknown or other
  misc_feature (449)..(455): n is a, c, g, or t
tcagagctcacgtacacgaccggtgctcgatttagtgagtcagtaagggaaaggggctggagtgggtttcatacattagtagtgacactagtgttagtcctggtagtacaatttactacgcagactctgtgaagggccgattcaccatctccagagacgatgccaggacctcactgtatctgcaaatgaacagcctgagagacgaagacacggctgtgtattactgtgcgagagaacgtggatactacaatggttactaccactactacggtatggacgtctggggccaagggaccacggtcaccgtctcctcagcctccaccaagggcccatcggtcttccccctggcaccctcctccaagagcacctctgggggcacagcggccctggctgcctggtcaaggctacttcctacgtgagctctgagcgggctgggcaaggcgcatagnnnnnnn

SEQ ID NO: 295543 - DNA, 606 bp, Homo sapiens
  misc_feature: GYAE6OF02IAWFI.47.45.E01.1.454.CMB.1.raw
  modified_base (570)..(570): a, c, t, g, unknown or other
  misc_feature (570)..(570): n is a, c, g, or t
  modified_base (574)..(575): a, c, t, g, unknown or other
  misc_feature (574)..(575): n is a, c, g, or t
  modified_base (578)..(578): a, c, t, g, unknown or other
  misc_feature (578)..(578): n is a, c, g, or t
  modified_base (580)..(582): a, c, t, g, unknown or other
  misc_feature (580)..(582): n is a, c, g, or t
  modified_base (584)..(586): a, c, t, g, unknown or other
  misc_feature (584)..(586): n is a, c, g, or t
  modified_base (588)..(588): a, c, t, g, unknown or other
  misc_feature (588)..(588): n is a, c, g, or t
  modified_base (590)..(593): a, c, t, g, unknown or other
  misc_feature (590)..(593): n is a, c, g, or t
  modified_base (595)..(597): a, c, t, g, unknown or other
  misc_feature (595)..(597): n is a, c, g, or t
  modified_base (599)..(603): a, c, t, g, unknown or other
  misc_feature (599)..(603): n is a, c, g, or t
  modified_base (605)..(606): a, c, t, g, unknown or other
  misc_feature (605)..(606): n is a, c, g, or t
tcagagctcacgtacacgaccggtgctcgatttagtgagtcagtaagggaaaggggctggagtgggtttcatacattagtagtgacactagtgttagtcctggtagtacaatttactacgcagactctgtgaagggccgattcaccatctccagagacgatgccaggacctcactgtatctgacaaatgaacagcctagagagacgaagacacggctgtcgtattactgtgcgaagagaacgtggaatactacaagttggttaacctaccaactaacgtaacggtagtaggtacgtcggtcgggacgaacgggacctaacggtccaaccggttctcctcgacgtccctacccaacgaacggccctacgtccggttacccttccccgtcggacccacccgttacctacccgaaagacgaccgtaacctcgggtacggggaccacgaacgccgggaccccgtgggaccgtcgtcgtacgggtacgtaaacggtaaccgttaccttacgttaaccgtgacggtcctcgtaggaacggtcggcgtacggacgtaacgggcaaccgtaagtacgngacnncgnannnannnanannnngnnngnnnnnann

SEQ ID NO: 295544 - DNA, 276 bp, Homo sapiens
  misc_feature: NA.10.1.A01.2.454.heavy.1.nb
agcactagaagtcggcggtgtttccattcggtgatcagcactgaacacagaggactcaccatggagtttgggctgagctgggttttcctcgttgctcttttaagaggtgtccagtgtcaagtgcagctggcggagtcgtgggggagcgtggtccagccgtgggaggtccctgagactctcctgtgcagcctctgggttcaccttcaatacctatggcatgcactgggtccgccaggctccgaggcaaggggctgggagtgggtggctcttatctca

SEQ ID NO: 295545 - DNA, 90 bp, Homo sapiens
  misc_feature: NA.10.14.B03.1.454.heavy.1.nb
tatgcgccttgccagcccgctcagcatagtagtggaggagggcgggaacagagtgaccgagggggcagccttgggctgacctaggacggt

SEQ ID NO: 295546 - DNA, 93 bp, Homo sapiens
  misc_feature: NA.10.16.B05.2.454.heavy.1.nb
tggggagtctgcaccatggcttggaccccactcctcttcctcaccctcctcctccactgcacagggtctctctcccagcttgtgctgactcaa

SEQ ID NO: 295547 - DNA, 248 bp, Homo sapiens
  misc_feature: NA.10.23.C01.1.454.heavy.1.nb
ccattgcctatgtggactctgtgaagggccgattcaccatcaccagagacgacgccaggagctccctgtatctccaaatgaacagtctgagacctgaggacacggccttgtattactgtgtaagagggagtcagggtttcaactattatagtagtggttatgactacgtggggccagggaaccctggtcaccgtctcctcagcctccaccaagggcccatcggtcttccccctggccgccctgcctcc

SEQ ID NO: 295548 - DNA, 246 bp, Homo sapiens
  misc_feature: NA.10.23.C01.2.454.heavy.1.nb
gagaggagccccagccctgagattcccaggtgtttccattcagtgatcagcactgaacacagaggactcaccatggagttgggactgagctggtattttccttttggcttattttaaaaggtgtccagtgtgaagtgcagctggtggagtcgtgggggaggcttggtacagcctggcaggtccctgagactctcctgtgcagcctctggattcagtctttgatgaatatgccatggactgggtccg

SEQ ID NO: 295549 - DNA, 106 bp, Homo sapiens
  misc_feature: NA.10.26.C04.2.454.heavy.1.nb
tatgcgccttgccagcccgctcagcatagtagtgggaagtagtccttgaccaggcagcccagggccgctgtgcccagcacctgaactcctgggggaccgtcagtct

SEQ ID NO: 295550 - DNA, 322 bp, Homo sapiens
  misc_feature: NA.10.34.D01.1.454.heavy.1.nb
ctgtgcagcctctggattcactttcagtaacgcctggatgaactgggtccgccaggctccagggaaggggctggagtgggttggccatattaaaatcaaagctgatggtgggacaacagagcacgctgcacccgtgaaaggcagattcagcatctcaagagatgattcaaaaagtacgctgtatctgaacatgaacagcctagaaaacggaggacacagccgtgtattactgtgccactcaggaccgatattgtctgatggcgtatgctctaaggagaccttgacttcgtggggccagggaaccctggtcaccgtctcctca

SEQ ID NO: 295551 - DNA, 529 bp, Homo sapiens
  misc_feature: NA.10.35.D02.1.454.heavy.1.nb
gagaggagccccagccctgggattcccaagtgtcttcattcagtgatcaggactgaacacagaggactcaccatggagtttgggctgaggtggattttccttgctgcaattttaaaaggtgtccagtgtgacgtgcagttggtggagtcgtgggggaggcttggttaagccgggggggtcccttagactctcctgttcagcctctggattcagtgtcactaacgcctggatgagctgggtccgccagtccccagggaaggggctggagtgggttggccttattagaagcagacctgatggtgggacaacagagtacgctggattcgtaaaaggcagattcgccatctcaattgatgagtcaaagaacaccgtgtatctggaaatgagcagcctaggaaagcgatgacacaggactctattattgtaccactaagagtcccaacgaagactgtgggaagggactgctgggccagggagcccttgtcaccgtctcctcagcctccaccaagggcccatcggtccttccccc

SEQ ID NO: 295552 - DNA, 467 bp, Homo sapiens
  misc_feature: NA.10.38.D05.4.454.heavy.1.nb
gagcccagcactgggattccgaggtgtttccattcggtgatcagcactgaacacagaggactcaccatggagttttggctgagctgggttttccttgttgctatttcaaaaggtgtccactgtgaggttcaactggtggagactggaggaggctggatccagccgtggggggtccctgagactctcctgtgcagcctctgggttcagcatcagtaacgactacatgacctgggcccgccaggctccagggaaggggctggagtgggtctcagttattgaaacagatggcactacatattattctgactccgtgaagggccgttcaccctctccagagacacttccaacaacatcttgtatcttcacatgcacaatctgagagtcgacgacacggccacctattattgtgcgcgacatgactacgctcaattctggggccagggacgcccaggtcaccgtctccccag

SEQ ID NO: 295553 - DNA, 151 bp, Homo sapiens
  misc_feature: NA.10.38.D05.6.454.heavy.1.nb
agactctcctgtgcagcctctgggttcagcatcagtaacgactacatgacctgggcccgccaggctccagggaaggggctggagtgggtctcagttatgaaacagatggcactacatattattctgactccgtgaagggccgttcaccctc

SEQ ID NO: 295554 - DNA, 359 bp, Homo sapiens
  misc_feature: NA.10.42.D09.1.454.heavy.1.nb
gtctcgactattaatggtcttgctgataatacacactacgcagacttcgtgaagggccggttcaccatctcgagagacaacaccaagaacacgctgaatctgcaaatgaacagcctgagagccgaggacacggctgtatattactgtgtgagggatgtccccccagaaagggctggttacatgtttgactcctggggccagggaatcctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcata

SEQ ID NO: 295555 - DNA, 218 bp, Homo sapiens
  misc_feature: NA.10.5.A05.1.454.heavy.1.nb
cccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggttgcgccaga

SEQ ID NO: 295556 - DNA, 498 bp, Homo sapiens
  misc_feature: NA.10.53.E09.1.454.heavy.1.nb
gagacgagcccagcactggaagtcgccggtgtttccattcggtgatcatcactgaacacagaggactcaccatggagtttgggctgagctgggttttcctcgttgctcttttaagaggtgtccagtgtcaggtgcagctggtggagtctgggggaggcgtggtccagcctgggaggtccctcagactctcctgtttagcctctggattcaccttcagtagttatcctttgcactgggtccgtcaggctccaggcaaggggctggagtgggtggcagttatctcatttgatggagacaataaatactacagagactccgttcggggccgattcaccatctccaaagacaatttgaagaacacgctgtttctgcaaatgaacagcctgagagctgaggacacggctgtgtattactgttcgtttggttctgactcgtcggggaataccttcagcacgtggggccagggcaccctggtcaccgtctcctcacgcctccacc

SEQ ID NO: 295557 - DNA, 106 bp, Homo sapiens; identical to SEQ ID NO: 295549
  misc_feature: NA.10.53.E09.3.454.heavy.1.nb

SEQ ID NO: 295558 - DNA, 586 bp, Homo sapiens
  misc_feature: NA.10.59.F04.1.454.heavy.1.nb
gagagtcatggacctcctgtgcaagaacatgaatcacctgtggttcttcctcctgctggtggcggcccccagagtgggtcctgtcccagctgcagctgcatgagtcgggcccaggactggtgaggccttcggataccctgtccctcagttgcgctgtctctggtgctccatcaacagtggtgacaactggtggggctgggtccgccagcccccagggatgggactgggagtggattggccttacacattatagtgggactacccactacaacccgtccctcaggagtcgagtcaccatctcactagacacgtccaggaatcacctctccctgacggtgacctctgtgaccgccgcggacacggccgtgtattattgtgcgagagaccccgctgaagattcctcaatgtactttgaccactggggccagggagccctggtcaccgtctcctcagcctccaccaagggcccatcggtcttccccctggcgccctgctccaggagcacctccgagagcacagcggccctgggctgcctggtcaaggactacttcccactactatgctgagcgggctggcaaggcgcata

SEQ ID NO: 295559 - DNA, 351 bp, Homo sapiens
  misc_feature: NA.10.60.F05.1.454.heavy.1.nb
  modified_base (156)..(156): a, c, t, g, unknown or other
  misc_feature (156)..(156): n is a, c, g, or t
gtctcaggtattacttggaatggtggtataataggctatgcggactctgtgaggggccgcttcaccatctccaaggacagcgccaagagatccctctatctgcaaatgaacagtctgagaactgaggacacggcctactactactgtgacaaaagntgattccggcagttacttcttagataacgtggggccgggaaccctggtcgccgtctcttcagcctccaccaagggcccatcggtcttccccctggccgccctgctccaggagcacctccgagagcacagcggccctgggctgcctggtcaaggactacttcccactactatgctgagcgggctggcaaggcgcat

SEQ ID NO: 295560 - DNA, 371 bp, Homo sapiens
  misc_feature: NA.10.71.G05.2.454.heavy.1.nb
gagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccaggttccaggccacgggctggaatggggtggcagatatacaatatgatgacagtaaaatatactatggagactccttcaagggccattcaccatctccagagacattccaagaacatgtgtatctg

SEQ ID NO: 295561 - DNA, 424 bp, Homo sapiens
  misc_feature: NA.10.77.G11.1.454.heavy.1.nb
gtggttctcggggctgccctttggctttggagatggttttctcgaaggggctggagtgggtctcaggtattagtggtagtggtgatggcacatactacgcagactccgtgaagggccggttcagcatctccagagacaattccaagaacacgttggatctgcaaatgaacagcctgagagccgacgacacggccgtatattactgtgcgaaagatacgtggacacatgtatggtccgcggggggggcaatggacgtctggggccaagggaccacggtcaccgtctcctcagcctccaccaagggcccatcggtcttccccctggcaccctcctccaagagcacctctgggggcacagcggccctgggctgcctggtcaaggactacttcccactactatgctgagcgggctggcaaggcgcata

SEQ ID NO: 295562 - DNA, 617 bp, Homo sapiens
  misc_feature: NA.10.79.H02.1.454.heavy.1.nb
gagaagagccccagccccagaattcccaggagtttccattcggtgatcagcactgaacacagaggactcaccatggagtttgggctgagctgggttttccttgttgctattataaaaggtgtccagtgtcaggtgaagctggtggagtcgtgggggaggcttggtcaagcctggagggtccctgagactctcctgtgcagcctctggattcgcctctggattgacgttcagtgactactacatgacctgggtccgccaggctccgagggaaggggctggagtgggtttcatacatttatcctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatccggtcttccccctggccgccctgctccaggagcacctccgagagcacagcggccctgggctgcctggtcaaggactacttcccatactatgctg

SEQ ID NO: 295563 - DNA, 399 bp, Homo sapiens
  misc_feature: NA.10.85.H08.2.454.heavy.1.nb
tgggttttccttgttgttattttagaaggtgtccaatgtgaggagcagctggtggagtctgggggaggcctggtccaggccggggggtccctgagactctcctgtggagcgtccggattcgactttgatacttattggatgagctgggtccgccaggctccagggaagggctggagtgggtggccaccataaaggagatggaagtgagaactactttgtgggctctgtgaagggccgattcaccatctccagagacaacgccaagaagtcactgtatctgcaaatgaacgatgtgagagtcgaggacacggctgtatatttctgtgcgaggggagccggctagtggttcggacctcgtggggccagggaaccctggtcaccgtctcatcagcctccacc

SEQ ID NO: 295564 - DNA, 342 bp, Homo sapiens
  misc_feature: NA.10.88.H11.2.454.heavy.1.nb
aaaccacacccctccttgggagaatcccctagatcacagctcctcaccatggactggacctggagcatccttttcttggtggcagcagcaacaggtgcccactcccaggttcagctggtgcagtctggggctgaggtgaagagccctggggcctcagtgaagatctcctgcgaggcttctggttacacctttaacacctatggcatctcctgggtgcgacaggcccctggacaaggacttgagtgggtggggtgggtcagcgcttaccaagttggctacacaaattatgcacagaagttccaggacagagtcaccatgaccacagacacatccacgagcaca

SEQ ID NO: 295565 - DNA, 240 bp, Homo sapiens
  misc_feature: NA.10.9.A09.2.454.heavy.1.nb
cccagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggagcgtagtccagcctgggagtcacagagactctcctgtgcagcctctgggttcaccttcagtagctacggcatgcacgtgggtccgccaaact

SEQ ID NO: 295566 - DNA, 654 bp, Homo sapiens
  misc_feature: NA.11.12.B01.1.454.heavy.1.nb
gctttggagatggttttctcgatgagctctgggagaggagcccagcactagaagtcggcggtgtttccattcggtgatcagcactgaacacagaggactcaccatggagttttggctgagctgggttttccttgttgctattttaaaaggagtccagtgtgaggtgcgtctggtggagtcgtggaggaggcctgatccagcctggggggtccctgagactctcctgtgcagcctctgggttcaccgtcagtcacacctacatgagttgggtccgccaggctccgagggaagggctggagtgggtctcctttattacagcagtggtagtacatattccgcagactccgtgaggggccgattcaccatctccagagacaactctaagaacacgctgtttcttcaaatgaacagcctgagagccgatgacacggccgtgtattactgtgcgagagatggggcccacgaacgttactacgctatggacgtctggggccaagggaccacggtcaccgtctcctcagcctccaccaagggcccatcggtcttccccctggcgccctgctccaggagcacctccgagagcacagcggccctgggctgcctggtcaaggactacttccgtatctctcgctgagcgggctggcaaggcgcata

SEQ ID NO: 295567 - DNA, 272 bp, Homo sapiens
  misc_feature: NA.11.25.C03.2.454.heavy.1.nb
aaaaggagtccagtgtgaggtgcgtctggtggagtctggaggaggcctgatccagcctggggggtccctgagactctcctgtgcagcctctgggttcaccgtcagtcacacctacatgagttgggtccgccaggctccgagggaaggggctggagtgggtctcctttattacagcagtggtagtacatattccgcagactccgtgaggggccattcaccatctccagagacaactctaagaacacgctgtttctcaaatgaacagcctgaga

SEQ ID NO: 295568 - DNA, 153 bp, Homo sapiens
  misc_feature: NA.11.25.C03.5.454.heavy.1.nb
gaagactgacggtccgccaggctccagggaaggggctggagtgggtctcctttatttacagcagtggtagtacatattccgcagactccgtgaggggccgattcaccatctccagagacaactctaagaacacgctgtttcttcaaatgaaca

SEQ ID NO: 295569 - DNA, 389 bp, Homo sapiens
  misc_feature: NA.11.26.C04.1.454.heavy.1.nb
aagactgacggtccgccaggctccagggaaggggctggagtgggtggccaacataaagccagatggaggtgtaaaacagtatgtagactctgtggagggccggttcaccatctccagagacaacgccaagaatgcgatatatctacagatgaacagcctgcgagccgaggacacggctgtgtattactgtgggagtccctggctggcacctgtatccgaccgttggagtcagggaactctggtcaccgtctcctcagcctccaccaagggcccatcggtcttcccctggcgccctgctccaggagcacctccgagagcacagcggccctgggctgcctggtcaaggactacttccgtatctctcgctgagcgggctggcaaggcgcata

SEQ ID NO: 295570 - DNA, 106 bp, Homo sapiens
  misc_feature: NA.11.35.D02.1.454.heavy.1.nb
tatgcgccttgccagcccgctcagcgagagatacggaagtagtccttgaccaggcagcccagggccgctgtgcccagcacctgaactcctgggggaccgtcagtct

SEQ ID NO: 295571 - DNA, 106 bp, Homo sapiens; identical to SEQ ID NO: 295570
  misc_feature: NA.11.38.D05.1.454.heavy.1.nb

SEQ ID NO: 295572 - DNA, 116 bp, Homo sapiens
  misc_feature: NA.11.39.D06.1.454.heavy.1.nb
tatgcgccttgccagcccgctcagcgagagatacggaagtagtccttgaccaggcagcccagggccgctgtgcccagcacctgaactcctggggggaccgtcagtcttcctcttcc

SEQ ID NO: 295573 - DNA, 282 bp, Homo sapiens
  misc_feature: NA.11.40.D07.1.454.heavy.1.nb
gggagaggagcccagcactagaagtcggcggtgtttccaatcggtgatcagcactgaacacagaggactcaccatggagtttgggctgacctgggttttcctcgttgctcttttaagaggtgtccagtgtcaggtgcagctggtggagtcgtgggggagcgtggtccagcctgggaggtccctgagactctcctgtgcagcctctggattcatcttcaatacctttggcatgcactgggtccgccaggcctccgaggcaagggctggagtggctatcattta

SEQ ID NO: 295574 - DNA, 119 bp, Homo sapiens
  misc_feature: NA.11.41.D08.2.454.heavy.1.nb
gcccttcggagaccctgtccctcacctgcactgtctctggtgactccatcagtaggtactattggagctggatccggcagcccccagggaagggactggagtggattggggtggatgta

SEQ ID NO: 295575 - DNA, 106 bp, Homo sapiens; identical to SEQ ID NO: 295570
  misc_feature: NA.11.57.F02.3.454.heavy.1.nb

SEQ ID NO: 295576 - DNA, 346 bp, Homo sapiens
  misc_feature: NA.11.61.F06.1.454.heavy.1.nb
gtctcacgtattgacaatgatgggagtgacacaatccacgcggattctgtgaggggccgattcaccacttcgagagacaacgccaagaacacggtatatctgcaaatgaacagtctgagaggcgaagacacggctgtttacttctgtgcaagaggtggctggtcgcatggatttgatctctggggccaggggacaatggtaaccgtctcttcagcctccaccaagggcccatcggtcttcccctggcgccctgctccaggagcacctccgagagcacagcggccctgggctgcctggtcaaggactacttccgtatctctcgctgagcgggctggcaaggcgcata

SEQ ID NO: 295577 - DNA, 346 bp, Homo sapiens
  misc_feature: NA.11.63.F08.1.454.heavy.1.nb
accacatctgtcctctagagaatcccctgagagctccgttcctcaccatggactggacctggaggatcctcttcttggtggcagcagccacaggagcccactcccaggtgcagttggtgcagtctggggctgaggtgaagaagcctggggcctcagtgaaggtctcctgcaaggcttctggatacagcttcaccggctactatatgcactgggtgcgacacggcccctggacaagggcttgagtggatgggacggatcaaccctaatagtggtggcacaaactatgcacagaagtttgagggcagggtcatcatgaccagggacacgtccatcagcacagcctaca

SEQ ID NO: 295578 - DNA, 397 bp, Homo sapiens
  misc_feature: NA.11.67.G01.1.454.heavy.1.nb
ggggtccctgagactctcctgtgtaggctctggattcagttttagcagctacgccatgacctgggtccgccaggctccgagggaaggggctggagtgggtctcggctattaatggccacggtggcaagacatactacgcagagtccgtgcagggccgatgcaccatctccagagacaattcccagaagacgctgtacctgcaaatggacagcctgagagccgacgacacggccgtatattactgtgccagaaatccgtccagatattgcactggtggcaactgctacgacgcctactattatcaccacatggacgtctggggcaaagggccacggtcatcgtctcctcagcctccaccaagggcccatcggtcttcccctggccaccctctccaaga

SEQ ID NO: 295579 - DNA, 106 bp, Homo sapiens; identical to SEQ ID NO: 295570
  misc_feature: NA.11.67.G01.3.454.heavy.1.nb

SEQ ID NO: 295580 - DNA, 365 bp, Homo sapiens
  misc_feature: NA.11.70.G04.1.454.heavy.1.nb
gattggtcatatcgataccactggaaacaccaattacaacccctccctcaagagtcgagtcaccatatccctgacgtccaagagtcagctctccctggagctgacttctgtgaccgccgcagacacggccgtgtattactgtgcgcgacgtcgtcccttgaaagtaattgttagggacctccactacggtatggacgtctggggccaagggaccacggtcaccgtctcctcagcctccaccaagggcccatcggtcttccccctggcaccctcctccaagagcacctctggggcacagcggccctgggctgcctggtcaaggactacttccgtatctctcgctgagcgggctggcaaggcgcata

SEQ ID NO: 295581 - DNA, 367 bp, Homo sapiens
  misc_feature: NA.11.71.G05.2.454.heavy.1.nb
aggagcccagcactagaagtcggcggtgtttccattcggtgatcagcactgaacacagaggactcaccatggagtttgggctgagctgggttttcctcgttgctcttttaagaggtgtccagtgtcaggtgcaactggaggagtcgtgggggaggcgtggtccagcctgggaggtccctgagactctcctgtacagcctctggcttcaccttcattacctatggcatgcactgggtccgccagactccaggcagggggctgggagtgggtggcagttattcatatgatggaaatagtgacttctattcagactccgtgaagggccattcaccgtctccagagacaattccaggcacacgctgtatct

SEQ ID NO: 295582 - DNA, 343 bp, Homo sapiens
  misc_feature: NA.11.79.H02.1.454.heavy.1.nb
tctcctgtgcagcctctggattcacttttagcaactatgtcatgcactgggtccgccaggctcctggaaaggggctggagtgggtctcgtctattgctggcaatgataataccgtaaactacgcagactccgtgaagggccggttcaccatctccagggacaattccatgaacacactttatcttcaattgaacaccctgagggccgacgacacggccgtatattatgtgcgaaggctacgatctcgagtacttctttgccactggggccagggaaccctggtcaccgtctcctcagcctccaccaaggcccatcgtcttccccctggccacccctcctccaa

SEQ ID NO: 295583 - DNA, 106 bp, Homo sapiens; identical to SEQ ID NO: 295570
  misc_feature: NA.11.86.H09.2.454.heavy.1.nb

SEQ ID NO: 295584 - DNA, 293 bp, Homo sapiens
  misc_feature: NA.11.87.H10.1.454.heavy.1.nb
tcttgtccaccttggtgttgctgggcttgtgattcacgttgcagatgtaggtctgggtgcccaagctgctggagggcacggtcaccacgctgctgagggagtagagtcctgaggactggtccagcctgggggatccctcagactctcatgtgcagcctctggattcaacgtcaagaaacaactttatgagttgggtccgccacggccccagggaaacggggctgggaggtgggtctcgagtctatttataggtggtgacacaacatactatacagacgctgtagaagggcaga

SEQ ID NO: 295585 - DNA, 187 bp, Homo sapiens
  misc_feature: NA.12.10.A10.2.454.heavy.1.nb
tatgcgccttgccagcccgctcagatacgacgtaggaagtagtccttgaccaggcagcccagggccgctgtgctctcggaggtgctcctggagcagggcgccagggggaagaccgatgggcccttggtggaggctgaggagacggcgaccgtggtccctttgtcccagacgtccatgtagtgataat

SEQ ID NO: 295586 - DNA, 544 bp, Homo sapiens
  misc_feature: NA.12.11.A11.1.454.heavy.1.nb
agccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagccgtggggggtccctgagagtctcctgtacaacctctggattcatgtttagtagtcattggatgaactgggtccgccaggctccgagggaaggggctgggagtgggtggccaacataaagcaagatggaagtgagaaatactatgtggactctgtgaagggccgattcacaatctccagagacaacgccaagaactcactgtatctgcaaataaacagcctgaaagccgaggacacggctgtgtatttctgtgcgaggactcctacggtgacaaatttattcaaaccagacaaagttcgttcgccaagccgtcacactactttgacagctggggccagggaaccctggtcaccgtctcctcagcctccaccaacgggcccat

SEQ ID NO: 295587 - DNA, 335 bp, Homo sapiens
  misc_feature: NA.12.12.B01.1.454.heavy.1.nb
gtacagactggtggcacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactcgtggtcaccgtctcctcagcctccaccaagggcccatcggtcttccccctggcgccctgcctccaggacgcacctccgagagcacagcggccctgggctgcctggtcaaggactacttcctacgtcgtatctgagcgggctggcaaggcgcata

SEQ ID NO: 295588 - DNA, 568 bp, Homo sapiens
  misc_feature: NA.12.14.B03.1.454.heavy.1.nb
agaggagccccagccctgagattcccaggtgtttccattcagtgatcaacactgaacacagaggactcatcatggaattgggactgacctgctattttcctttggctattttaaagggtgtccagtgtgaagtgcacttggaacagtcggggggagcttggttcggcctggcgggtccctgagactctcctgcgcagcctctggattcctttttgaggtattttgccatgcactgggtccggcaagcgtccgggggaggggcctggagtgggtctcaacaattacttggaatagtgctaccatagcctacacagactccgtgaagggccattcatcacttctagagacaacgccgagaactccctgtatctgcagatgaacagtctgagacctgaggacacggccctgtatttctgttcaaaaggggctctggttcagggatggggctttgactcctgggcccagggaaccctggtcgcggtctcctcagcctccaccaagggcccatcgtcttcccctggcaccctcctccagagcacctctcggggcacagcggccctgggctgcc

SEQ ID NO: 295589 - DNA, 350 bp, Homo sapiens
  misc_feature: NA.12.14.B03.2.454.heavy.1.nb
gtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccgtggggccagggaaccctggtcaccgtctcctcagcctccaccaa

SEQ ID NO: 295590 - DNA, 335 bp, Homo sapiens
  misc_feature: NA.12.2.A02.1.454.heavy.1.nb
ccctccttgggagaatcccctagatcacagctcctcaccatggactggacctggagcatccttttcttggtggcagcagcaacaggtgcccactcccaggttcagctggtgcagtctggagctgaggtgaagaagcctggggcctcggtgaaggtctcctgcaaggcttctggttacacctttaccagctatggtatcagctgggtgcgacaggcccctggacaagggcttgagtggatgggatggatcagcgcttacaatggtaacacagactatgcacagaagttccaggacagagtcacatgaccacagacacatccacgagcacagcctac

SEQ ID NO: 295591 - DNA, 277 bp, Homo sapiens
  misc_feature: NA.12.22.B11.1.454.heavy.1.nb
taggatacatctctaaaagtgggagcaccttctacaatccgtcactcaagagtcgagtttccatatccgtagacatgaccaagaatcacttctccctgaacctgacctctatgactgtcgcagacacggccgtctattactgtggcagagaaagatatatagcggcggtccatctatacatagacgtctggggcaaagggaccacggtcaccgtctcctcagcctccaccaagggcccatcggtcttcccctggcaccctcctccaagagcacctct

SEQ ID NO: 295592 - DNA, 354 bp, Homo sapiens
  misc_feature: NA.12.24.C02.1.454.heavy.1.nb
gattggggaaatctatcatagtggtaccacgtactacagcccgtcactcaacagtcgcgtcaccatatcggtggacgagtccaagaaccagttctccctgagcctgacctctgtgactgccgcggactcggccctatatttctgtgcgagagatcgagatgtgtcatcgcggggctcttttgatatctggggccaagggacaatggtcatcgtctcttcagcctccaccaagggcccatcggtcttccccctggcgccctgctccaggagcacctccgagagcacagcggccctgggctgcctggtcaaggactacttcctacgtcgtatctgagcgggctggcaaggcgcata

SEQ ID NO: 295593 - DNA, 383 bp, Homo sapiens
  misc_feature: NA.12.25.C03.1.454.heavy.1.nb
accacacccctccttgggagaatcccctagatcacagctcctcaccatggactgggcctggagcctcctttttcttggtggcagccgcaacaggtgcccactcccaggttcagctggtgcagtctggggctgagatgaagaagccgtggggcctcagtaaaggtctcctgcgaggcttctggttacacctttctcaggtatactattgcctgggtgcgacaggcccctggacaagggcttgagtggatggggtggatcaacgtacagactggtggcacagactatgcacgaggggctccgagggcagactcaccatgaccacagacacatcagcgaacacagtcaacatggagttgcggagcctgcgatctgacgacgcggcc

SEQ ID NO: 295594 - DNA, 335 bp, Homo sapiens
  misc_feature: NA.12.25.C03.2.454.heavy.1.nb
gaagactgacggtcctgccacagactatgcacaggggctccagggcagactcaccatgaccacagacacatcagcgaacacagtcaacatggagttgcggagcctgcgatctgacgacgcggccgtatattactgtgcgagagtacgtagcggctcgtcctttgactactggggcctgggaactctggtcaccgtctcctcagcctccaccaagggcccatcggtcttcccctggcgccctgctccaggagcacctccgagagcacagcggccctgggctgcctggtcaaggactacttcctacgtcgtatctgagcgggctggcaaggcgcata

SEQ ID NO: 295595 - DNA, 224 bp, Homo sapiens
  misc_feature: NA.12.3.A03.1.454.heavy.1.nb
  modified_base (146)..(146): a, c, t, g, unknown or other
  misc_feature (146)..(146): n is a, c, g, or t
cctcactgcccagctgggatctcagggcttcattttctgtcctccaccatcatggggtcaaccgccatcctcgccctcctcctggctgttctccaaggagtctgtgccgaggtgcagctggtgcagtctgaagcagaggtgaaagngcccggggatctctgacgatctctgtaagggttctggatacgactttcccaccactggatcggctgggtgcgccagat

SEQ ID NO: 295596 - DNA, 328 bp, Homo sapiens
  misc_feature: NA.12.30.C08.1.454.heavy.1.nb
gcttcaccagtcctggacctcctgtgcaagaacatgaaacacctgtggttcttcctcctgctggtggcagctcccagatgggtcctgtcccaggtgcagctgcaggagtcgggcccaggactggtgaagccctcacagaccctgtccctcacctgcaatgtctctggtgctccatcagcagtggtgattattactggagttggatccgccagtccccagggaaggcctggagtggattgggtacatctatcacagtgggagcacctactacactcccgtccctgaacgagtcgaattacgatgtcagtaaacacgtctaggaaccagt

SEQ ID NO: 295597 - DNA, 633 bp, Homo sapiens
  misc_feature: NA.12.33.C11.1.454.heavy.1.nb
gagaggagccccagccctgagattcccacgtgtttccatccagtgatcagcactgaacacagaggactcgccatggagtctgggctgaactgggttttccttgttgctattttaaaaggtgtccactgtgaggtgcaactggtggaggtcggggggaggtgtaggtacgggccggggggtccctgagactctcatgtgcagggtctggattcaacttttacgattatggcatgacctgggtccgccaagctccgagggaaggggctggagtgggtctctggtctgaattggaatggtgatagtatagattatgcaggctctgtgaggggccattcaccatctccagagacaacgccaagaactccctgtttctgcaaatggacaatttgagagaggaagacacggccttatatttctgtgcgagagccctcggcagaagtctggactactactattatggtatggacgtctggggccaagggaccacggtcatcgtctcctcagcctccaccaagggcccatcggtcttccccctggcaccctcctccaagagcacctctgggggcacagcggccctgggctgcctggtcaaggactacttcctacgtcgtatctgagcgggctggcaaggcg

SEQ ID NO: 295598 - DNA, 432 bp, Homo sapiens
  misc_feature: NA.12.40.D07.1.454.heavy.1.nb
catggagtttgggctgagctgggttttcctcgttgctcttttaagaggtgtccagtgtcaggggcacctggtggagtctgggggagccgtggtccagcctgggcggtccctgacactcgcctgtgttgcctctggatttcccttcaatttctattccatgcactgggtccgccaggctccaggcaaggggctcgagtgggtggcacttattgcacatgatggcgtcaacaaattctacgcaaattccgtgaggggccgattcaccatctccagagacaattacaagaacaccctttatctgcaaatagacagcctgagaccagacgacacggctgtctattattgcgcgagagagacacacgaacctactggccaatactatggggcttgttctggggccaggggaccctggtcatcgtctccccagcctcc

SEQ ID NO: 295599 - DNA, 310 bp, Homo sapiens
  misc_feature: NA.12.48.E04.2.454.heavy.1.nb
  modified_base (182)..(182): a, c, t, g, unknown or other
  misc_feature (182)..(182): n is a, c, g, or t
ctcactgcccagctgggatctcagggcttcattttctgtcctccaccatcatggggtcaaccgccatcctcgccctcctcctggctgttctccaaggagtctgtgccgaggtgcagctggtgcagtctgaagcagaggtgaaagaggcccggggatctctgacgatctctggtaagggttcnggatacgactttcccacccactggatcggctgggtgcgccagatgcccgggaaaggcctggagtggatggggattatctatcccggtgactttgataccagatacagtccgtcattccaaggccaggt

SEQ ID NO: 295600 - DNA, 106 bp, Homo sapiens
  misc_feature: NA.12.53.E09.3.454.heavy.1.nb
tatgcgccttgccagcccgctcagatacgacgtaggaagtagtccttgaccaggcagcccagggccgctgtgcccagcacctgaactcctgggggaccgtcagtct

SEQ ID NO: 295601 - DNA, 296 bp, Homo sapiens
  misc_feature: NA.12.55.E11.1.454.heavy.1.nb
gcccagcactggaagtcgccggtgtttccattcggtgatcatcactgaacacagaggactcaccatggagtttgggctgagctgggttttcctcgttgctcttttaagaggtgtccagtgtcagatgcagctggtggagtctgggggaggcgtggtccggcctgggacgtccctgacactctcctgtgcagccgctggattcaccttacccagttatgctatgcactgggtccccaggctccgagggagggctggaatggggtggcagttatatcatatgatggaagctatcaata

SEQ ID NO: 295602 - DNA, 363 bp, Homo sapiens
  misc_feature: NA.12.58.F03.1.454.heavy.1.nb
gtggccaatatacagtcaggtggaggtacgatacattatctcgactctgtgaagggccggttcaccatctccagagacaacgccaagaattcactgtatctgcaaatgaacagcctgagagtcgaagacacgggtatttattattgtgtgcgagatctggatttccttcgaaatgaagtgtggttcgatgtgtttgatctttggggccaagggacaattgtcaccgtctcttcagcctccaccaagggcccatcggtcttccccctggcgccctgctccaggagcacctccgagagcacagcggccctgggctgcctggtcaaggactacttcctacgtcgtatctgagcgggctggcaaggc

SEQ ID NO: 295603 - DNA, 194 bp, Homo sapiens
  misc_feature: NA.12.66.F11.2.454.heavy.1.nb
tatgcgccttgccagcccgctcagatacgacgtaggaagtagtccttgaccaggcagcccagggccgctgtgcccccagaggtgctcttggaggagggtgccaggggaagaccgatgggcccttggtggaggctgaggagacggtgacctgggttccctggccccaggggtcaaagtagttgggaaagtagtca

SEQ ID NO: 295604 - DNA, 359 bp, Homo sapiens
  misc_feature: NA.12.69.G03.1.454.heavy.1.nb
ggtggccaacataaaggaggatggaactaagaaatattatgtggactctgtgagggcccgattcaccgtctccagagacaacgccaagaactctctgtttctgacaatgaacagcctgagagccgaggacacggctgtatattactgtgcgcgagagcggcgtagcggttaccaacccaactactttgacttctggggccagggaaccctggtcaccgtctcctcagcctccaccaagggcccatcggtcttccccctggcaccctcctccaagagcacctctgggggcacagcggccctggctgcctggtcaaggactacttcctacgtcgtatctgagcgggctggcaaggcgcata

SEQ ID NO: 295605 - DNA, 303 bp, Homo sapiens
  misc_feature: NA.12.73.G07.1.454.heavy.1.nb
  modified_base (229)..(229): a, c, t, g, unknown or other
  misc_feature (229)..(229): n is a, c, g, or t
gccctggattccaaggcctatccacttggtgagcagcactgagcaccgagaattcaccatggaactggggctccgctgggtcttccttgttgctattttagaaggtgtccagtgtgaagtgctgttggtggagtcgtgggggaggcctggtcaagcctgggggatccctgagactctcctgtgcagcctctggattcagcttcagtcactatagtatgaactgggtccnccagactccgtggggaaggggctggagtgggtctcattcatcagtagtgaccaacaattacatttactacgccg

SEQ ID NO: 295606 - DNA, 400 bp, Homo sapiens
  misc_feature: NA.12.78.H01.1.454.heavy.1.nb
gtacagcctggggggtccctgagactctcctgtgcagcctctggattcacctttagcaactatgccatgagctgggtccgccaggctccagtgaaggggctggagtgggtctcaggtattagtggtagtggtggtagcagatactacgcagactccgtgaagggccggttcagcatctccagagacaattccaagaacacgctgtatttgcatatgaacagcctgagagccgaggacacggccgtatattactgtgcgaagcttagcggttaccggctacgattggggagcgactggttcgacccctggggccagggaaccctggtcaccgtctcctcagcctccaccaagggcccatccggtcttccccctggccaccctcctccaagacgcacctctg

SEQ ID NO: 295607 - DNA, 244 bp, Homo sapiens
  misc_feature: NA.12.78.H01.3.454.heavy.1.nb
gtacagcctggggggtccctgagactctcctgtacaacctctggattcatgtttagtagtcattggatgaactgggtccgccaggctccagggaaggggctgggagtgggtggccaaacataaaagcaagatggaagtgagaaatactatgtggactctgtgaagggccattcaacaatctccagagacaacgccaaagaactcactgtatctgacaaaataaacagcctagaaagccgaggac

SEQ ID NO: 295608 - DNA, 107 bp, Homo sapiens
  misc_feature: NA.12.78.H01.4.454.heavy.1.nb
ctatgcgccttgccagcccgctcagatacgacgtaggaagtagtccttgaccaggcagcccagggccgctgtgcccagcacctgaactcctgggggaccgtcagtct

SEQ ID NO: 295609 - DNA, 259 bp, Homo sapiens
  misc_feature: NA.12.79.H02.1.454.heavy.1.nb
ccacacccctccttgggagaatcccctagatcacagctcctcaccatggactggacctggagcatccttttcttggtgacagtagcaacaggtgtccactcccaggtgcatctggagcagtctggagctgaggtgaaggagccgtggggcctcagtaaaaatctcctgcaagtcttctggttacgcactcaccgccaatggtatcagctggctgcgacaggcccctggacaaggtcttgagtggatgtcatggatcagc

SEQ ID NO: 295610 - DNA, 347 bp, Homo sapiens
  misc_feature: NA.13.1.A01.1.454.heavy.1.nb
ccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctcagggcagattcaccatgacgacagacacatacacgaacacagcctacatggaggtgagg

SEQ ID NO: 295611 - DNA, 285 bp, Homo sapiens
  misc_feature: NA.13.1.A01.2.454.heavy.1.nb
gaggaggggtgaagaagcctggggcctcagtgcaggtcgcctgcagggcctctggttacattttcgacaacttttggcatctactgggtgcgacaggcccctggccacggccttgagtcgctggggtggatcagttgttacaacggtgacacagactttgcacagaagtttgagggcagagtcaccctgaccacagacacatccgcgaacacagcctacatggaactgaggaatctagacatctgacgacacggccatatattactgtgcgagaaggacggtttt

SEQ ID NO: 295612 - DNA, 151 bp, Homo sapiens
  misc_feature: NA.13.1.A01.3.454.heavy.1.nb
tatgcgccttgccagcccgctcagtcacgtactatcagatggcgggaagatgaagacagatggtgcagccacagttcgattggtatccactttggtcccagggccgaaagtgaaaggccagaatgtagcttgcatgcagtaataaatccca

SEQ ID NO: 295613 - DNA, 336 bp, Homo sapiens
  misc_feature: NA.13.11.A11.3.454.heavy.1.nb
ggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccacggtcaccgtctcctcagcctccaccaagggcccatcggtcttcccctggcgccctgctccaggagcacctctgagagcacagcggccctgggctgcctggtcaaggactacttcctagtacgtgactgagcgggctggcaaggcgcata

SEQ ID NO: 295614 - DNA, 300 bp, Homo sapiens
  misc_feature: NA.13.12.B01.1.454.heavy.1.nb
cggcagcccgccgggaagggactggagtggattgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtcgtggggccaagggaccacggtcaccgtctcctcagcctccaccaagggcccatccggtccttccccctggccgccctgcctccgaggacgccacccgtccgagacgca

SEQ ID NO: 295615 - DNA, 73 bp, Homo sapiens
  misc_feature: NA.13.12.B01.4.454.heavy.1.nb
aggcagcgctctcgggacgtctccaccatggcctgggctctgctattcctcaccctcctcactcagggcagta

SEQ ID NO: 295616 - DNA, 151 bp, Homo sapiens
  misc_feature: NA.13.21.B10.2.454.heavy.1.nb
ccgccatccttgccctcctcctggctgttctccaaggagtctgtgccgaggtgcagctggtgcagtctggagcagaggtagaaaaacggcccggggagtctctgaagatctctgtaagggttttggaaacagtctttatcagccacgtgga

SEQ ID NO: 295617 - DNA, 314 bp, Homo sapiens
  misc_feature: NA.13.23.C01.2.454.heavy.1.nb
gccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccagggaaccctggtcaccgtctcctcagcctccaccaagggcccatcggtcttccccctggcaccctcctccaagagcacctctgggggcacagcggccctgggctgcctggtcaaggactacttcctagtacgtgactgagcgggctggcaaggcgcata

SEQ ID NO: 295618 - DNA, 244 bp, Homo sapiens
  misc_feature: NA.13.25.C03.2.454.heavy.1.nb
cccagcaaccacatctgtcctctagagaatcccctgagagctccgttcctcaccatggactggacctggaggatcctcttcttggtggcagcagccacagcagcccactcccaagtgctcctgaaacagtccggggctgaggtgaagaagcctggggcctcagtgaaggtctcctgcaaggcttccggatacaccctcaatggaaactatgtccactatgtgcgacacggccccaggacaaggg

SEQ ID NO: 295619 - DNA, 179 bp, Homo sapiens
  misc_feature: NA.13.25.C03.3.454.heavy.1.nb
tatgcgccttgccagcccgctcagtcacgtactaggaagtagtccttgaccaggcagcccagggccgctgtgcccccagaggtgctcttggaggagggtgccagggggaagaccgatgggcccttggtggaggctgaggagacggtgaccagggttccctggccccagtagtcaaagta

SEQ ID NO: 295620 - DNA, 321 bp, Homo sapiens
  misc_feature: NA.13.27.C05.1.454.heavy.1.nb
ctttctgagagtcatggatctcctgtgcaagaaaatggagcacctgtggttcttcctcctgctggtggcggctcccagatgggtcctggcccaagtgcagttggtggagtcgggcccagggctggtgaagccttcgacgaccctgtccctcacttgcactgtctcaggtgctccattaaaaccagcagttatcactggggtgatccggcacggcccccggggaaggagctggagtggatggggaggatttattatactggcaatacttacgacaatccgtcctcaagagtcgagtcaccctgtccgtggacacgccgaaat

SEQ ID NO: 295621 - DNA, 79 bp, Homo sapiens
  misc_feature: NA.13.27.C05.2.454.heavy.1.nb
tgccagccgctcagtcacgtactagaggagggcgggaacagagtgacagtggggttggccttgggctgacctaggacgg

SEQ ID NO: 295622 - DNA, 353 bp, Homo sapiens
  misc_feature: NA.13.30.C08.1.454.heavy.1.nb
gattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatctggggccaagggtcgatggtcatcgtctcttcagcctccaccaagggcccatcggtcttccccctggcgccctgctccagagcacctctgggggcacagcggccctgggctgcctggtcaaggactacttcctagtacgtgactgagcgggctggcaaggcgcata

SEQ ID NO: 295623 - DNA, 96 bp, Homo sapiens
  misc_feature: NA.13.33.C11.1.454.heavy.1.nb
gagcccagcactgggattccgaggtatttccattcggtgatcagcactgaacacagaggactcaccatggagttttggctgagctgggttttcctt

SEQ ID NO: 295624 - DNA, 193 bp, Homo sapiens
  misc_feature: NA.13.33.C11.2.454.heavy.1.nb
attactattttaaaaggtgtccagtgtgaggtgcagttggtggagtctggaggaggcttggtccaggccgggggggtccctgagactctcatgtgcggcctctgggctcaccgtcaacaccaactacatgagctgggtccgccaggctccagggagaggccggagtgggtctcagttatttatgtcgacggtg

SEQ ID NO: 295625 - DNA, 130 bp, Homo sapiens
  misc_feature: NA.13.33.C11.3.454.heavy.1.nb
gttgctattttaaaaggtgcccagtgtgaggtgcagctggtggagtctggaggaggcttgatccagcctggggggtccctgagactctcctgtgcagcctctgggttcaccgtcagtcacacctacatga

SEQ ID NO: 295626 - DNA, 244 bp, Homo sapiens
  misc_feature: NA.13.33.C11.4.454.heavy.1.nb
ctgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactgggctggatccggcacgccccgagggaagggctggagtggagttggggata

SEQ ID NO: 295627 - DNA, 378 bp, Homo sapiens
  misc_feature: NA.13.36.D03.1.454.heavy.1.nb
aaccacacccctcctaagaagaagcccctagaccacagctccacaccatggactggacctggaggatcctcttcgttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgagacactg

SEQ ID NO: 295628 - DNA, 469 bp, Homo sapiens
  misc_feature: NA.13.37.D04.2.454.heavy.1.nb
aggagcccagccctgggattttcaggtgttttcatttggtgatcaggactgaacagagagaactcaccatggagtttgggctgaactggctttttcttgtggctattttaagaggtgtccagtgtgaggtgcaactgttggagtcgtgggggagcgttggttcagccgtggggggtccctgagactctcgtgtgcagcctctggtattttagttttagctagttatgccatgagctgggtccgccaggctccagggaaggggctggagtgggtttcgggtattagtgctcttgatgatagcacatactatgcagactccgttaagggccgcttcaccatctccagagacaattccaagaacacgctatatctgcagatgaacagcctgggagccgaggacacggccgtttatcactgtgcgaaagatattgtaatgatggtagctgctactactactttttgactacgt

SEQ ID NO: 295629 - DNA, 106 bp, Homo sapiens
  misc_feature: NA.13.37.D04.4.454.heavy.1.nb
tatgcgccttgccagcccgctcagtcacgtactaggaagtagtccttgaccaggcagcccagggccgctgtgcccagcacctgaactcctgggggaccgtcagtct

SEQ ID NO: 295630 - DNA, 359 bp, Homo sapiens
  misc_feature: NA.13.38.D05.1.454.heavy.1.nb
ggagccccagccttgggattcccaagtgttttcattcagtgatcaggactgaacacagaggactcaccatggagtttgggctgagctggattttcctcgctgctattttaaaaggtgtccagtgtgaggtgcaagtggtggagtcgtggggggggcttggttaagccgtggggggtccctcagactctcctgtgcaacctctggattctattttctctgacgcctggttgagctgggtccgccaggctcccgggaagggctggagtgggttggccgtattaaaggtagaagacatggtcggacaacagactacagtgttcccgtagaaaggcagattcactatctcaagagatgactac

SEQ ID NO: 295631 - DNA, 241 bp, Homo sapiens
  misc_feature: NA.13.4.A04.5.454.heavy.1.nb
cagccctgggattttcaggtgttttcatttggtgatcaggactgaacagagagaactcaccatggaatttgggctgagctggctttttctgtggctattttaaaaggtgtccagtgtgaagtgcagctggtggagtctgggggaggcttggtacagcctgggaggtccctgagactctcctgtgcagcctctggattcacctttagcaactatgccatgagctgggtccgccaggctccga

SEQ ID NO: 295632 - DNA, 245 bp, Homo sapiens
  misc_feature: NA.13.41.D08.1.454.heavy.1.nb
ggtttcatatatcactggtgatagtgcttccacatattacgcagactctatgaagggccgattcaccatctccagagacaatgccaggaactcgctgtatctgcaaatgaacagcctgagagccgaggacacggctgtctattactgtgcgaaagccagggggcgtttattgactactggggccagggaatcctggtcaccgtctcctcagcctccaccaagggcccatcggtcttccccctggc

SEQ ID NO: 295633 - DNA, 219 bp, Homo sapiens
  misc_feature: NA.13.42.D09.1.454.heavy.1.nb
gattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcgcggggcacttttgatatcgtggggccaagggtcgatggtcatcgtctctt

SEQ ID NO: 295634 - DNA, 136 bp, Homo sapiens
  misc_feature: NA.13.42.D09.2.454.heavy.1.nb
cagcctccaccaagggcccatcggtcttccccctggccgccctgctccaggagcacctccgagagcacagcggccctgggctgcctggtcaaggctacttcctagtacgtgactgagcgggctggcaaggcgcata

SEQ ID NO: 295635 - DNA, 194 bp, Homo sapiens
  misc_feature: NA.13.42.D09.3.454.heavy.1.nb
attgggcttatcaatgccagtgggggcaccagctacaacccctccctcaagagccgcgtcaccatttcagtagacacgtccaagaaccagctctccctgaagctgagttctgtgaccgccgcagacacggccgtgtattactgtgcgcgacaggtggacgtctggggccaaggggaccacggtcaccgtctcct

SEQ ID NO: 295636 - DNA, 364 bp, Homo sapiens
  misc_feature: NA.13.42.D09.4.454.heavy.1.nb
gattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccggaaccctggtcaccgtctcctcagcctccaccaaggcccatccggtcttccccctggcaccctcctccaagagcacctctgggggcacagcggccctgggctgcctggtcaaggactacttcctagtacgtgactgagcgggctggcaaggcg

SEQ ID NO: 295637 - DNA, 282 bp, Homo sapiens
  misc_feature: NA.13.42.D09.6.454.heavy.1.nb
ggcagggaaacgggcggtcggagtgggtggccaacataaacacagacggaagtgacccatactatgcggactctgtgaagggccgattcaccatctccagagacaacgccaagaactcactatatttgcaaatggaccgcctgagagacgaggacacggctatgtattactgtgcgagagatgagagtggctacgaggttggggccggggaaccctggtcaccgtcaactcagcctccaccaagggcccatcggtcttccccctggcgccctgcctccagga

SEQ ID NO: 295638 - DNA, 291 bp, Homo sapiens
  misc_feature: NA.13.43.D10.1.454.heavy.1.nb
cagccttgggattcccaagtgttttcattcagtgatcaggactgaacacagaggctcaccatggagtttgggctgagctggattttccttgctgctattttaaaaggtgcccagtgtgaggtgcagctggtggagtcgtggaggaggcttgtaaaggccgggggggtcccttcgactctcctgtgcagcctctggaatcactttcagtgacgcctggatgaactgggtccgcaggctccgagggagggctggagtggatggcgtagtaaagtgagcctgatgggtggacaa

SEQ ID NO: 295639 - DNA, 218 bp, Homo sapiens
  misc_feature: NA.13.46.E02.1.454.heavy.1.nb
attggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcgacccctggggcccgggaaccct

SEQ ID NO: 295640 - DNA, 199 bp, Homo sapiens
  misc_feature: NA.13.46.E02.10.454.heavy.1.nb
gtaggtttcattaggagcaattctcatgatgggacaacagaatacgccgcgtctgtaaaaggcagattcaccatctcaagagatgagtccagaagcatcgccttttctgcagatgagtagcctgaagaccgaggacacagccatctattactgtgctagagagtattgcagtcctacgacctgctagtggggccttggt

SEQ ID NO: 295641 - DNA, 153 bp, Homo sapiens
  misc_feature: NA.13.46.E02.11.454.heavy.1.nb
ttggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacggc

SEQ ID NO: 295642 - DNA, 91 bp, Homo sapiens
  misc_feature: NA.13.46.E02.12.454.heavy.1.nb
gtctcaggtatttatggtaacagtgaaagaatagggtatgcggactctgtgaagggccgattcaccatctccagagacaacgccaagactc

SEQ ID NO: 295643 - DNA, 203 bp, Homo sapiens
  misc_feature: NA.13.46.E02.3.454.heavy.1.nb
gtctctggtataaactggaatggtgccagcacaacttatgcagactctgtgaagggccgattcaccatctccagagacagtgccgagaactccgtacatctgcaaatgaacagtctcggagtcgaggacacggccttgtatttctgtgcgaggttagcagtggctggtacttacgcaatggacgtctggggccaagggaccac

SEQ ID NO: 295644 - DNA, 339 bp, Homo sapiens
  misc_feature: NA.13.46.E02.5.454.heavy.1.nb
gtctcacggattgacaatgatgggagagacacaatccacgcggattctgtgaggggccgattcaccacatcgagagacaacgccaagaacacggtatatctgcaaatgaacagtctgagaggcgaagacacggcggtttacttctgtgcaagaggtggctggtcgcatggttttgatctcgtggggccaggggacaatggtaaccgtctcttcagcctccaccaagggcccatcggtcttccccctggccgccctgcctccaggagcacctccgagagcacagcggccctgggctgcctggtcaaggctacttcctagtacgtgactgagcgggctggc

SEQ ID NO: 295645 - DNA, 288 bp, Homo sapiens
  misc_feature: NA.13.46.E02.6.454.heavy.1.nb
gttggcagtcatttcagatgatggcaatgataaatattacgcacgctccgtgaagggccgattcgccatctccagagacaattccaggaacacgctgtacctggagatggacggcctgagacctgacgacacggcaatttatactgtgcgagggtttatgtgttggaacgtggtacaccggaaaactggttcgacccctggggcccagggaaccctggtcgtcgtctcgtctgcctccaccaacgggcccatccggtccttcccccgtggccgccctgcctccgaggc

SEQ ID NO: 295646 - DNA, 258 bp, Homo sapiens
  misc_feature: NA.13.46.E02.8.454.heavy.1.nb
gattggggaaatctatcatagtgggaccacctactacagcccgtccctcaatagtcgcgtcaccatgtcagtggacgagcccaagaaccagttctccctgagcctgacctctgtgaccgccgcggactcggccctatacttctgtgcgagagatcgagatgtgtcatcggcggggctacttttgatatcgtggggccaaagggtcgatggtcatcgtctcttcagcctccaccaacgggcccagtcggtccttccccc

SEQ ID NO: 295647 - DNA, 240 bp, Homo sapiens
  misc_feature: NA.13.46.E02.9.454.heavy.1.nb
gtggccaacataaaggaggatgggagtcagacatattatgtggagtctgtgcggggccgattcaccatttccagagacaacgccagatcgtcagtatatctgcaaatgaggagcctgagagtcgatgatacggctacatattattgtgcgagaattgactagttttccagacggcgactacgttgtcggcgtggggcgactttgactatttggggccaagggacactgtcaccgtctccc

SEQ ID NO: 295648 - DNA, 106 bp, Homo sapiens; identical to SEQ ID NO: 295629
  misc_feature: NA.13.53.E09.5.454.heavy.1.nb

SEQ ID NO: 295649 - DNA, 305 bp, Homo sapiens
  misc_feature: NA.13.55.E11.6.454.heavy.1.nb
tgagagtcatggatctcatgtgcaagaaaatgaagcacctgtggttcttcctcctgctggtggcggctcccagatggggcctgtcccagctgcagctgcaggagtcgggcccaggagtggtgaagccttcggagaccctgtccctcagttgtaatgtgtctggtggctccctaagtaggactacttactactggggctggatccggcagcccccagggaaggggctggagtggattggggatatctcttatagtgggagtacgaactacaatccgtccctcaagagtcgagtcatcatatccgta

SEQ ID NO: 295650 - DNA, 106 bp, Homo sapiens; identical to SEQ ID NO: 295629
  misc_feature: NA.13.57.F02.1.454.heavy.1.nb

SEQ ID NO: 295651 - DNA, 340 bp, Homo sapiens
  misc_feature: NA.13.59.F04.2.454.heavy.1.nb
catagtggtaccacctactacagcccgtccctcaatagtcgcgtcaccatatcagtggacgagtccaagaaccagttctccctgagcctgacctctgtgaccgccgcggactcggccctatacttctgtgcgagagatcgagatgtgtcatcgcggggcacttttgatatctggggccaagggtcaatggtcatcgtctcttcagcctccaccaagggcccatcggtcttccccctggcagccctgcctccaggagcacctccgagagcacagcggccctgggctgcctggtcaaggactacttcctagtacgtgactgagcgggctggcaaggcgcata

SEQ ID NO: 295652 - DNA, 304 bp, Homo sapiens
  misc_feature: NA.13.59.F04.3.454.heavy.1.nb
agcccagcactgggattccgaggtatttccattcggtgatcagcactgaacacagaggactcaccatggagttttggctgagctgggttttccttattactattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggctccgaggggaaggggctgggagtgcgtctcttttattatagtagtggtagtacatactcgcag

SEQ ID NO: 295653 - DNA, 98 bp, Homo sapiens
  misc_feature: NA.13.6.A06.1.454.heavy.1.nb
acgattaccgcggacagatccacgagcacagtgtacatggagctgagccgcctgacatctgaagacacggccgtgtattactgtgcgagagatcgggg

SEQ ID NO: 295654 - DNA, 175 bp, Homo sapiens
  misc_feature: NA.13.6.A06.3.454.heavy.1.nb
tatgcgccttgccagcccgctcagtcacgtactaggaagtagccttgaccaggcagcccagggccgctgtgctctcggaggtgctcctggagcagggcgccagggggaagaccgatgggcccttggtggaggctgaggagacggtgaccgtggtcccttggccccagacgtccat

SEQ ID NO: 295655 - DNA, 197 bp, Homo sapiens
  misc_feature: NA.13.6.A06.6.454.heavy.1.nb
cagtcctgtcccaggtgcagctgcgggagtcgggcccaggactggtgaagccttcggagaccctgtccctcacctgcactgtctctggtggctccatcagtagttactactggagctggatccggcagcccccagggaagggactggagtggattgggcagtatctttacagtgggagcaccaactacaacccctcc

SEQ ID NO: 295656 - DNA, 72 bp, Homo sapiens
  misc_feature: NA.13.6.A06.8.454.heavy.1.nb
agtcagggcgagactgagccacggatcctgtgccctcgagtgaggaggcgtgaggaggagcagagcccagga

SEQ ID NO: 295657 - DNA, 261 bp, Homo sapiens
  misc_feature: NA.13.60.F05.1.454.heavy.1.nb
ggggatatctcttatagtgggagtacgaactacaatccgtccctcaagagtcgagtcatcatatccgtagacaggtccaggaacgaattctccctgaaagtgagttctgtgaccgtcgcagacacggctgtctattatgtgcgagacggcaaatatggttcagggagttcgactacgtggggccaaggggaaccctggtcaccgtctcctcagccctccaccaagggcccatcggtccttccccctggccacccctcctcc

SEQ ID NO: 295658 - DNA, 221 bp, Homo sapiens
  misc_feature: NA.13.61.F06.1.454.heavy.1.nb
gtggccaacataaaggaggatgggagtcagacatattatgtggagtctgtgcgggccgattcaccatttccagagacaacgccagatcgtcagtatatctgcaaatgaggagcctgagagtcgatgatacggctacatattattgtgcgagaattgacagttttccagacggcgactacgttgtcggctggggcgactttgacatttggggccaagggaca

SEQ ID NO: 295659 - DNA, 151 bp, Homo sapiens
  misc_feature: NA.13.61.F06.2.454.heavy.1.nb
atgcgccttgccagcccgctcagtcacgtactaggaagtagtccttgaccaggcagcccagggccgctgtgcccccagaggtgctcttggaggagggtgccagggggaagaccgatgggcccttggtggaggctgaggagacggtgaccag

SEQ ID NO: 295660 - DNA, 196 bp, Homo sapiens
  misc_feature: NA.13.61.F06.3.454.heavy.1.nb
ttggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgacttttggagtggtgcgctcga

SEQ ID NO: 295661 - DNA, 179 bp, Homo sapiens
  misc_feature: NA.13.61.F06.5.454.heavy.1.nb
attggggatatctcttatagtgggagtacgaactacaatccgtccctcaagagtcgagtcatcatatccgtagacaggtccaggaacgaattctccctgaaagtgagttctgtgaccgtcgcagacacggctgtctattattgtgcgagacagcaaatatggttcagggagttcgacta

SEQ ID NO: 295662 - DNA, 384 bp, Homo sapiens
  misc_feature: NA.13.63.F08.1.454.heavy.1.nb
ccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtggatcagttgttacaacggtgacacagactttgcacagaagtttgagggcagagtcaccctgaccacagacacatccgacgaacacagcctacatggaactgaggaatctgacatctgacgacacgccatatattactgt

SEQ ID NO: 295663 - DNA, 361 bp, Homo sapiens
  misc_feature: NA.13.65.F10.1.454.heavy.1.nb
cactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcagcctctgggtcaccgtcaacaccaactacatgagctgggtccgccaggctccgagggaagaggccggagtgggtctcgagttatttatgtcgacggtgccacattctacgcagactccgtgaggggccgttcaccatctccagagacaattccaagaacacggtgtatcttacaaa

SEQ ID NO: 295664 - DNA, 336 bp, Homo sapiens
  misc_feature: NA.13.65.F10.2.454.heavy.1.nb
ccctccttgggagaatcccgtagatcacagctcctcaccatggactggacctggagcatccttttcttggtggcagcggcaacaggtgtccaccctgaggttcagttggttcagtctggaggaggggtgaagaagcctggggcctcagtgcaggtcgcctgcagggcctctggttacattttcgacaactttggcatctactgggtgcgacaggcccctggccacggccttgagtcgctggggtgatcagttgttacaacggtgacacagactttgcacagaagtttgagggcagagtcaccctgaccacagacacatccgcgaacacagcctaca

SEQ ID NO: 295665 - DNA, 367 bp, Homo sapiens
  misc_feature: NA.13.67.G01.2.454.heavy.1.nb
gtacagcctggaaggtccctgagactctcctgtgcagcctctggattcacctttagcagctatgccatgacctgggtccgccaggctccagggaaggggctggcgtgggtctcaggtattagtggtagtggtggaagcacatactacgcagactccgtgaagggccggttcaccatctccagagacaattccaagaacacgctgtatctgcaaatgaacagcctgagagccgaggacacggccgtatattactgtgcagcagtggctggcacaggagcatattactttgactactggggccagggaaccctggtcaccgtctcctcagcctccaccaagggcccatcggtcttccccctggcaccct

SEQ ID NO: 295666 - DNA, 297 bp, Homo sapiens
  misc_feature: NA.13.67.G01.3.454.heavy.1.nb
ggagccccagccctgagattcccacgtgttgccattcggtgatcagcgctgaacacagaggactcgccatggagtttgggctgagctgggttttccttgttgctattttaaaaggtgtccagtgtgaggtgcagctggtagagtcgtgggggaggtggtggtacggccgtggggggtccctcgagactctcctgtgcaacctctggattcagatttgatgagtatggcatacactgggtcccgccaacctccgaggggaaggggctgcaggtgggtctcgtggtataaacgtggaat

SEQ ID NO: 295667 - DNA, 263 bp, Homo sapiens
  misc_feature: NA.13.67.G01.4.454.heavy.1.nb
gtccagcctggggggtccctgagactctcctgtgcagcctctggattcactttttagtaggtattggatgggttgggtccgccagactccagagaagggactggagtgggtggccaacataaaggaagatggaagtgaaagatactatgtggactctgtgaagggccattcaccatctccagagacaacgccaagaactcactgtatctgcagatgaccagcctgagagtcgaggatacggctgtgtattattgtgcgagaga

SEQ ID NO: 295668 - DNA, 163 bp, Homo sapiens
  misc_feature: NA.13.71.G05.4.454.heavy.1.nb
gctgacggagtctggaggagacttggtccaggccgggggggtccctgagactctcctgcatagtctcaagatttatgttcagtaattattggatgagctgggtccgccaggctccgaggggaagggctggagtgggtggccaacataaagcacgatggaagtg

SEQ ID NO: 295669 - DNA, 131 bp, Homo sapiens
  misc_feature: NA.13.71.G05.5.454.heavy.1.nb
gctggtggagtcgtggggggggcttggtccagccgtgggggtccctgagactctcctgtgcagcctctggattcacttttagaggtattggatgggttgggtccgccagactccagagaagggactggagt

SEQ ID NO: 295670 - DNA, 323 bp, Homo sapiens
  misc_feature: NA.13.71.G05.6.454.heavy.1.nb
cgccatccttgccctcctcctggctgttctccaaggagtctgtgccgaggtgcagctggtgcagtctggagcagaggtgaaaaagcccggggagtctctgaagatctcctgtaagggttttggaaacagctttatcagccactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgcca

SEQ ID NO: 295671 - DNA, 223 bp, Homo sapiens
  misc_feature: NA.13.71.G05.8.454.heavy.1.nb
gctgggttttccttgttgctattttaaaaggtgcccagtgtgaggtgcagctggtggagtctggaggaggcttgatccagccgtggggggtccctgagactctcctgtgcagcctctgggttcaccgtcagtcacacctacatgagctgggtccgccaggctccgagggaaggggctggagtgcgtctcttttattatagtagtggtagtacatactccgcag

SEQ ID NO: 295672 - DNA, 320 bp, Homo sapiens
  misc_feature: NA.13.73.G07.4.454.heavy.1.nb
ccctccttgggagaatcccctagatcacagctcctcaccatggactggacctggagcatcctttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaacacagactatggacagaacctccagggcagatcaccatgacgacagacacatac

SEQ ID NO: 295673 - DNA, 377 bp, Homo sapiens
  misc_feature: NA.13.75.G09.1.454.heavy.1.nb
catggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtggtccttcagtggttactactggagctggatccgccagcccccagggaaggggctggagtggattggggaaatcaatcatagtggaagcaccaactacaacccgtccctcaagagtcgagtcaccatatcagtagacacgtccaagaaccagttctccctgaagctgagctctgtgaccgccgcggacacggctgtgtattactgtgcgagacggccccg

SEQ ID NO: 295674 - DNA, 358 bp, Homo sapiens
  misc_feature: NA.13.75.G09.2.454.heavy.1.nb
ttgggtacgtctacgatactgtgacctactacaagccgtccctcaagagtcgcgtcaccatgtcagtggacaggtcgaagaatcaattctccctgaacctgacctctgtgaccgccgcggacacggccgtgtattattgtgccagaggccttatggttgagggacttattctgacttctggttttgatatctggggccaggggacaatggtcactgtctcttcagcctccaccaagggcccatcggtcttccccctggcaccctcctccaagagcacctctgggggcacagcggccctgggctgcctggtcaaggactacttcctagtacgtgactgagcgggctggcaaggcgcata

SEQ ID NO: 295675 - DNA, 418 bp, Homo sapiens
  misc_feature: NA.13.76.G10.2.454.heavy.1.nb
actgggattccgaggtgtttccattcggtgatcagcactgaacacagaggactcaccatggagttttggctgagctgggttttccttgttgctattttaaaaggtgcccagtgtgaggtgcagctggtggagtctggaggaggcttgatccagcctggggggtccctgagactctcctgtgcagcctctgggttcaccgtcagtcacacctacatgagctgggtccgccaggcctccgagggaacggggctggagtgcgtctcttttatttatagtagtggtagtacatactccgcagactccgtgaggggccattcaccatctccagagacaattccaagaacacgctgtttctacaaatgaacagcctgagagccgatgacacggccgtgtattactgtgcgagagagtggggccc

SEQ ID NO: 295676 - DNA, 178 bp, Homo sapiens
  misc_feature: NA.13.76.G10.5.454.heavy.1.nb
ccctccttgggagaatcccctagatcacagctcctcaccatggactggacctggagcatccttttcttggtggcagcagcaacaggtgcccactctcaggttcagctggtgcagtctggagctgaggtgaagaagccgtggggcctcagtgaaggtctcctgcaaggcttctggttac

SEQ ID NO: 295677 - DNA, 353 bp, Homo sapiens
  misc_feature: NA.13.77.G11.4.454.heavy.1.nb
gattgggtacatccattacagtgggaccacctactacaacccgtccctcaggagtcgacttaccatatcagtagacacgtctaagaaccagttctccctgaagctgagctctgtgactgccgcggacacggccgtatattactgtgcgagagtcggaggttacggtgactatcagcagtttgactactggggccagggaaccctggtcaccgtctcctcaccctccaccaagggcccatcggtcttccccctggcaccctcctccaagagcacctctgggggcacagcggccctgggctgcctggtcaaggctacttcctagtacgtgactgagcgggctggcaaggcgcata

SEQ ID NO: 295678 - DNA, 199 bp, Homo sapiens
  misc_feature: NA.13.77.G11.5.454.heavy.1.nb
gattggccatattaaggacagacctaatggcgcgacagcacactaccttgaatccgtcaaagacagattcatcatctcgagaggtgattccgacaacacggtgtctctccatatgagcagcctgaaaatcgaggacacaggcctatattactgtgcagtgatgggccacgaccacgtacttttggagtggtgcgctcga

SEQ ID NO: 295679 - DNA, 371 bp, Homo sapiens
  misc_feature: NA.13.78.H01.1.454.heavy.1.nb
cctgggtcctcggtgaaggtctcctgcaagccttctggaggcaccttcaacaactatgctataaactgggtgcgacaggcccctggacaagggcctgagtggatgggaggtttcatccctgtctttgatacaacaaactacggacagaggttccagggcagactcacgattaccgcggacagatccacgagcacagtgtacatggagctgagccgcctgacatctgaagacacggccgtgtattactgtgcgagagatcggggactagtaccggggcatattcgcgacctggacttctacttctacatggacgtctggggcaaagggaccacggtcaccgtctcctcagcctccaccaagggcccatcggt

SEQ ID NO: 295680 - DNA, 325 bp, Homo sapiens
  misc_feature: NA.13.78.H01.2.454.heavy.1.nb
ctgacatggtgacgcgactattgagggacgggctggagtggattggggaaatctatcatagtgggaccacctactacagcccgtccctcaatagtcgcgtcaccatgtcagtggacgagcccaagaaccagttctccctgagcctgacctctgtgaccgccgcggacacggccctatacttctgtgcgagagatcgagatgtgtcatcgcggggcacttttgatatctggggccaagggtcgatggtcatcgtctcttcagcctccaccaagggcccatcggtcttcccctggcgccctgctccaggacgcacctccgagagcac

SEQ ID NO: 295681 - DNA, 156 bp, Homo sapiens
  misc_feature: NA.13.78.H01.4.454.heavy.1.nb
tatgcgccttgccagcccgctcagtcacgtactaggaagtagtccttgaccaggcagcccagggccgctgtgcccccagaggtgctcttggaggagggtgccagggggaagaccgatgggcccttggtggaggctgaggagacggtgaccagggct

SEQ ID NO: 295682 - DNA, 28 bp, Homo sapiens
  misc_feature: NA.13.81.H04.2.454.heavy.1.nb
ctgaccgtcctaggtcagcccaaggctg

SEQ ID NO: 295683 - DNA, 537 bp, Homo sapiens
  misc_feature: NA.13.86.H09.1.454.heavy.1.nb
accacacccctccttgggagaatcccctagatcacagctcctcaccatggactggacctggagcatccttttcttggtggcagcagcaacaggtgcccactcccaggttcagctggtgcagtctgcagctgaggtgaagaagcctggggcctcagtgaagatctcctgcaaggcttctggttacacctttagcagctatcttatcagctgggtgcgacaggcccctggacgaggactcgagtggatgggatggatcagcccttacaacggaaacacagactatggacagaacctccagggcagattcaccatgacgacagacacatacacgaacacagcctacatggaggtgaggagcctgagatatgacgacacggccgtgtattattgtgcgagagtggagtggcagtggatatcgacaaattactactattacatggacgtctggggcaaagggacgacggtcaccgtttcgccagcctccaccaagggcccatcggtcttccccctggcaccctcctccaagagcacctctgg

SEQ ID NO: 295684 - DNA, 106 bp, Homo sapiens; identical to SEQ ID NO: 295629
  misc_feature: NA.13.87.H10.3.454.heavy.1.nb

SEQ ID NO: 295685 - DNA, 338 bp, Homo sapiens
  misc_feature: NA.13.88.H11.1.454.heavy.1.nb
gaggagccccagccctgggattcccaagtgttttcattcagtgatcaggactgaacacagaggactcaccatggagtttgggctgagctggattttccttggttgttttttaaaaggtgtccactgtgagctgcagctggtggagtcgtggggggggcttgggtaaagcctggggggtcccttacactctcctgtgtagcctctaaaatcactttcaacgacgcctggatgagctgggtccgccaggcgccgaggggaggggactgggagtgggttggccgtattaaaagcgaggccgagtggtgggacagcagacttcgctgcaccgtgcaagccag

SEQ ID NO: 295686 - DNA, 191 bp, Homo sapiens
  misc_feature: NA.14.14.B03.1.454.heavy.1.nb
cttgttgctattataaaaggtgtccagtgtcaagtgcagttggtggagtctgggggaggcttggtcaagcctggagggtccctgagactctcctgtgcagcctctggattcaccttcagtgactactacatgacctggatccgccaggcgccagggaagggctggaatggattgcatacattcactatagt

SEQ ID NO: 295687 - DNA, 319 bp, Homo sapiens
  misc_feature: NA.14.2.A02.1.454.heavy.1.nb
gcccagctgggatctcagggcttcagtctctgtcctccaccatcatggggtcaaccgccatcctcgccctcttcctggctgttctccaaggagtctgtgccgaggtgcagttggtgcagtctggagcagaggtagaaaaaggccggggagtctctgaagatctcctgtaagggttatggatatagttttacaaactactggatcggctgggtgcgccagacgcccgggagaggcctggagtggatgggaatcatctatcctaatgactctgataggcgatacagcccgtcttcaaggccaagtcaccatctcagtcgac

SEQ ID NO: 295688 - DNA, 395 bp, Homo sapiens
  misc_feature: NA.14.21.B10.1.454.heavy.1.nb
  modified_base (317)..(317): a, c, t, g, unknown or other
  misc_feature (317)..(317): n is a, c, g, or t
tgggattttcaggtgttttcattcggtgatcaggactgaacagagagaactcaccatggagtttgggctgagcgtggcgttttctggtggctattttaaaaggtgtgcagtgtgaggtgcagctgttggagtcgtgggggaggcttggtacagcctgggggtccctgaactctcctgtgcagcctctggattcgtctttagcagctatgccatgagctgggctcgccaggctccgaggggaaggggctggagtgggtctctgctattcctggcagtggtgatatcgaatctacgcagactccgtgaagggcccgttnactgtttccagagacattccaagaacacactgtatctgcagatgacagcctgagagcgaggacacggccgtatattac

SEQ ID NO: 295689 - DNA, 636 bp, Homo sapiens
  misc_feature: NA.14.25.C03.1.454.heavy.1.nb
cgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggaggcgtggtccagcctgggaggtccctgagactctcctgtgcagcctctggattcaccttcagtacctatgctatgcactgggtccgccaggctccaggcgaggggctgggagtgggtggcgattatatcacatgatggaactaatagacgctatgccgactccgtgaagggccgattcaccatctccagagacaattccaagaacacgcagtatctgcaaatgaacagcctgagagctgaggacacggctgtgtattactgtgggagagatggaggtcgatattgtagtggtggtagctgctataactggatcgacccctggggccagggaaccctggtcaccgtctcctcagcctccaccaagggcccatcggtcttccccctggcaccctcctccaagagcacctctgggcacagcggccctgggctgcctggtcaaggactacttccgtactagacgctgagcgggctggcaaggcgcata

SEQ ID NO: 295690 - DNA, 106 bp, Homo sapiens
  misc_feature: NA.14.33.C11.3.454.heavy.1.nb
tatgcgccttgccagcccgctcagcgtctagtacggaagtagtccttgaccaggcagcccagggccgctgtgcccagcacctgaactcctgggggaccgtcagtct

SEQ ID NO: 295691 - DNA, 485 bp, Homo sapiens
  misc_feature: NA.14.35.D02.1.454.heavy.1.nb
taacaaccagattcctcctctaaagaagcccctgggagcacagctcatcaccatggactggacctggaggttcctctttgtggtggcagcagctacagctgtccagtcccaggtccagctggtgcagtctggggctgaggtgaagaagcctgggtcctcggtgaaggtctcctgcaaggtttctggaggcacgttcgacacctacactatcaactgggtgcgacaggcccctggacaagggcttgagtggatgggaaggatcatccctattcgtcgtataacaaattacgcacagagattccaagacagactcacgattaccgcggacaaattcacggccacagcctacatggagttgagcggcctgagatttgacgacacggccttctattactgtgcgagagaactcgctacgataaatatgcccttgcctcttgactactgggccagggaaccctggtcaccgtctcctcagcctccaccaa

SEQ ID NO: 295692 - DNA, 106 bp, Homo sapiens; identical to SEQ ID NO: 295690
  misc_feature: NA.14.35.D02.3.454.heavy.1.nb

SEQ ID NO: 295693 - DNA, 268 bp, Homo sapiens
  misc_feature: NA.14.37.D04.1.454.heavy.1.nb
tgcccgggaaaggcctggagtggatgggaaggatcgaccccattgactcttatacgtactacagcccttctttccaaggccacgtcaccatctcaactgacaagtccacaagtactgcctacctgcagtggagcaacctgagggcctcggacaccgccatctattactgtgcgagacgttaattgtagttaatatgaacttgttatttcgagggactggggccagggaacctggtcaccgtctcctcacgcctccaccgaacgggccc

SEQ ID NO: 295694 - DNA, 106 bp, Homo sapiens; identical to SEQ ID NO: 295690
  misc_feature: NA.14.37.D04.2.454.heavy.1.nb

SEQ ID NO: 295695 - DNA, 105 bp, Homo sapiens
  misc_feature: NA.14.38.D05.1.454.heavy.1.nb
tatgcgccttgccagcccgctcagcgtctagtacggaagtagtccttgaccaggcagcccagggccgctgtgcccagcacctgaactcctgggggaccgtcagtc

SEQ ID NO: 295696 - DNA, 318 bp, Homo sapiens
  misc_feature: NA.14.41.D08.1.454.heavy.1.nb
aggcgttcaccagtcctgtcccaggtgcagctgcaggagtcgggcccaggactggtgaagccttcacagaccctgtccctcacctgcactgtctctggtggctccatcatcagtggtggttactactggagctggatccgccagcacccagggaaggcctggagtggattggctacatctatcacagtgggagcacccactacaacccgtccctcaatagtcgacaaaccatatcagttgacacgtctaagaaccagttctccctgaagctgagctctgtgactgccggacacggccgtgtattactgtgcgaggtcg

SEQ ID NO: 295697 - DNA, 262 bp, Homo sapiens
  misc_feature: NA.14.50.E06.1.454.heavy.1.nb
aaccacatccctcctcagaagcccccagagcacaacgcctcaccatggactggacctggaggatcctctttttggtggcagcagccacaggtgcccactcccaggtccaccttgtgcagtctggggctgaggtgaagaagcctggggcctcagtgaaggtttcctgcaaggcttctggatacaccttcaccacctatgttgttcattgggtgcgccaggcccccggacaaaggcttgagtggagtgggatggatcgaacgct

SEQ ID NO: 295698 - DNA, 470 bp, Homo sapiens
  misc_feature: NA.14.53.E09.1.454.heavy.1.nb
ctcactgccctgctgggatctcagggcttcattttctgtcctccaccatcatggggtcaaccgccatcctcgccctcctcctggctgttctccaaggagtctgtgccgaggtgcaactggtgcagtctggtccagaggtgaaaaagcccggggagtctctgaagatctcctgtcagggttctggatataattttagtaactgttggaccggctgggtgcgccagaggcccgggaaaggcctggagtggatggggatcgtctttcctggtgactcagaaaccagatacagcccgtccttcgaaggccaggtcatcatatcggccgacaagtccgtcaataccgcctacctgcagtggagcagcctcgaggcctcggacaccgccatgtactattgcgcgatcactcacaccgatatttttgatttcgtggggccacgggacaatggtctccgtctcttcagcctccaccaa

SEQ ID NO: 295699 - DNA, 353 bp, Homo sapiens
  misc_feature: NA.14.55.E11.2.454.heavy.1.nb
gagaggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgacactctcctgtgcaacgtctggattcagcttcagtagttatggcatgcactgggtccgccaggctccgaggcaaggggctgggagtgggtggcaggttgtgtggtatgacggaagtaatagaaagtatgccgacgccgtagaagggccgattcaccatctccagagacaa

SEQ ID NO: 295700 - DNA, 631 bp, Homo sapiens
  misc_feature: NA.14.57.F02.1.454.heavy.1.nb
gaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccgggggaggcttggtacagccgggggggtccctgacactctcctgtgcagcctcaggattcatttttagcgaatatgccatgagctgggtccgccaggctccagggaaggggctggagtgggtctcagcaatcagtggttctagtggaagtacattcgacgccgtctccgtgaagggccggttctccatctccagagacaattccaagaacactctatttcttcaaatggacagcctgaaagacgaagacacgggcgtgtatttttgtgtgaaagatacgaagtctatgatacccaatttgggaggggcctttcatgtctggggccaagggacgctggtcaccgtctcttcagcctccaccaagggcccatcggtcttccccctggcaccctcctccaagagcacctctggggcacagcggccctgggctgcctggtcaaggactacttccgtactagacgctgagcgggctggcaaggcgcata

SEQ ID NO: 295701 - DNA, 365 bp, Homo sapiens
  misc_feature: NA.14.60.F05.1.454.heavy.1.nb
tggccgtattaagagtaaagctaacaattacgcgacagtatatgctgcgtcggtgaaaggcaggttcaccatctccagagatgattcagagaacacggcgtatctgcaaatgaacagcctgaaaaccgaggacacggccgtgtattattgtactagaccgtcttacgatattttgactggtcggcgggggttcgaccccgtggggccagggaaccctggtcaccgtctcctcagcttccaccaagggcccatcggtcttccccctggcgccctgctccaggagcacctctgggggcacagcggccctggctgcctggtcaaggctacttccgtactagacgctgagcgggctggcaaggcgcata

SEQ ID NO: 295702 - DNA, 334 bp, Homo sapiens
  misc_feature: NA.14.66.F11.2.454.heavy.1.nb
  modified_base (278)..(278): a, c, t, g, unknown or other
  misc_feature (278)..(278): n is a, c, g, or t
ggcttcaccagtcctgtcccaggtgcagctgcaggagtcgggcccaggactggtgaagccttcacagaccctgtccctcacctgcactgtctctggtgctccatcatcagtggtggttactactggagctggatccgcagcacccagggaaggcctggagtggattggctacatctatcacagtgggagcaccccatacaacccgtccctcaatagtcgacaaaaccatatcagttgacacgtctaagaaccagttctccctgaagctgagctctgtnactgccgcggacacggccgtgtattactgtgcgaggtcgattgtgatggtaacaac

SEQ ID NO: 295703 - DNA, 306 bp, Homo sapiens
  misc_feature: NA.14.68.G02.1.454.heavy.1.nb
tggttctcactcaccgatggtcgattgggtgtgagctggatccgtcagtccccagggaaggccctggagtggcttgcacacatgtattggaatgacgaaaaatcgtacaggaaatctctgcagagcaggctcatcatctccagggacacatccaaaagccaggtggtccttaccatgaccaacatggaccctgtggacacagccacatattactgtgcacggatcgtttattattacggttcggggagctccaagcttgactactggggccagggaaccctggtcaccgtctcctcagcctccacc

SEQ ID NO: 295704 - DNA, 624 bp, Homo sapiens
  misc_feature: NA.14.70.G04.1.454.heavy.1.nb
gcccagccctgggattttcaggtgttttcatttggtgatcaggactgaacagagagaactcaccatggagtttgggctgaactggcttcttcttgtggctattgtaaaaggtgtccagtgtgaggtgcaactgttggagtcgtgggggaggcttggtacagcctggggggtccctaaaactctcctgtacaacctcaggattcgcctttcgcatctatgccatggcctgggtccgccagattccagggaaggggctggagtggatctcaactattagtggaagtgggagtggtgaatccacatattacgcaggctctgtgaagggccggttcaccatctccagagacaattccaacaacacactttatctgcaaatgaacagcctgcgagccgaggacacggccctatattactgtgcaagagatcgaacaggcccgtgggagcccgttgactactggggccagggaaccctagtcatcgtctcctcagcctccaccaagggcccatcggtcttccccctggcaccctcctccaagagcacctctgggggcacagcggccctgggctgcctggtcaagggactacttccgtactagacgctgagcgggctgggcaaggcgcata

SEQ ID NO: 295705 - DNA, 304 bp, Homo sapiens
  misc_feature: NA.14.71.G05.1.454.heavy.1.nb
tgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacgagggccggggggtccctgagactctcctgtgcagcctctggattcgtctttagcagctatgccatgagctgggctcgccaggctccgagggaagggctggagtgggtctctgctattcctggcagtggtgatatcgaatactacgcagactccg

SEQ ID NO: 295706 - DNA, 380 bp, Homo sapiens
  misc_feature: NA.14.74.G08.1.454.heavy.1.nb
attggcaatatgcatgacagtgggggcaccaactacaacccctccctcaagagtcgagtcaccttatcactagacgcgtccaagaagcagttctccctgaagctgagctctgtgaccgccgcagacacggccgcgtatttctgtgcgagacccgggagacggttttactatgaaaaaggtcgttctgcacatattgttggtggttttgatgtctggggccaggggacaatggtcaccgtctcttcagcctccaccaagggcccatcggtcttccccctggcaccctcctccaagagcacctctgggggcacagcggccctgggctgcctggtcaaggactacttccgtactagacgctgagcgggctggcaaggcgcata

SEQ ID NO: 295707 - DNA, 332 bp, Homo sapiens
  misc_feature: NA.14.77.G11.1.454.heavy.1.nb
ggtggccaccatgcaaaaggatggaagtgacacatcctatgtgaactctgtgaagggccgattcaccatctccagagacaacgccaggaattcattgtatctgcaaatgaacaacctgagagccgaggacacgtctgtgtattactgtgtgagagatgttctccgttggggccagggaaccctggtcaccgtctcctcagcctccaccaagggcccatcggtcttccccctggcaccctcctccaagagcacctctggggcacagcggccctgggctgcctggtcaaggactacttccgtactagacgctgagcgggctggcaaggcgcata

SEQ ID NO: 295708 - DNA, 508 bp, Homo sapiens
  misc_feature: NA.14.78.H01.1.454.heavy.1.nb
gagaagagccccagccccagagttcccaggagtttccattcggtgatcagcactgaacacagaggactcaccatggagtttgggctgagctgggtcttccttgttgctattataaaaggtgtccagtgtcaagtgcagttggtggagtcgtgggggagcttggtcaagcctggagggtccctgagactctcctgtgcagcctctggattcaccttcagtgactactacatgacctggatccgccaggcgccaggggaaggggctggaatggattgcatacattcactatagtggaaatgcagtgtcctacgcagactctctgaaggccgattcaccgtctccagggacaacgccaagaactcgctgtatctgcaaatcgacggcctgagagtcgaggacacggccatgtattactgtgcgagagtgtggttcggtcatgttttagaagttggggcttttgacctactggggccagggaaccctggtcaccgtctcttcagcctccacc

SEQ ID NO: 295709 - DNA, 106 bp, Homo sapiens; identical to SEQ ID NO: 295690
  misc_feature: NA.14.78.H01.2.454.heavy.1.nb

SEQ ID NO: 295710 - DNA, 364 bp, Homo sapiens
  misc_feature: NA.14.85.H08.1.454.heavy.1.nb
agtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtcaatggtgcgtccctcactaatctctactggagctggatccgccacgcccccagggaaggggctggagtggattggggaaatcagtcaaagtggaggcaccaagtacaacccgtccctcgagagtcgagtcaccatatcaatagacacgttccagaatcagttctccctgagctgacttctgtgacagccgcggacacggctgtgtattac

SEQ ID NO: 295711 - DNA, 106 bp, Homo sapiens; identical to SEQ ID NO: 295690
  misc_feature: NA.14.86.H09.3.454.heavy.1.nb

SEQ ID NO: 295712 - DNA, 476 bp, Homo sapiens
  misc_feature: NA.15.1.A01.1.454.heavy.1.nb
ccaccaccacgcatgtgacctcaggggtccctgagactctcatgtgcaggctctggattcagcgtcaggaatagttacatgagttgggtccgccaggctccagggcaggggctagagtggctctcaatgatttacaccgatggggacggtgggaccacatactacgcagattccgtgaagggcagattcaccatctccagagacaatttggagaacaccgtgattcttaatatgaacagcctgagagccgatgacacggctgtgtatttctgtgcgagagacgggtataatagttactggtttggcgactggggccagggaaccctggtcatcgtctcgtcagcctccaccaagggcccatcggtcttccccctggaaccctcctccaagagcacctctgggggcacagcggccctgggctgcctggtcaaggactacttccgctacgtagactgagcgggctggcaaggcgcata

SEQ ID NO: 295713 - DNA, 161 bp, Homo sapiens
  misc_feature: NA.15.12.B01.1.454.heavy.1.nb
tatgcgccttgccagcccgctcagtctacgtagcggaagtagtccttgaccaggcagcccagggccgctgtgcccccagaggtgctcctggagcagggcgccagggggaagaccgatgggcccttggtggaagctgaggagacggtgaccagggctcccgg

SEQ ID NO: 295714 - DNA, 412 bp, Homo sapiens
  misc_feature: NA.15.16.B05.1.454.heavy.1.nb
gaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccagccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgacaaatgaacaacctgagagccgaggacacggctgtgtattac

SEQ ID NO: 295715 - DNA, 335 bp, Homo sapiens
  misc_feature: NA.15.20.B09.1.454.heavy.1.nb
ccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatgcagagaagttccagggcagagtcatcatcaccgcggacacatccacgagtacagccta

SEQ ID NO: 295716 - DNA, 225 bp, Homo sapiens
  misc_feature: NA.15.20.B09.2.454.heavy.1.nb
atatatctattacagtgggggcaccaactacaacccctccctcaagagtcgagtcatcatttcagtagacacgtccaagaaccagttctccctgaagatgagctctgtgaccgccgctgacacggccgtctagttattgtgcgagacatcggcacctaagttggttcgacccctggggccagggaacccggtcaccgtcgcctcagcctccaccaagggcccatc

SEQ ID NO: 295717 - DNA, 106 bp, Homo sapiens
  misc_feature: NA.15.25.C03.1.454.heavy.1.nb
tatgcgccttgccagcccgctcagtctacgtagcggaagtagtccttgaccaggcagcccagggccgctttgcccagcacctgaactcctgggggaccgtcagtct

SEQ ID NO: 295718 - DNA, 601 bp, Homo sapiens
  misc_feature: NA.15.28.C06.1.454.heavy.1.nb
gaggagccttagccctggactccaaggcctttccacttggtgatcagcactgagcacagaggactcaccatggaattggggctgagctgggttttccttgttgctattttagaaggtgtccagtgtgaggtgcaactggtggagtctgggggaggcctcgtccaggccgggggggtccctgagactctcctgtgaagcctctggattcaccttgagcacttattggatgacttgggtccgccaggctccagggaaggggctggagtgggtggccaccatacaaaaagatggaagtgacacaacctatgtgaactctgtgatgggccgattcaccgtctccagagacgacgccaagaactcactacatctgcaaatgaacaacctgagagccgaggacacggctgtgtattactgtgtgagagatgttctgcgttggggccagggaaccctggtcaccgtctcctcagcctccaccaagggcccatcggtcttccccctggccgccctgctccaggagcacctccgagagcacagcggccctgggctgcctggtcaaggactacttccgctacgtagactgagcgggctggcaaggcgcata

SEQ ID NO: 295719 - DNA, 239 bp, Homo sapiens
  misc_feature: NA.15.28.C06.3.454.heavy.1.nb
ggacgtttcaaaagtaaaaatgatggtgagaaaatagactacggtgcacccgtgaaaggaagattcaccatctcaagagataattcaaaaacgacggtgtatttgcaaatgaacagcctgaaaaccgaggacacagccgtctattactgtaccacagattcggaagtgcatcgacgtaaaggaggctatgcttttgatatctggggcccagggacaagtggtcgtcgtctcttcagcct

SEQ ID NO: 295720 - DNA, 323 bp, Homo sapiens
  misc_feature: NA.15.34.D01.3.454.heavy.1.nb
tggtccagcctggggggtccctgagactctcctgtgcagcctctggattcagttctagtaaatactggataagttgggtccgccaggctccagggaaggggctggagtggatggccaatatgaaccaagacggaagtgataaacatcatgtgggctctgtgcagggccgattcactatctccagagacaacgccaagaatctagtgtatttgcaaatgaacagcctgagagccgacgacacggctgtgtattactgtggcgggaggccggagtggtatttggattctttcgtggggccaggggccctggtccaccgtctcctc

SEQ ID NO: 295721 - DNA, 258 bp, Homo sapiens
  misc_feature: NA.15.38.D05.1.454.heavy.1.nb
ggaaggggctggagtgggtggccaacataaaccaagatggaagtgaagagtactatgtggactctgtgaagggccgcttcaccatttccagagacaacgccaagaactctctgtttctgcaaatgaacagtctgagagccgaggacacggctgtctattactgtgcgagaacccgtagagatgggtacaaaaggggaggggacttactttgactactggggccggggaaccctggtcaccgtctcctcagcctccacc

SEQ ID NO: 295722 - DNA, 347 bp, Homo sapiens
  misc_feature: NA.15.55.E11.1.454.heavy.1.nb
tggtacagcctggggggtccctgagactctcctgtgcagcctcaggattcgcctttcgcatctatgccatgacctgggtccgccaggctccagggaaggggctggagtggatctcagctattagtggaggtggtagtggtgaaaacacatattacgcaggctccgtgaagggccgcttcaccatctccagagacaattccaacaacacactttatcttcaaatgaacagcctgcgagccgaggacacggccgtatactactgtgcgagagatcgaacaggcccgtgggacgcccgttgactacgtggggccagggaacccgtggtcaccgtctcctcaacctccacc

SEQ ID NO: 295723 - DNA, 106 bp, Homo sapiens
  misc_feature: NA.15.55.E11.2.454.heavy.1.nb
tatgcgccttgccagcccgctcagtctacgtagcggaagtagtccttgaccaggcagcccagggccgctgtgcccagcacctgaactcctgggggaccgtcagtct

SEQ ID NO: 295724 - DNA, 86 bp, Homo sapiens
  misc_feature: NA.15.70.G04.1.454.heavy.1.nb
tatgcgccttgccagcccgctcagtctacgtagctcagatggcgggaagatgaagacagatggtgcagccacagttcgtttgattt

SEQ ID NO: 295725 - DNA, 373 bp, Homo sapiens
  misc_feature: NA.15.73.G07.1.454.heavy.1.nb
tccaccaccacgcatgtgacctcaggggtccctgagactctcctgtgcagcctctggattcgtctttagcagctatgccatgagctgggctcgccaggctccagggaagggctggagtgggtctctgctattcctggcagtggtgatatcgaatactacgcagactccgtgaagggccggttcactgtttccagagacaattccaagaacacactgtatctgcagatgaccagcctgagagccgaggacacggccgtatattactgtgcgaaacgccaagtattttggagtggttattatacctttgactcttgggccagggaaccctggtcaccgtctcctcagcctccaccaagggcccatccggtcttcc

SEQ ID NO: 295726 - DNA, 353 bp, Homo sapiens
  misc_feature: NA.15.77.G11.1.454.heavy.1.nb
gataggctatatccgcttcactgggagcaccaactacaacccctccctcaagagtcgactcaccatatctttagacacggccaacaaccagttctccctgaggctcagctctgtgaccgccgcagacacggccgtctattactgcgcgagacggagggtagacggtgaccggggctcgtttgactactggggccagggaatccgtggtcaccgtctcctcggcctccaccaagggcccatcggtcttccccctggcaccctcctccaagagcacctctgggggcacagcggccctgggctgcctggtcaggactacttccgctacgtagactgagcgggctggcaaggcgcat

SEQ ID NO: 295727 - DNA, 225 bp, Homo sapiens
  misc_feature: NA.15.8.A08.1.454.heavy.1.nb
ccaccaccacgcatgtgacctcaggggtccctgagactctcctgtgccgcctctggagcagagtctgaattcaccttcatgcactttgccatgagctgggtccgccaggctccggggaagggctggagtgcgtcgcatgtataactaaaagtggagacatcacactctacgcagactccgtgaagggccgcttcaccatctccagagacaatccaaagaacacgc

SEQ ID NO: 295728 - DNA, 456 bp, Homo sapiens
  misc_feature: NA.15.86.H09.1.454.heavy.1.nb
ggagaggagccccagccttgggatccccaagtgttttcattcagtgatcaggactgaacacagaggactcaccatggagttcgggctgagctgggttttccttgctgctatcttaaaaggtgtccagtgtgaagtgcaggtggtggagtctgggggagccttggtaaagccgtgggggtcccttagagtctcctgtgtggcctctggattcactttcagtaatggctggatgagttgggtccgccaggctccagggaaggggctggagtgggttggacgtttcaaaagtaaaatgatggtgagaaaatagactacggtgcacccgtgaaaggagattcaccatctcaagagataattacaaaaacgacggtagtatttgacaaatgaacagcctagaaaaccgaggacacagccgtctattactgtaccacagattcggaagtgcatcgacgtaaa

SEQ ID NO: 295729 - DNA, 525 bp, Homo sapiens
  misc_feature: NA.15.87.H10.1.454.heavy.1.nb
aggagccttagccctggactccaaggcctttccacttggtgatcagcactgagcacagaggactcaccatggaattgggactgagctgggttttccttgttgctattttagaaggtgtccagtgtgaggtgcagttggtggagtctgggggaggcttggtccaaccgtggggggtccctgagactctcctgtgcagcctctggattcatctttaatagtttttggatgacctgggtccgccagggtccagggaagggctggagtgggtggccaacataaagcaagatggaagtgagaaatactatgtggactctgtgaagggccgattcaccatctccagagacaacgccaagaacttactgtatctgcaaatgaacagcctgagaggcgaggacacggctctgtattactgtgcgaggatacctcctctgggccgggccacggtttccacggcatggacgtcgtggggccgaagggaccgacggtcaccgtctcctcacgcctccaccaagggccccatcggtc

SEQ ID NO: 295730 - DNA, 513 bp, Homo sapiens
  misc_feature: NA.16.1.A01.1.454.heavy.1.nb
ggggaagaggaagactgacggtccccccaggagttcaggagtcgggcccaggactggtgaggccttcagagaccctctccctcacctgcgcggtctctggtgactccatgaacagtggtggtacctactggagctggatccgccagcagccagggaaggcctggagtggattgggtacatctattacactgggagcacctactacaacccgtccctgaagagtcgagctaccatattagttgacccgtctaggaaccaattctccctgaagatgacctttgtgactgccgcggacacggccgtctactactgtgcgaggaggtggagtcggagggtcttttgatttctggggccaagggacagtggtcaccgtctcttcagcctccaccaagggcccatcggtcttcccctggcaccctcctccaagagcacctctgggggcacagcggccctgggctgcctggtcaaggactacttccgagtagtacactgagcgggctggcaaggcgcata

SEQ ID NO: 295731 - DNA, 391 bp, Homo sapiens
  misc_feature: NA.16.10.A10.2.454.heavy.1.nb
ccaccaccacgcatgtgacctcaggggtccctgagactctcctgtgcagcctctggattcacccttagcggttatgccatgagctgggtccgccaggctccagggaaggggctggagtgggtctcaacttttagtggtagtggtggtcacgcctactacgcagagtccgtgaagggccgattcaccatctccagagacacttccgagaacacgctgtatctgcgaatgaacagcctgagagtcgaggacacggccatatattactgtgcgaaagatcctgaggcctataccactcagtcagctggttcgacccctgggccagggaaccctggtcaccgtctcctcacgcctccaccaacgggcccatccggtcttccccctcggccaccct

SEQ ID NO: 295732 - DNA, 450 bp, Homo sapiens
  misc_feature: NA.16.12.B01.2.454.heavy.1.nb
ggggtccctgagactctcctgtgcaacctctggattcacctttaccagctatgccatgagctgggtccgccaggctccagggaaggggctggagtgggtcgcagccattagtggtattcgtgatgccacatactacgcagactccgtgaggggccggttcaccatctccagcgacacttccaggagcacgttgtatctgcaaatgaacagcctgagagtcgaggacacggccctatattactgtgcgaaagataagatttggggacccgatgcttatgatagctggggccaagggacaatggtcaccgtctcttcagcctccaccaagggcccatcggtcttccccctggcaccctcctccaagagcacctctgggggcacagcggccctgggctgcctggtcaaggactacttccgagtagtacactgagcgggctggcaaggcgcata

SEQ ID NO: 295733 - DNA, 288 bp, Homo sapiens
  misc_feature: NA.16.15.B04.1.454.heavy.1.nb
  modified_base (241)..(241): a, c, t, g, unknown or other
  misc_feature (241)..(241): n is a, c, g, or t
aggagcccagccctgggattttcaggtgttttcatttggtgatcagggctgaacagagagaactcaccatggagtttgggctgagctggtctttttcttgtggctattttaaaaggtgtccagtgtgaggtgcagctgttggagtcgtgggggaggcttggtacagccgtggggggtccctgagactctcctgtgcagcctctggattcatctttagcagctatgtcatgacctgggtccncaggctcagggagggctggagtgggtctcgagttagttggtggtagt

SEQ ID NO: 295734 - DNA, 298 bp, Homo sapiens
  misc_feature: NA.16.2.A02.2.454.heavy.1.nb
gccctggattccaaggcctatccacttggtgatcagcactgaccaccgaggattcaccatggagctggggctccgctgggttttccttgttgctattttagaaggtgtccagagtgaggtgcagctggtggagtttgggggaggcctggtcaagccgtggggggtccctgagactctcctgtgcagcctctgaattcatcttcagtatctataacatgaactgggtccgccagactccagggaagggctggagtgggtcgcatccattagtggtggtaataattacatatactacgga

SEQ ID NO: 295735 - DNA, 355 bp, Homo sapiens
  misc_feature: NA.16.21.B10.1.454.heavy.1.nb
ggtctcaggtattactggtggtggttataccacatactacgcagactccgtgaagggccggttcaccatctccagagacaattccaagaacacactgtatctgcaaatgaacagcctgagagccgacgacacggccatatattactgtgcgaaagcaccggcagttagtcacccatactactttgactactgggccagggaaccctggtcaccgtctcctcagcctccaccaagggcccatcggtcttccccctggcaccctcctccagagcacctctgggggcacagcggccctgggctgcctggtcaaggactacttccgagtagtacactgagcgggctggcaaggcgcata

SEQ ID NO: 295736 - DNA, 315 bp, Homo sapiens
  misc_feature: NA.16.24.C02.1.454.heavy.1.nb
ggtctcaagtattagtggtgttggtggtctcacatattacgcagactccgtgaagggccggttcaccgtctccagagacaattccaagaatacactgtatctgcgaatgaatggcctgagagccgaagacacggccgtctactactgtgcgaaagaagggcgtgggagttacttatatggtgatatgtggggccaagggacaatggtcaccgtctcttcagcctccaccaaggccccatcggtcttccccctggccgccctgctccaggacgccacctccgagagcacacgccggccctgggctgccctggtcaa

SEQ ID NO: 295737 - DNA, 505 bp, Homo sapiens
  misc_feature: NA.16.28.C06.1.454.heavy.1.nb
cttttcttgtggctattttaaaaggtgtccagtgtgaggtgcaactgttggagtctgggggagccttggtacagccggggggtccctgagactctcctgtgcagcctctggattcccctttaccacatatgccatgggctgggtccgccaggctccagggaaggggctggagtgggtctcacttattagtggtagtggtagtactacatactacgcagactccgtgaagggccggttcaccatctccagagacaatcccaagaacacgctgtatctgcaaatgaacggcctgagagccgaggacacggccgtatattactgtgcccgagggaggttttacatgatattactggttaacaaaaagggtactactttgactactggggccagggaaccctggtcaccgtctcctcagcctccaccaagggcccatccggtcttccccctggccgccctgctccaggagcacctccgagaacacagcggccctgggctgcctggtcaa

SEQ ID NO: 295738 - DNA, 339 bp, Homo sapiens
  misc_feature: NA.16.33.C11.1.454.heavy.1.nb
tcaccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggagtggggagattgatcccagtgactctcacatcaactacagcccgtcttccaaggccacgtcaccatctcagctgacaagtccatcagtact

SEQ ID NO: 295739 - DNA, 106 bp, Homo sapiens
  misc_feature: NA.16.33.C11.3.454.heavy.1.nb
tatgcgccttgccagcccgctcagtgtactactcggaagtagtccttgaccaggcagcccagggccgctgtgcccagcacctgaactcctgggggaccgtcagtct

SEQ ID NO: 295740 - DNA, 106 bp, Homo sapiens; identical to SEQ ID NO: 295739
  misc_feature: NA.16.34.D01.1.454.heavy.1.nb

SEQ ID NO: 295741 - DNA, 351 bp, Homo sapiens
  misc_feature: NA.16.35.D02.1.454.heavy.1.nb
ccacccagctgggatctcagggcttccttttctgtcctcctccaggatggggtcaaccgccatcctcaccctcctcctggctgttctccaaggagtctgtgccgaagtgcagctggtgcagtccggagcagaggtgaaaaagcccggggagtctctgaggatctcctgtaagggttctggatacaggttttccagctactggatcacctgggtgcgccagaagcccggtaaaggcctggagtggatgggggaggattgatcccagtgactctcacatcaactacagcccgtccttccaaggccacgtcaccatctcagctgacaagtccatcagtactgccttctgcagtg

SEQ ID NO: 295742 - DNA, 406 bp, Homo sapiens
  misc_feature: NA.16.37.D04.1.454.heavy.1.nb
agtacagccggggggtccctgagactctcctgtgcagcctctggattcacctttagtgcctatgccatgagctgggtccgccaggctccagggaaggggctagaatgggtctcaagtatcacaagcagtagtagtaccgcatggtacgcagactccgtgaagggccgtttcaccatctccagagacaattccaagaacacgctgtatttgcaaatgaacagtctgagagtcgaggacacggccatatattactgtgcgaagcgggaattggtggcggtgactgctattgactactggggccagggaaccctggtcaccgtctcctcagcctccaccaacgggcccatcggtccttccccctggccacccctcctccaacgacgccacctcgtcgggggccacgacg

SEQ ID NO: 295743 - DNA, 262 bp, Homo sapiens
  misc_feature: NA.16.37.D04.2.454.heavy.1.nb
  modified_base (223)..(223): a, c, t, g, unknown or other
  misc_feature (223)..(223): n is a, c, g, or t
tcttcagcggtttcgctatgcactgggtccgccaggctccaggaaagggactggaatatgtttcagctattagttataatgggggtaacacatactacgcagactcagtgaagggcagattcaccatctccagagacaattcccagaacacgctggatcttcaaatgagcagtctgagagctgaggacacggctgtgtattactgtgtagaaagtatttccgnggctactacgactactactacggtatggacgtcgtgggg

SEQ ID NO: 295744 - DNA, 415 bp, Homo sapiens
  misc_feature: NA.16.38.D05.2.454.heavy.1.nb
cgagcccagcactggaagtcgccggtgtttccattcggtgatcagcactgaatacagaggactcaccatggagtttgggctgagctgggttttcctcgttactcttttaagaggtgtccaatgtcaggtgcagttggtggagtctgggggaggcgtggtccagcctggaaggtccctgagactctcgtgtgcagcgtctggattcatctttaatagttttcctatgcactggatccgccaggctccaggcaggggactggagtgggtggcagggagtgtcacttgatggagccaatacatacttcgcagactccgtgaagggccgattcaccatttccagagagaattccaacaacacgctgcatctgcaaatggacaccctgagacctgacgacacggctgtctattactgtgt

SEQ ID NO: 295745 - DNA, 106 bp, Homo sapiens; identical to SEQ ID NO: 295739
  misc_feature: NA.16.38.D05.3.454.heavy.1.nb

SEQ ID NO: 295746 - DNA, 433 bp, Homo sapiens
  misc_feature: NA.16.39.D06.1.454.heavy.1.nb
gagaggagcccagcactgggattccgaggtgtttccattcggtgatcagcactgaacacagaggactcaccatggagttttggctgagttgggttttccttgctgctattttaaaaggtgtccagtgtgaggtgtacttggtggagtctggaggaggcttgacccaggccgggggggtccctgagactctcctgtgcagcctctgggttcagcgtcagtaacaaccacgtgatgtgggtccgccagcctccgaggggaaggggctggaatgggtctcagttattagaaaatgatggtgacacaatctacgccgactccgtgaagggccgattcaccatctccagagacaattccaagaacacggtagaatcttacaaatgaacagcctgagaaccgaggacacggccgtatattattgtataggttatggtgt

SEQ ID NO: 295747 - DNA, 284 bp, Homo sapiens
  misc_feature: NA.16.5.A05.1.454.heavy.1.nb
gcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtgggggagcgtggtccatccgtgggaatccctgacactctcctgcgtagcctctgggttcgtcttcaggaattatggcatgcactgggtccgccaggctccaggcaaggggctgggagtggggtggcggttattcatatgat

SEQ ID NO: 295748 - DNA, 415 bp, Homo sapiens
  misc_feature: NA.16.53.E09.1.454.heavy.1.nb
gcagatgtaggtctgggtgcgccagatgcccgggaaaggcctggagtggatggggaggattgaggctagtgactcttataccaactacagcccgtccttccaaggccacgtcaccatctcagttgacaagtccatcaacactgcccacctgcagtggagcagcctgaaggcctcggacaccgccatgtattactgtgcgagacatggggatttatattgtactaataatgtatgccactttgactactggggccagggaaccctggtcaccgtctcctcagcctccaccaagggcccatcggtcttccccctggccaccctcctccaagacgcacctctggggcacagcggccctgggctgcctggtcaaggactacttccgagtagtacactgagcgggctggcaaggcgcata

SEQ ID NO: 295749 - DNA, 303 bp, Homo sapiens
  misc_feature: NA.16.59.F04.2.454.heavy.1.nb
tcccagtgactctcacatcaactacagcccgtccttccaaggccacgtcaccatctcagctgacaagtccatcagtactgccttcctgcagtggcgcagcctggaggcctcggacaccgccatatattactgtgcgagtccggttatcgccgcagatcactactactactacggtctggacgtcgtggggccaagggaccacggtcaccgtctcctcaccctccaccaagggcccatccggtccttccccctggccaccctcctccaacgacgccacctcgtcgggggcacgacggccggccc

SEQ ID NO: 295750 - DNA, 328 bp, Homo sapiens
  misc_feature: NA.16.67.G01.1.454.heavy.1.nb
gagaggagcccagccctgggatttccaggtgttttcatttggggatcaggactgaacagagagaactcaccatggagttagggctgagctggcttttctgtggctattttaaaaggtgtccagtgtgaggtgcagctgttggagtctgggggaggcttggtacagccgtggggggtccctgagactctcctgtgcgacctctggattcacctttagcagctatgccatgagctgggtccgccaggctccgagggaaggggctgggagtgggtctcaactattagtggtagtggtggtaccacatacttcgctgactccgtgaagggcc

SEQ ID NO: 295751 - DNA, 403 bp, Homo sapiens
  misc_feature: NA.16.68.G02.1.454.heavy.1.nb
gcttcaccagtcctggacctcctgtgcaagaacatgaaacatctgtggttcttccttctcctggtggcagctcccagatgggtcctgtcccaggagcaactgcaggagtcgggcccaggactggtgaagccttcggagaccctgtccctcacctgcactgtctctggtggctccttcagcagttactactggagctggatccgtcagctcccagggaagggactggagtggattgcctatatctcttacagtgggagcagcaactacaacccctccctcaagagtcgagtcgacatattagtagacacgtccaagaaccagttttccctgaggctgaggtctgtgaccgctgcggacacggtccctttattactgtgcgcgacgggcccctatcgagtgacta

SEQ ID NO: 295752 - DNA, 333 bp, Homo sapiens
  misc_feature: NA.16.70.G04.1.454.heavy.1.nb
tcgggaatatctattatagtgggagcacctactacaacccgtccctcaagagtcgagtcgccatatccgtagacacgtccaagaaccacttctccctgaaactgagctctgtgaccgccgcagacacggctgtctattactgtgcgagacagagttacgacggtggttactccggtctcttgacacgtgggccagggaccctggtcaccgtctcctcagcctccaccaagggcccatcggtcttccccctggcaccctcctccaacgagcacctcgtggggcacagcggccctgggctgcctggtcaaggactacttccgagtagtacactga

SEQ ID NO: 295753 - DNA, 460 bp, Homo sapiens
  misc_feature: NA.16.71.G05.1.454.heavy.1.nb
gagaggagcccagccctgggattttcaggtgttttcatttggtgatcaggactgaacagagagaactcaccatggagtctgggctgagcgggctttttcttgtggctattttaaaaggtgtccagtgtgaggtgcagctgttggagtcgtgggggaggcttggcacagccgtggggggtccctgagactctcctgtgcagcctctggattcacctttgacagctatgccatgacctgggtccgccaggctccagggaaggggctggaatgggtctcaggtattactggtggtggttataccacatactacgcagactccgtgaagggccgttcaccatctccagagacaattccaagaacacactgtatctgacaaatgaacagcctgagagccgacgacacggccatatattactgtgcgaaagcaccggcagttagtcacccatactactttgactac

SEQ ID NO: 295754 - DNA, 362 bp, Homo sapiens
  misc_feature: NA.16.73.G07.1.454.heavy.1.nb
ggagggtgtccttgagtcgtgggggaggcgtggtccagccgtgggggtcgctgagactctcctgtgcagcctctggattcaccttcagtacctatgccatacactgggtccgccagcctccaggcaaggggctggagtgggtgctcttatatcatctgatggagtactgaatactacgcagactccgtgaagggccgattcaccatctccagagacaattcccagaacacactgtatctgcaaatgaacagcctgagaactgaggacacggctctatattactgtgcgaggagggggccggtgggagctcctccgacggggccagtgactccgtggggccagggactcccgtggtccaccgt

SEQ ID NO: 295755 - DNA, 615 bp, Homo sapiens
  misc_feature: NA.16.78.H01.1.454.heavy.1.nb
agccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttgagaacttatagcatgaactgggtccgccaggctccagggaagggctggagtgggtctcatccattagtagtagtagtagttacatatattacgcagactcagtgaagggccgattcaccatctccagagacaacgcccagaactcactatatctgcaaatgaacagcctgagagccgacgacacggctgtgtattactgtgcgggagccgtaacttcgggggactacctcgacccctggggccagggaatactggtcaccgtctcctcagcctccaccaagggcccatcggtcttccccctggccaccctcctccaagagcacctctgggggcacagcggccctgggctgcctggtcaaggactacttccgagtagtacactgagcgggctggcaaggcgcata

SEQ ID NO: 295756 - DNA, 336 bp, Homo sapiens
  misc_feature: NA.16.80.H03.1.454.heavy.1.nb
agaggagccccaggcccgggattcccaggtgtttccattcagtgatcagcactgaagacaggagactcatcatggagttctggctgagctgggttctccttgttgcctattttaaaagatgtccagtgtgaggtgcagctggtggagtcgtgggggaggcttggtccgaggccgggggggtccctggagactctcctgttcagcctctggattcatcttcagcggtttcgctatgcactgggtccgccaggcctccgaggaagggactggaatatgttcagctattagttataatgggggtaacacatactacgcagactcagtgaaggcagattc

SEQ ID NO: 295757 - DNA, 81 bp, Homo sapiens
  misc_feature: NA.16.86.H09.1.454.heavy.1.nb
ctcaggaggcagcgctctcaggacatctccaccatggcctgggctctgctgctcctcaccctcctcactcagggcacaggg

SEQ ID NO: 295758 - DNA, 353 bp, Homo sapiens
  misc_feature: NA.16.87.H10.1.454.heavy.1.nb
ctgggattcccagctgtttctgcttgctgatcaggactgcacacagagaactcaccatggagtttgggctgatctgggtcttccttgttgcttttttaaaaggtgtccagtgtgaggagcagctggtggagtccgggggaggcttagttcagcctgggaagtccctgagactctcctgtgcagcctctggattcaccttcagcaattactggctgcactgggtccgccaagctccagggagggctggtgtgggtctcacatattaatctcgatgggagtaatttagcctacgcggactccgtcaagggccgattcaccgtctccagagacaacaccaagaacacactatatct

SEQ ID NO: 295759 - DNA, 355 bp, Homo sapiens
  misc_feature: NA.16.9.A09.1.454.heavy.1.nb
agccctgggattttcaggtgttttcatttggtgatcaggactgaacagagagaactcaccatggagtttgggctgagctggctttttcttgtggctattttaaaaggtgtccagtgtgaggtgcagttggtggactctgggggagacctgataccgcctggggggtccctgagactctcctgtacagcctctggattcacctttaggagccatgccatgagctgggtccgccaggctccgagggaaggggctggagtgggtctctactattactgctagtggtaatcatgcatactatgcagactccgtgaacgggccgttcaccttcaccagagacaattaccaagaacacgct

SEQ ID NO: 295760 - DNA, 185 bp, Homo sapiens
  misc_feature: NA.17.10.A10.1.454.heavy.1.nb
aagatatatccactggccttgcaggagacagtcactgatgccccaggcttctgcacctcagccccacgtctgcaccaactgaacctgggcgtgggcacctgtgcctgctgccaccaggaaaaggatgctccaggtccagtccatggtgaggagctgtgatctaggggattctcccaaggaggggt

SEQ ID NO: 295761 - DNA, 229 bp, Homo sapiens
  misc_feature: NA.17.10.A10.2.454.heavy.1.nb
cacaaaatatggtatgaattgggtgcgacaggcccccggacaagggcttggagtgggtggggtgggtcaggcggctttggacggtaaggcacagtatgcaccgaagatgaagggcagagtcacgattaccacggacacccccagaacacagtctacatgcaactgacgagcctgagagctgacgacacggccgtctattactgtgcgagaatgttttctgtcatcgtac

SEQ ID NO: 295762 - DNA, 247 bp, Homo sapiens
  misc_feature: NA.17.12.B01.2.454.heavy.1.nb
accacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggat

SEQ ID NO: 295763 - DNA, 423 bp, Homo sapiens
  misc_feature: NA.17.25.C03.1.454.heavy.1.nb
acaaccacatctgtcctctagagaaaaccctgtgagcacagctcctcaccatggactggacctggaggatcctcttcttggtggcagcagctacaagtgcccactcccaggtgcagctggtgcagtctggggctgaggtgaagaagcctggggcctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatgaccacgaactcctccataaacacagcctacatggagttgaggagcctgacatctgacgacacggccgtctattactgtgcgagagtcccacgatccggtgagccta

SEQ ID NO: 295764 - DNA, 247 bp, Homo sapiens
  misc_feature: NA.17.25.C03.3.454.heavy.1.nb
aggtgtccagtcccaggtccagttggtgcaatctggggctgaggtgaagacgcctgggtcctcggtgagggtctcctgcaaggcttctggaggcaccttcagcgactatagtttcaattgggtgcgacgggcctctggacaaggccttgagtggatgggaaggatcgtccctatcgttgacacaccaaactacgcacagaagttccagggcagactcaccataaccgcgacaaattaacgaacacag

SEQ ID NO: 295765 - DNA, 155 bp, Homo sapiens
  misc_feature: NA.17.25.C03.4.454.heavy.1.nb
tatgcgccttgccagcccgctcagcgtagactagggaagtagtccttgaccaggcagcccagggccgctgtgcccccagaggtgctcttggaggagggtgccagggggaagaccgatgggcccttggtggaggctgaggagacggtgaccagggt

SEQ ID NO: 295766 - DNA, 424 bp, Homo sapiens
  misc_feature: NA.17.28.C06.1.454.heavy.1.nb
agagaggaggcttagccctggactccaaggcctttccacttggtgatcagcactgagcacagaggactcaccatggagttggggctgaactgggttttccttgttgctgttttagaaggtgtccagtgtgaggtccagttggttgagtccgggggaggcctggtccagccgtggggggtccctgagactctcctgtgcagcctccggattccccttcagtagttattggatgacttgggtccgcagactccgagggaagggctggagtgggtggccaacataaagcaagatggaactgccgtagttttacgtggactctgtgaagggccgtttcaccatctccagagacaacgccaagaattcactgtatctacaactgaacagcctgagagtcgcagacacggccgtgtattactgtgcgaga

SEQ ID NO: 295767 - DNA, 88 bp, Homo sapiens
  misc_feature: NA.17.29.C07.1.454.heavy.1.nb
ctcaggaggcagcgctctcaggacatctccaccatggcctgggctctgctgctcctcaccctcctcactcagggcacagggtcctggg

SEQ ID NO: 295768 - DNA, 273 bp, Homo sapiens
  misc_feature: NA.17.33.C11.2.454.heavy.1.nb
tgccccaccatggacacactttgctccacgctcctgctgctgaccatcccttcatgggtcttgtcccagatcaccttgaaggagtctggtcctacgctggtgaaacccacacagaccctcacgctgacctgcaccttctctggcttctcactcagaacgagtggaatgggagtgggctggatccgtcagcccccaggaaacggccctggagtggcttgcgctcatttattgggatgagagtaagcactacagtccgtctctgaagaacaggct

SEQ ID NO: 295769 - DNA, 265 bp, Homo sapiens
  misc_feature: NA.17.34.D01.2.454.heavy.1.nb
tcctcggtgagggtctcctgcaaggcttctggaggcaccttcagcgactatagtttcaattgggtgcgacgggcctctggacaaggccttgagtggatgggaagatcgtccctatcgttgacacaccaaactacgcacagaagttccagggcagactcaccataaccgcggaacaaattaacgaacacagttaatctaggagctagaacagcctgtcatctgaggacacgggcttctacttctgtgcgaggagtaattactatac

SEQ ID NO: 295770 - DNA, 182 bp, Homo sapiens
  misc_feature: NA.17.34.D01.3.454.heavy.1.nb
cctcagtgaaggtctcctgcaaggcttctggattcacgtttacctcctatagtatcaactgggtgcgccaggccgctggacaacgacctgagtggatgggatgggcgaaccctaacactggtgtcacagtgtcttcacccatcctccgggacagacttaccatcgaccacgaacctcctacc

SEQ ID NO: 295771 - DNA, 367 bp, Homo sapiens
  misc_feature: NA.17.37.D04.1.454.heavy.1.nb
cttgtccaccctggtgtgggtctcacgtattgatactgatggcattaccacatcctacgcggactccgtgcagggccgattcaccatctccagagacaacgccaagaacacgctgtatctgcaaatgaacagtctgagagccgaggacacggctgtgtactactgtgcaagagtttcccccggagctcgcccggtaacttctggggccagggaacccaggtcaccgtctcctcagcctccaccaagggcccatcggtcttccccctggcaccctcctccaagagcacctctgggggcacagcggccctgggctgcctggtcaaggactacttccctagtctacgctgagcgggctggcaaggcgcat

SEQ ID NO: 295772 - DNA, 195 bp, Homo sapiens
  misc_feature: NA.17.80.H03.1.454.heavy.1.nb
tatgcgccttgccagcccgctcagcgtagactagggaagtagtccttgaccaggcagcccagggccgctgtgcccccagaggtgctcttggaggagggtgccagggggaagaccgatgggcccttggtggaggctgaggagacggtgaccagggttccctggccccagtggtcgaaccccacggcggtagcagct

SEQ ID NO: 295773 - DNA, 106 bp, Homo sapiens
  misc_feature: NA.17.86.H09.2.454.heavy.1.nb
tatgcgccttgccagcccgctcagcgtagactagggaagtagtccttgaccaggcagcccagggccgctgtgcccagcacctgaactcctgggggaccgtcagtct

SEQ ID NO: 295774 - DNA, 286 bp, Homo sapiens
  misc_feature: NA.18.1.A01.1.454.heavy.1.nb
gagtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggtaattttgactggttattcctactactttgactactggggccagggcactccggtcaccgtctcctcagcctccaccaagggcccatcggtcttccccctggcaccctcctccaagacgcacctc

SEQ ID NO: 295775 - DNA, 45 bp, Homo sapiens
  misc_feature: NA.18.11.A11.2.454.heavy.1.nb
accagagtatccagagcaacagacgaaatgaaagacctacgggtc

SEQ ID NO: 295776 - DNA, 153 bp, Homo sapiens
  misc_feature: NA.18.13.B02.1.454.heavy.1.nb
ctctcctgtgcagcctctggattcaccttcagtaactactacatggcctggatccgccaggctccagggaaggggctggagtacgtctcatacatcagtaacactggaaataccatatactacgcagactctgtgaggggccgattcaccatc

SEQ ID NO: 295777 - DNA, 402 bp, Homo sapiens
  misc_feature: NA.18.14.B03.1.454.heavy.1.nb
tccttgttgctattttaaaaggtgtccagtgtgaggtgcagctggtggagtccgggggaggcttggtccagcctgggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccgtctccagaaatgattcaaagaacacggcgtatctgcaaatgaacagcctagaaaaccgaggacacggccgtgtattactgtactagacaggtggattacatttggggagttagtcgacgaaacgggggggtactacgtacgctatggacgtcgtggg

SEQ ID NO: 295778 - DNA, 422 bp, Homo sapiens
  misc_feature: NA.18.16.B05.1.454.heavy.1.nb
cagcactggaagtcgccggtgtttccattcggtgatcagcactgaacacagaggactcaccatggagtttgggctgacctgggttttcctcgttgctcttttaagaggtatccagtgtcaggttcaactggtggagtccggggagcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactccgtgaagggccgattcaccatctccagggacaattccaggaacacgctgtctctacaaatgacagcctgagaactgacgacacgctgtctattatgtgcgagagactactgggttactg

SEQ ID NO: 295779 - DNA, 330 bp, Homo sapiens
  misc_feature: NA.18.19.B08.1.454.heavy.1.nb
accagcgtaggaccagactccttcatgggtcttgtcccagatcaccttgaaggagtctggtcctacgctggtgaaacccacacagaccctcacgctgacctgcaccttctctgggttctcactcagcactagtggagtgggtgtgggctggatccgtcagcccccaggaaaggccctggagtggcttgcactcatttattggagtgataataagcgctacagcccatctctgaagagcaggctcaccatcaccaaggacacctaccaaaaaccaggtggtaccttacaatgaccaacatggaccctgtagacacaggcacatattactgt

SEQ ID NO: 295780 - DNA, 85 bp, Homo sapiens
  misc_feature: NA.18.20.B09.1.454.heavy.1.nb
tatgcgccttgccagcccgctcagtacgagtatgtcagatggcgggaagatgaagacagatggtgcagccacagttcgtttgatt

SEQ ID NO: 295781 - DNA, 345 bp, Homo sapiens
  misc_feature: NA.18.26.C04.1.454.heavy.1.nb
agactctcctgtgcagcctctggattcaccttcagtaactactacatggcctggatccgccaggctccagggaaggggctggagtacgtctcatacatcagtaacactaggaaataccatatactacgcagactctgtgaggggccattcaccatcgccagggacaacgccaagagctcacattatctgcagatgactgccctgagagccgaggactcggccgtttactactgtgcgagagatcccggcgatgctggcaccggctggtactactttgattccgtggggccagggaaccctggtcaccgtctcctcagcctccaccaagggcccatcggtcttccc

SEQ ID NO: 295782 - DNA, 339 bp, Homo sapiens
  misc_feature: NA.18.31.C09.1.454.heavy.1.nb
gtggatttcatacattagtagtgctggcaataccatcctctacgcagactctgtgaagggccggttcagcgtctccagggacaacgccaataactttctgtttctgcaaatgaacagcctgagagccgaggactcggccacatattactgtgcgagaggaattttgactggttattcctactactttgactactggggccagggcactccggtcaccgtctcctcacgcctccaccaagggcccatcggtcttccccctggcaccctcctccaagagcacctctgggggcacagcggccctgggctgcctggtcaaggctacttcccatactcgtactg

SEQ ID NO: 295783 - DNA, 369 bp, Homo sapiens
  misc_feature: NA.18.33.C11.1.454.heavy.1.nb
gagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccgagggaagggcctggagtggatctcacttattatagtggtggtaccacatactacacagactccgtgaacgggccgattcaccatctcagaagacaattccaggaacacattgtatcttcaaatgaa

SEQ ID NO: 295784 - DNA, 242 bp, Homo sapiens
  misc_feature: NA.18.33.C11.2.454.heavy.1.nb
tgcagatgtaggtctgggtgcccaagctgctgaagggccgattcaccatctcagaagacaattccaggaacacattgtatcttcaaatgaataacctgagagccgaggacacggccatgtattactgtgtggggcatttacttgacccctggggccggggaaccctggtcaccgtctccccaccctccaccaaggcccatccggtcttccccctggccaccctcctccaagagcacctctgg

SEQ ID NO: 295785 - DNA, 505 bp, Homo sapiens
  misc_feature: NA.18.36.D03.1.454.heavy.1.nb
gaggagcccagccctgagattttcaggtgttttcacttggtgatcaggactggacagagagaactcaccatggagtttgggctgagctggctctttcttgtggcgtattttaaaaggtgtcaagtgtgaggtgcagctgttggagtcgtgggggagccttggtacagcctggggggtccctgagactctcctgtacagtctctggattcaccgtctccacttttgccatggcctgggtccgccgggctccgagggaagggcctggagtgggtctccactatcagtgacactggtaatggcgatagcaagtggtacgcaggctccgtggaggggcggttcaccattagcagagacaattccaagaacacggtctatctacaaatgaacagcctgagagccgaggacacggccctgtatttctgtgtgagagatcgaaaattccctttcgatgttcttgatatgtgggccaagggacaatggtcaccgtctcctcagcctccaccaa

SEQ ID NO: 295786 - DNA, 256 bp, Homo sapiens
  misc_feature: NA.18.36.D03.2.454.heavy.1.nb
  modified_base (217)..(217): a, c, t, g, unknown or other
  misc_feature (217)..(217): n is a, c, g, or t
ccctgcattcatctttaatagttattggatgcactgggtccgccaggctccgggggaaggggccggagtgggtggccaacataatgcaagatggaactgagaagaactatgtggactctgtgaagggccgattcaccatctccagagacaacactaagaacttactgtatctgacaaatgaacagcctcagagccgaggacacggctgtgtattacngtgcgaagagcagtggctgggacagtggacgtcgtgggg

SEQ ID NO: 295787 - DNA, 324 bp, Homo sapiens
  misc_feature: NA.18.39.D06.3.454.heavy.1.nb
tgaagaaccctggggcctcagtgaaggtctcctgtcagacctatggattccccttccagaattttgatatccattgggtgcgacaggccagtggacaagggctcgagtggatgggatggatgaacggtaaaactgccaacacaggctatgcagaggcattccagggcagagtcaccatgaccgggaacccctccaccggcacagcctacatggagctgagcagtctgacacctgacgacacggccgtctattactgtgcgagagccgcgaatatgtggtgcaaagtggtcgttgtttgttttggccggtgaactactggggcca

SEQ ID NO: 295788 - DNA, 214 bp, Homo sapiens
  misc_feature: NA.18.53.E09.2.454.heavy.1.nb
ccgtgggcatgtgtgagttgtgtcaccaagtggggttttgagctcaactctcttctgcttgctggctgtagctccaggtgctcactcccaggtgcggctggtgcagtctggggctgaggtgaagaagcctggggcctcagtgaagctttcctgcaaggcatctggatacaccttcaccagctactatatgcactgtgtgcgacacggcccctgg

SEQ ID NO: 295789 - DNA, 126 bp, Homo sapiens
  misc_feature: NA.18.59.F04.3.454.heavy.1.nb
gccttgccagcccgctcagtacgaggtatggaggagggtgggaacgagagtggacagtggggttgggccttgggctgacctagacggtgaccttggtcccagttccgaagacatagagagtgctgg

SEQ ID NO: 295790 - DNA, 357 bp, Homo sapiens
  misc_feature: NA.18.59.F04.6.454.heavy.1.nb
gagaggagccccagccttgggattcccaagtgttttcattcagtgatcaggactgaacacagaggactcaccatggagtttgggctgagctggattttccttgctgctattttaaaaggtgtccagtgtgaggtgcagctggtggagtcgtgggggaggcttgggtaaagccgggggggtcccttaggactcccctgtacagcctctggattcactttcagtaaggcctggatgaactgggtccgccaggctccgagggaaggggctggagtgggttggccgtattaaaaccaaactgatggtgggacaacagactacgctgcacccgtgaaaggcagattcaccatctcaagagat

SEQ ID NO: 295791 - DNA, 345 bp, Homo sapiens
  misc_feature: NA.18.60.F05.1.454.heavy.1.nb
ttgggattacctcttacagtgggaccacccattacaacccgtccctcaaaagtcgactcaccatttccgtggacacgtcgaaaaacgagttctccctggacttgacctctgtgaccgccgcagacacggctgtttattactgtgcgagacgactacctgactccaatccatactttgactattggggccgggagccctggtcaccgtctcctcagcctccaccaagggcccatcggtcttccccctggcgccctgctccaggagcacctccgagagcacagcggccctgggctgcctggtcaaggactacttcccatactcgtactgagcgggctggcaaggcgc

SEQ ID NO: 295792 - DNA, 362 bp, Homo sapiens
  misc_feature: NA.18.63.F08.1.454.heavy.1.nb
ccatggacacactttgctacacactcctgctgctgaccaccccttcctgggtcttgtcccaggtcaccttgaaggagtctggtcctgtgctggtgaaacccacagagaccctcacgctgacctgctccgtctctgggttctcactcagcagtactagaatgggtgtgagctggctccgccacggcccccggggaaggccctggagtggcttgcacactatttttcgattgaacgaaaaatcctaacaacacatctctgaagaccagagtcaccatctccaaggacacctaccaaaagccaggtggtccttaccatgatcaacctggaccctgcgacacagccacatatttctgtgctacggg

SEQ ID NO: 295793 - DNA, 373 bp, Homo sapiens
  misc_feature: NA.18.70.G04.1.454.heavy.1.nb
ccacatccctcctgagaagccccagagcacaactccttaccatggactggacctggaggatcctcttttggtggcagcagccacaggtgcccactcccaggtccagcttgtgcagtctggggctgaggtgaagaagcctggggcctcagtgaaggtttcctgcaagacttctggatactccttcacttagtttttctatccattggctgcgccaggcccccggacaaaggcttgagtgggtgggatggatcaacgctgtcaatggtctcacaaaatattcacagaagttgcagggcagagtcacattactagggacacatccgcgagaacagcctacatggagctgagcagcctgatatctgaagacacggct

SEQ ID NO: 295794 - DNA, 334 bp, Homo sapiens
  misc_feature: NA.18.78.H01.2.454.heavy.1.nb
gagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagccgtggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaggca

SEQ ID NO: 295795 - DNA, 106 bp, Homo sapiens
  misc_feature: NA.18.78.H01.4.454.heavy.1.nb
tatgcgccttgccagcccgctcagtacgagtatgggaagtagtccttgaccaggcagcccagggccgctgtgcccagcacctgaactcctgggggaccgtcagtct

SEQ ID NO: 295796 - DNA, 435 bp, Homo sapiens
  misc_feature: NA.18.81.H04.1.454.heavy.1.nb
tgagacacctgtggttcttcctcctcctggtggcagctcccagatgggtcctgtctctcgtgcagttgcgtgagtcgggcccaggactggtgaagccttcggggaccctgtcgctcacctgcgctgtctttaatgactccatcagtagtagtcactggtggacttgggtccgccagtccccaggaaaggggctggagtggattggggaaatctctcctagtggggccaccaactacaatccgtccctcgaaagtcgactcaccatatccctagacaactccaagaaccatttctccctgcaattgatctctgtcgaccgccgcggacacggccatttattattgtgcgagacatctcttcgatgacagttcttattatggactggggtactactacggtctggacgtctggggccaagggaccccggtcaccgtc

SEQ ID NO: 295797 - DNA, 277 bp, Homo sapiens
  misc_feature: NA.18.85.H08.1.454.heavy.1.nb
ggattcccagctgtttctgcttgctgatcaggactgcacacagagaactcaccatggagtttgggctgagctgggttttcctcgttgtcttttttaaaggtgtccagtgtgaggtgcagctggtggaagtccgggggagcttagttcagccgtgggggtccctgagactctcctgtgcagcctctggattcagtttcagtgcctactggatgcactggatccgccaagttccagggaagagactggtgtgggtctcacgtattaaagatgagtgggg

SEQ ID NO: 295798 - DNA, 508 bp, Homo sapiens
  misc_feature: NA.18.87.H10.1.454.heavy.1.nb
agagaggagccttagccctggactccaaggcctttccacttggtgatcagcactgagcacagaggactcaccatggaattggggctgagctgggttttcctcgttgctattttagaaggtgtccagtgtgacgtgcagctggtggagtcgtgggggaggcttggtccagccgtggggggtccctgagactctcctgtgcaggccctgcattcatctttaatagttattggatgcactgggtccgccaggctccgggggaaggggccggagtgggtggccaacataatgcaagatggaactgagaagaactatgtggactctgtgaagggccattcaccatctccagagacaacactaaagaacttactgtatctgacaaaatgaacagcctcagagccgaggacacggctgtgtattactgtgcgaagagcagtggctgggacagtggacgtcgtggggccaaagggaccacgggtcaccgtctcctcacgcctccaccaacggccca

SEQ ID NO: 295799 - DNA, 49 bp, Homo sapiens
  misc_feature: NA.18.87.H10.3.454.heavy.1.nb
gtccagcctggggggtccctgagactctcctgtgcagcctctggattca

SEQ ID NO: 295800 - DNA, 411 bp, Homo sapiens
  misc_feature: NA.19.10.A10.4.454.heavy.1.nb
agtcccagccttggggttcccgagtgttttcgttcagtgatcaggactgaacacgtaggactcaccatggagtttggcctgagttggtattttcctttctgcttattttaaaaggtgtcctgtgtgaggtgcgcctggtggagtcgtgggggaggcgtggtccaggcccggggggtccctgagactctcctgtagaagttatggattcaacttcgctagcggctggctgtgctgggttcgccaggctccgagggaaggggctgggagtggggttggccgcatcaagaggagatagtggaaggggaggcgacagactacgctgcaccgtgagaggcagatttaccatgtcaagagatgattcaacaaagtacagtgtatctgcaaatgaacagcctagaagaccgaggacac

SEQ ID NO: 295801 - DNA, 373 bp, Homo sapiens
  misc_feature: NA.19.12.B01.1.454.heavy.1.nb
tgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgggccggggtagtggttatttgtactactttgactactggggccagggaaccctggtcaccgtctcctcagcctccaccaagggcccatcggtcttccccctggcaccctcctccaagagcacctctgggggcacagcggccctgggctgcctggtcaaggactacttcccacgagagtactgagcgggctggcaaggcgcat

SEQ ID NO: 295802 - DNA, 342 bp, Homo sapiens
  misc_feature: NA.19.13.B02.1.454.heavy.1.nb
ttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtt

SEQ ID NO: 295803 - DNA, 348 bp, Homo sapiens
  misc_feature: NA.19.2.A02.1.454.heavy.1.nb
cagtcctgtcccaggtgcagctacagcagtggggcgcaggactgttaaagccttcggagaccctgtccctcacctgcgctgtctatggtgggtccttcagaggttactactggagttggatccgccagcccccagggaaggactggagtggattggggaaatcaatcatagtggaagcgccagctacaacccgtcctcaagagtcggctcgacatattagtagacacgcccaagagtcagttctccctgaagctgggctctgtgaccgccgccgacacggctgtctatttctgtgcgagagttggattattgtgctggtgtagctgctacgcgtcgtttcagttagac

SEQ ID NO: 295804 - DNA, 426 bp, Homo sapiens
  misc_feature: NA.19.26.C04.1.454.heavy.1.nb
ggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggc

SEQ ID NO: 295805 - DNA, 319 bp, Homo sapiens
  misc_feature: NA.19.3.A03.1.454.heavy.1.nb
tagccctggattccaaggcctatccacttggtgaccagtactgagcaccgaggattcaccatggaactggggctccgctgggttttccttgttgctattttagaaggcgtccagtgtgaggtgcacctggtggagtctgggggaggcctggtcaagcctggggggtccctgagactctcctgtgcagcctctggattcgatttcgataattatggcatgaattgggtccgccaggctccgagggaagggctggagtgggtctcttccattaataaacatgccagtgacatgtactacgcagacgcacgtggagggccga

SEQ ID NO: 295806 - DNA, 282 bp, Homo sapiens
  misc_feature: NA.19.36.D03.1.454.heavy.1.nb
accacacccctccttgggagaatcccctagatcacagctcctcaccatggactggacctggagcatccttttcttggtggcagcagcaacaggtgcccactctcagggtcagctggtgcagtctggagctgaggttaagaagcctggggcctcagtgaaggtcgcctgcaaggcctctgattacacctttagcaactacggcatcacctgggtgcgacaggcccctggacaagggcttgagtggatgggatggatcgagcgcttacagtcataacacaaact

SEQ ID NO: 295807 - DNA, 423 bp, Homo sapiens
  misc_feature: NA.19.42.D09.1.454.heavy.1.nb
ctgtggttctcggggctgccctttggttttggagatggttttctcgatgggggctggagtgggtgggagttctgtcatatgatggaaggtataaatactttggagactccgtgaagggccgattcaccatctccagagacaattccaggaacacggtgtttctgcaaatgaacagcttgagacctgacgacacggctgtctattactgtgcgaaggagttcgcacccaagtacaactccgaaccatactttgactactggggccagggaaccctggtcaccgtctcctcagcctccaccaagggcccatcggtcttccccctggcgccctgctccaggagcacctccgagagcacagcggccctgggctgcctggtcaaggctacttcccacgagagtactgagcgggctggcaaggcgcata

SEQ ID NO: 295808 - DNA, 188 bp, Homo sapiens
  misc_feature: NA.19.45.E01.1.454.heavy.1.nb
gtttcatacattagtagtagtagtagcaccatatactacgcagactctgtgaagggccgattcaccatctccagagacaatgccaagaactcactgtatctgcaaatgaacagcctgagagccgaggacacggctgtgtattactgtgcgagaactaggatatccggggagggccgtcttttgactac

SEQ ID NO: 295809 - DNA, 339 bp, Homo sapiens
  misc_feature: NA.19.5.A05.1.454.heavy.1.nb
cagctgggatctcagggcttcattttctgtcctccaccatcatggagtcaaccgccatcctcgccctcctcctggctgttctccaaggagtctgtgccgaggtgcagctggtgcagtctggagcagaggtgaggaagcccggggagtctctgaggatctcgtgtaagacttctggattcaggtttactacatattggatcggctgggtgcgccagcagcccggacaaggcctggagtggatgggaatcatctatcctggagactctgatgccagatacactccgtccttccaaggccgagtcaccatttcagccgacaagtccatcagcaccgcctacc

SEQ ID NO: 295810 - DNA, 619 bp, Homo sapiens
  misc_feature: NA.19.53.E09.1.454.heavy.1.nb
gagaggagccccagccctgagattcccaggtgtttccattcagtgatcagcactgaacacagaggactcaccatggagttgagactgagctggattttcctttggctattttaaaaggtgtccagtgtgaagtgcagctggtggagtcgtgggggagcttggtacagcctggcaggtccctgagactctcctgtgcagcctctggattcacctttgatgattatgccatgcacgtgggtccggcaagctccgagggaagggcctggagtgggtctcaggtattagttggaatagtgctagtatagcctatgcggactctgtgaagggccgattcaccatctccagagacaacgccaagaactccctgtatctgcaaatgaacagtctgagagctgaggacacggccttgtattactgtgcaaggaggtatagcagctactggtacgactacgtggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcata

SEQ ID NO: 295811 - DNA, 397 bp, Homo sapiens
  misc_feature: NA.19.6.A06.1.454.heavy.1.nb
ccctgggattttcaggtgttttcatttggtgatcaggactgaacagagagaactcaccatggagtttgggctgagctggctttttcttgtggctattttaaaaggtgtccagtgtgaagtgcaactggtggagtcgtgggggaggcttggtacagccgtgggggtccctgagactctcctgtgcagcctctggattcacctttagcaactatgccatgacctgggtccgccaggctccagggaaggggctggagtgggtctcagttattagtgggagtggtgggggaacatactacgcagactccgtgaagggccggttcaccatttccagagacaattccaagaacaccctgtatctgcacatgaacagcctgagagccgaggacacggccgtata

SEQ ID NO: 295812 - DNA, 424 bp, Homo sapiens
  misc_feature: NA.19.67.G01.1.454.heavy.1.nb
gcccagcactgggattccgaggtgtttccattcggtgctcagcactgaacacagaggactcaccatggagttttggctgacctgggttttccttgctgctaatttcaggaggtgtccagtgtgaggtgcaactggtggagacgtgggcggaggcttggtccagcctgggcggtctctgagactgtcctgtgaaccctctggggtctccgtcagcagcgactgtattgcctgggtccgccaggctccagggaagaggccggagtgggtcgcaggtatttttataggtgggacgacattctacggagactccatggagggccgattcaccatctccagagacttttctcagaacacactgtctcttcaaatgaacagcctgagggccgaggacacggccgtctattattgtgtgagagtttatggc

SEQ ID NO: 295813 - DNA, 291 bp, Homo sapiens
  misc_feature: NA.19.68.G02.1.454.heavy.1.nb
tgctgaattctggctgaccagggcagtcaccagagctccagacaatgtctgtcgccttcctcatcttcctgcccgtgttgggcctcccatggggtgtcctgtcacaggtgcagctgcaacagtcaggtccaggactggtgaagccctcgcagagcctctcactcacctgtaccatctccggggacagtgtctctagtgacagcgcaacgttgggactggctcaggcacgtccccatcgagagccttgagtggctgggaagcatactacgaggtccacgtggtatgatgatt

SEQ ID NO: 295814 - DNA, 263 bp, Homo sapiens
  misc_feature: NA.19.69.G03.1.454.heavy.1.nb
aaccacacccctccttgggagaatcccctagatcacagctcctcaccatggactggacctggagcatccttttcttggtggcagcagcaacaggtggccactcccaggttcagctggtgcagtctggaggtgaggtgaagaagccgtggggcctcagtgaaggtctcctgcaaggcctctggttacacctttgccagattcggtatcagctgggtgcgacaggcccctggacaagggtcttggagtggatgggatggatcgac

SEQ ID NO: 295815 - DNA, 583 bp, Homo sapiens
  misc_feature: NA.19.71.G05.1.454.heavy.1.nb
tgctgaattctggctgaccagggcagtcaccagagctccagacaatgtctgtctccttcctcttcttcctgcccgtgctgggcctcccacaaggtgtcctgtcacaagtacagctgcagcagtcaggtccaggactggtgaagccctcgcagaccctctcgctcacctgtgccatcgtccggggacagagtcgctagcgacagtgttgcttggcacgtgggtcaggcacgtccccatcgagaggtctagagtggctgggaaggacatatttcatgtccaacacgtggaatacaaattatgcaccatctgttgagagtcgactgacaatcaacgtagacacatcgaagaaccagttctccctgcagctgacctctgtgactcccgaggacacgggtgtatattactgtggaagaggcccccatagacatgccacctcgtctctggtgctatattggggccagggaacccatgtcaccgtctcctcggcctccaccaagggcccatcggtcttccccctggccgccctgctccaggacgcacctccgagagcacagcggccctgggctgcctggtcaaggactac

SEQ ID NO: 295816 - DNA, 315 bp, Homo sapiens
  misc_feature: NA.19.82.H05.1.454.heavy.1.nb
aaccacatctgtcctctagagaaaaccctgtgagcacagctcctcaccatggactgggcctggaggatcctcctcttggtggcagcagctacaagtgcccactcccaggtgctactggtgcagtctggggctgaggtgaagaggcctggggcctcagtgaaggtctcctgcaagacttctgggttccccttccaaaattttgatatcaattgggtgcgacaggccactggacaagggctcgagtggatgggatggatgaacggtaaaagtggaaacacgaggctatgcggagagattccgagggcagagtcacca

SEQ ID NO: 295817 - DNA, 611 bp, Homo sapiens
  misc_feature: NA.19.86.H09.1.454.heavy.1.nb
tcacccagcaaccacatctgtcctctagagaatcccctgagagctccgttcctcaccatggactggacctggaggatcctcctcttggtggcagcagccaccggagcccactcccaggtgcagctggtgcagtctggggctgaggtgaaggagcctggggcctcagtgaaggtctcctgcgaggcttttggatacaccttcagtcattatcatatactctgggtgcgacaggcccctggacaagggcttgagtggatagggcggatccacggtggtagtggtggcgcatacgtcgcacagaagtttcagggccgcgtcaccatggccaaggtcgcgtccacgaatacagtgtatatggacttgagcagcctgaggtctgacgacacggccatgtattattgtgcgaggcaggacggggctaaaggcataaagtggttcgacccctggggccagggaaccctggtcaccgtctcctcagcctccaccaagggcccatcggtcttccccctggcgccctgctccaggagcacctccgagagcacagcggccctgggctgcctggtcaaggactacttcccacgagagtactgagcgggctggcaaggcgcata

SEQ ID NO: 295818 - DNA, 102 bp, Homo sapiens
  misc_feature: NA.1.14.B03.2.454.heavy.1.nb
tatgcgccttgccagcccgctcagactagcagtagaggaggtgggaacagagtgaccgaggggcagccttgggctgacctaggacggtcagtttggtccctc

SEQ ID NO: 295819 - DNA, 448 bp, Homo sapiens
  misc_feature: NA.1.34.D01.2.454.heavy.1.nb
ataaagcctggggggtccctgagactctcctgtggagcctctggattcacctttggaacctacgccatgagctgggtccgccaggctccagggaaggggctggagtgggtctccgctattagtggtagtggcggtagcacatactacgcagactccgtgaagggccggttcaccatctcccgagacaattcgcagaacacgttgttttgcaaatggacagcctgagagtcgcggacacggccgtctattattgtgcgacgcgctattataatataggctactggggccagggaaccctggtcaccgtctcctcagcctccaccaagggcccatccgtcttccccctggcgccctgctccaggagcacctccgagagcacagcggccctgggctgcctggtcaaggactacttccacgcactcgtctgagcgggctggcaaggcgcata

SEQ ID NO: 295820 - DNA, 199 bp, Homo sapiens
  misc_feature: NA.1.36.D03.2.454.heavy.1.nb
agagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaacttcaccgcctcctatatacactggtac

SEQ ID NO: 295821 - DNA, 395 bp, Homo sapiens
  misc_feature: NA.1.49.E05.1.454.heavy.1.nb
cccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctacatggaactgaggagcctcagatctgacgacacggccacttatactgcgcgagagatta

SEQ ID NO: 295822 - DNA, 407 bp, Homo sapiens
  misc_feature: NA.1.5.A05.1.454.heavy.1.nb
tccctcctcagaagcccccagagcacaacgccccaccatggactggacctggaggatcctctttttggtggcagcagccacaggtgcccactcccaggtccagcttgtgcagtctggggctgaggtgaagagcctggggcctcagtgaaggtttcctgcaaggcttcaggatacaccttcactaggtatgctatacattgggtgcgccaggcccccggacaaaggcttgagtggatgggatggatcaacgctggcaatggtaacacaaaaattcaacagaagttccagggcagagtcacctttacagggacacatccgcgaggattacttatatggagctgagcagcctgagatccgaagacacggctgtatattttgtgcgactctagtggagtcattattacgct

SEQ ID NO: 295823 - DNA, 233 bp, Homo sapiens
  misc_feature: NA.1.5.A05.2.454.heavy.1.nb
tcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcct

SEQ ID NO: 295824 - DNA, 40 bp, Homo sapiens
  misc_feature: NA.1.77.G11.4.454.heavy.1.nb
gtatgggagctccaggtacacttttggccaggggaccaag

SEQ ID NO: 295825 - DNA, 299 bp, Homo sapiens
  misc_feature: NA.1.78.H01.1.454.heavy.1.nb
gtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccac

SEQ ID NO: 295826 - DNA, 152 bp, Homo sapiens
  misc_feature: NA.1.89.I01.12.454.heavy.1.nb
tatgcgccttgccagcccgctcagcgtgtctctagaggagggcgggaacagagtgaccgagggggcagacttgggctgacctgcgacggtcagcttggtccctccgccgaacaccacagaactcagactggtatcccaggtcccgcagtaat

SEQ ID NO: 295827 - DNA, 103 bp, Homo sapiens
  misc_feature: NA.1.89.I01.15.454.heavy.1.nb
tatgcgccttgccagcccgctcagacgagtgcgttcagatggcgggaacagagtgaccgagggggcagccttgggctgacctaggacggtcagtttggtccct

SEQ ID NO: 295828 - DNA, 103 bp, Homo sapiens
  misc_feature: NA.1.89.I01.16.454.heavy.1.nb
tatgcgccttgccagcccgctcagacgctcgacagaggagggtgggaacagagtgaccgagggggcagccttgggctgacctaagacggtcagcttggtcccc

SEQ ID NO: 295829 - DNA, 78 bp, Homo sapiens
  misc_feature: NA.1.89.I01.5.454.heavy.1.nb
tatgcgccttgccagcccgctcagacgtacgatgaggagggtgggaacagagtgaccgagggggcagccttgggctga

SEQ ID NO: 295830 - DNA, 413 bp, Homo sapiens
  misc_feature: NA.21.15.B04.1.454.heavy.1.nb
gaggagccttagccctggactccaaggcctttccacttggtgatcagcactgagcacagaggactcaccatggaattggggctgagctgggttttccttgttgctattttagaaggtgtccagagtgaggtgaaagtggtggagtcggggggaggcttggtccaggccggggggtccctgagactgtcctgtgaagtctctggattgtatagcagagattggatgcactgggtccgccagacttcgagggaaagggtctggagtgggtggccaacataaaccaagatggaagtgtgaagcactatgtggcctctgtgaggggccgattcacaatctccagagacagtgccaagaactcgttgtatctgcaaatggacagcctgagagccgaggacacggctctctattactgt

SEQ ID NO: 295831 - DNA, 384 bp, Homo sapiens
  misc_feature: NA.21.17.B06.1.454.heavy.1.nb
cttgggattcccaagtgttttcattcagtgatcaggactgaacacagaggactcaccatgaagtttggctgagcgtggtcttcctcgttgctgttttaaaaggtgtccagtgtgaaatacagctggtggagtctgggggagccttggtgaaggccgggggggtcactcagactctcctgctctgcatctggttttatgataagtgatgcctggatgcacgtgggtccgccaggcaccgaggggaaggggctgggagtgggtcggccgtagttaggagggcgaagtgcgtgggtgggcgatagaatactctgcagccgtgagaggcagattcaccatcttcagagatgattcgagaaacacgatgcttctgcagatggatagcct

SEQ ID NO: 295832 - DNA, 405 bp, Homo sapiens
  misc_feature: NA.21.19.B08.1.454.heavy.1.nb
gccctggattccaaggcctatccacttggtgatcagcactgagcaccgaggattcaccatggaactggggctccgctgggttttcctagttactattttagaaggtgtccagtgtgaggtgcatctggtggagtcgtgggggaggcctggtcaagccgtggggggtccctgagactctcctgtgcagcctctggatccgccttcagtacctatagtatgaattggatccgccaggctccaggaagggctggagtggctctcacagattagtggtagtagtagtttcatatattacgcagactcagtgcagggccattcaccatctccagagacaacgccaagaacttccctagtatctgacaaatggacagcctgagagtcgaggacacggctagtgtattactg

SEQ ID NO: 295833 - DNA, 88 bp, Homo sapiens
  misc_feature: NA.21.20.B09.1.454.heavy.1.nb
cttcggagaccctgtccctcacctgcactgtctctggtggctccatcatcaatggtcattatcactggggctggatccgccagccccc

SEQ ID NO: 295834 - DNA, 365 bp, Homo sapiens
  misc_feature: NA.21.21.B10.1.454.heavy.1.nb
ccttagccctggattccaaggcctatccacttggtgatcagcactgagcaccgaggattcaccatggaactggggctccgctgggttttccttgttgctgttttagaaggtgtccagtgtgaggtgcaactggtggagtcgtgggggaggcctggtcaagccgtggggggtccctgagactcttctgtgaagcctctggattcaccttcagtggctatagcatgaactgggtccgccaggctccgagggaaggggctggagtgggtctcatccgttagtagtagtagtagttacatatactacgcagactcagtgaagggccgatcaccatctccagagacaacgccaagaactcactgtatctg

SEQ ID NO: 295835 - DNA, 406 bp, Homo sapiens
  misc_feature: NA.21.26.C04.1.454.heavy.1.nb
gaagactgacggtcctgctgctgaccatcccttcatgggtcttgtcccagatcaccttgaaggagtctggtcccacgctggtgaaacccacagagaccctcacgctgacctgcaccttctctgggttttcactcagtaccactgcagtgggtgtgggctggatccgtcagccccccggaaaggccccggagtggcttgcactcatttattggaatgatgataaccactacagcccatctctgaggaccaggctcaccctcacgaaggacaccgaccaaaaaccaggtcggtacctaacactgaccaacatcggaccccatggacacagccacatactactgtgcacacgggagtggctgggtgtgggactacgtggggccagggagtccgtggtcaccgtctcctc

SEQ ID NO: 295836 - DNA, 486 bp, Homo sapiens
  misc_feature: NA.21.27.C05.1.454.heavy.1.nb
tgctgacttctggctgaccagggcagtcaccggagctccagacaatgtctgtctccttcctcatcttcctgcccgtgctgggcctcccatggggtgtcctgtcacagatcaaactacagcagtctggtccaggactggtgaggccctcgcagaccctttcactcacctgtgacatctccggggaaaatgtcgctggcaacaatggttggaattggattaggcagtccccgtcgagaggccttgagtggcttggaaggacctattatacgtcccagtggtatgaagactatgcagattctgtgagcggtcgtctcaccatcaccccagacacgtccaagaatcaggtctccctccacctaatgtctgtcactcccgacgacacggcagtttattttgtgcaagagggatcacattcgtgactacctccttgactcctgggccagggtacgtttgtcaccgtctcctcacgcctccaccaagggccca

SEQ ID NO: 295837 - DNA, 327 bp, Homo sapiens
  misc_feature: NA.21.28.C06.1.454.heavy.1.nb
agcccagcactggaagtcgccggtgtttccattcggtgatcagcactgaacagagaggactcaccatggagtttgggctgggctgggttttcctcgctgttcttttagaggtgtccactgtcaggtaacactggtggagtcgggggagcgtggtccagcctgggacatccctgagactctcctgtttaggctctggattcagtatttggagacgccgccatgcactgggtccgccaggctccaggcaagggtctcgagtggttgggatttataacagtcgatcatattctcgaatttgcgggctctgtgaggggccatgtagcatct

SEQ ID NO: 295838 - DNA, 418 bp, Homo sapiens
  misc_feature: NA.21.34.D01.1.454.heavy.1.nb
agagaggagccttagccctggactccaaggcctttccacttggtgatcagcactgagcacagaggactcaccatggaactggggctgagctgggttttccttgttgttattttagaaggtgtccagtgtgaggtgcagctggtggagtctgggggagcttggtccagcctggggggtccctgagagtctcctgtgtggcctctggattcaagtttaatacctattggatgagctgggtccgccaggctccgagggaagggctggagtgggtggccaacataaaggaagatggaagtgaacaaaaagtatgtggactctgtgaagggccgattcaccatcttcagagacaacgccaagaactcactttatctgacaaatgaatagcctgagagtcgaagacacggctgtgtattactgt

SEQ ID NO: 295839 - DNA, 496 bp, Homo sapiens
  misc_feature: NA.21.35.D02.1.454.heavy.1.nb
gagcccagcactggaagtcgccggtgtttccattcggtgatcagcactgaacacagaggactcaccatggagtttgggctgacctgggttttcctcgttgctcttttaagaggtgtccactgtcaggtccacctggtggagtcgggggagcgtgttccagcctgggacgtccctgagagtctcctgtgcagcctctggattcagcttcagtgactttgccatgcacgtgggtccgccagactccaggcaaggggctagagtggctggcagttatcgcattcgatggaagcgatatgtactatgcggactccgtgaagggccgattcaccatctccagagacaattccaagaacacgctgtttctgcaaatgagcagcctgaaagaagaggacacggctgtatataactgtgcgcgaggaccttattattatggttcagggaccattgactactggggccagggaaccctggtcaccgtctcctcagcctccaccaa

SEQ ID NO: 295840 - DNA, 300 bp, Homo sapiens
  misc_feature: NA.21.36.D03.1.454.heavy.1.nb
agcgcaggtgagggacgagtagctggtgctcccactatgatagatttccccaatccactcctgtccctcacctgcgctgtctctggcggctccatcagaagtagtaactggtggagttgggtccgccagcccagggaaggggccggagtggattggggaaatctatcatagtgggagcaccagctacaacccgtccctcaagagtcgagtcaccatatcagtagacaagtccaagaaccagttcctccctgaagctgagctctgtcgaccgccgcggacacggccgtgtattatgtgcga

SEQ ID NO: 295841 - DNA, 385 bp, Homo sapiens
  misc_feature: NA.21.4.A04.4.454.heavy.1.nb
ggagccccagccccagaattcccaggtgttttcatttggtgatcagcactgaacacagaggactcaccatggagtttgggctgagctgggttttccttgttgttattttacaaggtgtccagtgtgaggtgcagctggtggagtcgtgggggagacttggtccagcctggagggtccctgagactctcctgtgcagcctctgcattcaccttcagtgaccacaacatggactgggtccgccaggctccgagggagggctggagtgggtcggccgtatacgaaggaagctaacagttacagtacagaatacggcgcgtctgtgaaaggaggttcaccatctacaagagatgattacaaagactcactgtatctgacaaatgaacag

SEQ ID NO: 295842 - DNA, 347 bp, Homo sapiens
  misc_feature: NA.21.45.E01.1.454.heavy.1.nb
gagtcatggacctcctgtgcaagaacatgaggcacctgtggtttttcctcctgctggtggcagctcccagatgggtcctgtcccaggtccacctgcaggagtcgggcccaggactggtgaagccctcggagaccctgtccctcatttgcactgtgtctggatccaccgtcacagatggttccttcgtggggctgggtccggcagtccccagagaagggtctggagtggattgggagtgtctataagtacggggagtcaatatcgtggtgacactccctactacaacccgtcttttaagagtcgagtcactatatcagtgcgctcgtccacgaaccaggtctccctga

SEQ ID NO: 295843 - DNA, 346 bp, Homo sapiens
  misc_feature: NA.21.46.E02.4.454.heavy.1.nb
gtctcacggattaaaactgacgggactaccacaaactacgcggactccgtgaagggccggttcaccatctccagagacaacgccaagagcacgctctatctgcaaatgaacagtctgagagtcgaggacatggctgtatattactgtgcaggagaaagggctggagtggttattattcctggggccagggaaccctggtaaccgtctcctcagcctccaccaagggcccatcggtcttccccctggcgccctgctccaggagcacctccgagagcacagcggccctgggctgcctggtcaaggactacttcccgagcgacgactgagcgggctggcaaggcgcata

SEQ ID NO: 295844 - DNA, 417 bp, Homo sapiens
  misc_feature: NA.21.53.E09.1.454.heavy.1.nb
gttttccttgttgctattataaaaggtgtccagtgtcaggtgcagttggtggagtctgggggaggcttggtcaagcctggagggtccctgagactctcctgtgcagcctctggattcaccttcagtgactactacatgggctggatccgccaggctccgagggaagggctggagtgggtctcatatattagtagtagtggtagtcccgtatactacgcagactctgtgaagggccgattcaccatcgccagggacaacgccaagaactcacagtatctgcagatgaatagcctgagagccgaggactcggccgtgtattactgtgcgagagatcccggcgatgatggcgacggctggtactactttgattacgtggggccagggaaccctggtcaccgtctcctcagcctccaccaa

SEQ ID NO: 295845 - DNA, 361 bp, Homo sapiens
  misc_feature: NA.21.60.F05.1.454.heavy.1.nb
gttggccgtattggaagcaaaactaacaattacgcgacaacatatgctgcgtcggtgaaaggcaggttcaccatctccagagatgattcaaagaacacggcgtatctgcaaatgagcagcctgaaaaccgaggacacggccgtctattactgtgctagacctagtggctcgtccgactggttgaagttcgacccctgggggccggggaaccctggtcaccgtctcctcggcctccaccaagggcccatcggtcttccccctggcgccctgctccaggagcacctccgagagcacagcggccctgggctgcctggtcaaggctacttccctcgtctctactgagcgggctggcaaggcgcat

SEQ ID NO: 295846 - DNA, 200 bp, Homo sapiens
  misc_feature: NA.21.67.G01.1.454.heavy.1.nb
tatagtcggaaaaactgtaaccagaggccctgcaggagaccttcaccgaggccccaggcttcttcacctcaggtccagactgcaccagttgagtctgggagtgggcacctgttgctgctgccaccaggaaaaggatgctccaggtccagtccatggtgaggggctgtgatctaggggaatctcccaaggaggggtgtggt

SEQ ID NO: 295847 - DNA, 127 bp, Homo sapiens
  misc_feature: NA.21.67.G01.2.454.heavy.1.nb
gtatcagttgggtgcgacaggcccttggacaagggcttgagtggatgggatgggccgaccttcgcaacggaagatggagtatggtcaggaatttcagggcagaattaccttgaccacagactcatcc

SEQ ID NO: 295848 - DNA, 366 bp, Homo sapiens
  misc_feature: NA.21.68.G02.1.454.heavy.1.nb
gtctcaggtattggtggcagtgagggtcccacatacttcgcagactccgtgaagggccggttcaccatctccagagacaattccaaggacaccctatatctgcaaatgcacagcctgagagccgaggacacggccgtatattactgtgcgaggaccggggcttatgacagtgggtggtacctggacttctactactacatggacgtctggggcaaagggaccacggtcaccgtctcctcagcctccaccaagggcccatcggtcttccccctggcaccctcctccaagagcacctctgggggcacagcggccctgggctgcctggtcaaggactacttccctcgtctctactgagcgggctggcaa

SEQ ID NO: 295849 - DNA, 453 bp, Homo sapiens
  misc_feature: NA.21.70.G04.1.454.heavy.1.nb
gcttcaccagtcctgtcccagctgcagctgcaggagtcgggcccaggactggtgaagccttcggagaccctgtccctcacctgcactgtctctggtggctccatcatcaatggtcattatcactggggctggatccgccagcccccagggaaggggctggagtgggttgcgagtatttttcatgatgggaccacctactataggtcgtcgctcaacagtcgagtcaccatatccgtagacacgtccaggaaccagttctccctgaagctgaactctctgaccgccgcagacgcgggtatatattattgtgcgagacatagtggtattggctactcgccctattacggtatggacgtctggggccaagggaccgcagtcaccgtctcctcagcctccaccaacgggcccatccggtccttcccctggcgccctgctccaggacgccacctccga

SEQ ID NO: 295850 - DNA, 381 bp, Homo sapiens
  misc_feature: NA.21.78.H01.1.454.heavy.1.nb
gagcccagcactgggattccgaggtgtttccattcggtgatcagcactgaacacagaggactcaccatggagttttggctgagctgggttttccttgttgctatttcaaaaggtgtccagtgtgaggtgcagttggtggagactggaggaggcttgatccagcctggggggtccctgagactctcctgtgcagtctctgggttcgtcagtggcgactacatgagctgggtccgccaggctccagggaagggcctggagtggatctcacttattatagtggtggtaccacatactacacagactccgtgaagggccattcaccatctcagaagacaattccaggaacacattgtatcttacaaatgaataacctgagagccg

SEQ ID NO: 295851 - DNA, 106 bp, Homo sapiens
  misc_feature: NA.21.78.H01.2.454.heavy.1.nb
tatgcgccttgccagcccgctcagtagagacgagggaagtagtccttgaccaggcagcccagggccgctgtgcccagcacctgaactcctgggggaccgtcagtct

SEQ ID NO: 295852 - DNA, 367 bp, Homo sapiens
  misc_feature: NA.21.8.A08.5.454.heavy.1.nb
gcactagaagtcggcggtgtttccattcggtgatcagcactgaacacagaggactcaccatggagtttgggctgagctgggttttcctccttgctcttttaagaggtgtccagtgtcaggcgcaactggtggagtctgggggaggcatggtccagcctgggaggtccctgagcctctcctgtgcagcgtctggattcagtatcggctcctttgccatgcactgggtccgccaggctccaggcaaggggctgggagtgggtggcgattatctggtatgatggaagtgagagatattattcagactccgtgaagggccgattcaccatctccagagacaatgaccaacaacacactgtatcttacaaat

SEQ ID NO: 295853 - DNA, 398 bp, Homo sapiens
  misc_feature: NA.21.85.H08.1.454.heavy.1.nb
tgaccaggcaggtcaggctgacctggttcttggtcatctcctccagggaaggggctggagtgggtctctggtataaattacaatggaggtcacacagcttatagagactctgtgaggggccgattcaccatctccagagacagcgccaagaactccctgtatctgcaaatgaacagtctgagagccgaggacacggccttatattactgtgcgcgtgatgggttgggtgccctttcgttcttcgatctctggggccgcggcaccctggtcactgtctcctcagcctccaccaagggcccatcggtcttccccctggccgccctgctccaggagcacctccgagagcacagcggccctgggctgcctggtcaaggctacttccctcgtctctactgagc

SEQ ID NO: 295854 - DNA, 271 bp, Homo sapiens
  misc_feature: NA.22.11.A11.2.454.heavy.1.nb
ggggggtccctgagactctcctgtgcagcctctgggttcaccgtcagtagcaagtacatgagctgggtccgccaggctccgagggagggctggagtggatctcagttatttatctcggtggtaacacatactacgcagactccgtggagggccgattcaccatctccagagacaattccaagaacacggtgtatcttcaaatgaacagcctgagagccgatgacacggccgtgtattactgtgtgagatcaaaattccaagccgcggggtc

SEQ ID NO: 295855 - DNA, 327 bp, Homo sapiens
  misc_feature: NA.22.24.C02.1.454.heavy.1.nb
gcttcaacagtcctgtcccaggtgcagctacaacagtgggcgcaggactgttgaagccttcggagaccctgtccctcacctgcgctgtctatggtgggtctttcagtgattactactggagctggatccgccagcccccagggatgggcctggagtggattggggaaatcgatcatactggaagcagcaagaccaacccgtccctcaagaatcgagtcactctgtcagtagacacgtcccggagccagttctccctgaacctgaagtctatgaccgcgcggacacggctgtttatactgtgccggactaaccgtgccgcgtgccttg

SEQ ID NO: 295856 - DNA, 318 bp, Homo sapiens
  misc_feature: NA.22.29.C07.4.454.heavy.1.nb
gtctcaggtattagtgataatgcttttagcacaaactacgcagactccgtgaagggccggttcaccatctccagagacaattccaagaacacgctgtatttgacaaatgaacagcctgagagccgaagacacggccgtctattactgtgcgagagttaccgcatacggtgactacctactttctcgactggggccagggaaccctggtcaccgtctcctcagcctccaccaagggcccatcggtcttccccctggcgccctgcctccaggagcacctccgagagcacagcggccctgggctgcctggtcaaggctact

SEQ ID NO: 295857 - DNA, 290 bp, Homo sapiens
  misc_feature: NA.22.30.C08.2.454.heavy.1.nb
aggagccttagccccggactccaaggcctttccacttggtgatcagcactgagcacagaggactcaccatgggattggggctgagctggcttttccttgttgctattttagaggtgtccagtgtgaggtgcgcctggtggaatcgtgggggggccttggtccagcctggggggtccctgagactcgcctgtgcagcctctggattcgagtttggagcctactgtctgacttgggccgccaggctccgaggggagggctggagtgggtggccagcatcaacgagacggaca

SEQ ID NO: 295858 - DNA, 513 bp, Homo sapiens
  misc_feature: NA.22.34.D01.1.454.heavy.1.nb
gaagactgacggtcctgtcccaggtgcagctgcaggagtcgggcccaggactggtgaagccttcggagaccctgtccctcacctgtactgtctctggtggctccgtcactggttaccactggagctggatccggcagcccccagggaagggactggagtggattggctatatttcttacagtggccgcaccaactcccacccctccctcaagacgtcgacgccaccatatcagtcgacacgtccaagaaccagttctccctgaaactgaggtctgtgaccgcagcggacacggccgtgtattactgtgcgagagagtccgggtccgatatctggccgttcgacccctggggccagggaaccctggtcaccgtctcctcagcctccaccaagggcccatcggtcttccccctggcgccctgctccaggagcacctccgagagcacagcggccctgggctgcctggtcaaggactacttccacgcgtatgtctgagcgggctggcaaggcgcata

SEQ ID NO: 295859 - DNA, 259 bp, Homo sapiens
  misc_feature: NA.22.38.D05.1.454.heavy.1.nb
tgggatgacggttaccgctacagtccatctctgaggaggagactcaccatcaccaaggacacccccaaaaaccaggtggtccttacaatgaccaccatggaccctgtggacacagccacatatttctgtgcacactctataggagcacctggtagtctgccaaactggttcgacccctggggcccggaacctggtcaccgtctcctcagcctccaccaagggcccatcggtcttccccctggccgccctgcctccagga

SEQ ID NO: 295860 - DNA, 347 bp, Homo sapiens
  misc_feature: NA.22.46.E02.1.454.heavy.1.nb
gatttcatatattaacgatggagggaggacgaaaaggtacgcaaattctgtgaagggccgagtcaccatttccagagacaacgccaggaactcagtgtatctgcaaatgaacagcctgacagccgaggacacggctgtctattactgtacgagagattggcaagcctgggcctttgatgtctggggccctgggacaatggtcaccgtctctttagcctccaccaagggcccatcggtcttccccctggcgccctgctccaggagcacctccgagagcacagcggccctgggctgcctggtcaaggctacttccacgcgtatgtctgagcgggctggcaaggcgcata

SEQ ID NO: 295861 - DNA, 361 bp, Homo sapiens
  misc_feature: NA.22.5.A05.1.454.heavy.1.nb
accatggacacactttgctccacgctcctgctgctgaccatcccttcatgggtcttgtcccagatcaccttgaaggagtctggtcctacgctggtgaaacccacacagaccctcacgctgacctgcaccttctctgggttctcactcaccacttatggagtgggtgtgggctggatccgtcacgccccaggaaaggccctagactggcttgcactcatttattggaatgatgataagcgctacagcccatctctgaagagcagactcaacatcaccaaggacacctaccaaaaagcaagtggtccttacaatgaccaacatggaccctttggacacagccacatattactgtgcacaccac

SEQ ID NO: 295862 - DNA, 371 bp, Homo sapiens
  misc_feature: NA.22.56.F01.1.454.heavy.1.nb
ctgcttcagtgggtgtgggctggatccgtcagcccccaggaaaggccctggagtggcttgcactcctttatggggatggcggtgaacactacagtccatctctgaagaccagactcaccatcgcccgggacacctccaagaaccaagtggtccttacactgaccagcgtggaccctgtggacacaacaacatatttctgtgcacagagccgccagttagactggggggcctgtcgtggtggttggtgccgcaatgatgcatttcatatttggggccaagggacagtggtcaccgtctcggcagcctccaccaagggcccatccggtccttccccctggccgccctgctccaggacgccacctccgagacgc

SEQ ID NO: 295863 - DNA, 313 bp, Homo sapiens
  misc_feature: NA.22.62.F07.1.454.heavy.1.nb
cttgcactcatcgattgggatggtgataaatactacagcacatctctgaagaccagactcaccatctccagggacacctccaaaaaccgggtggtcctttcaatgaccaacatggaccctgtggactcaggcacatattactgtgcccggacacgctgtcgatacaatgaatatgcagactttgactattggggccacggactcctggtctccgtctcctcggcctccaccaagggcccatccggtcttccccctggcgccctgctccaggacgccacctccgagacgcacagcggccctgggctgcctggtc

SEQ ID NO: 295864 - DNA, 388 bp, Homo sapiens
  misc_feature: NA.22.65.F10.1.454.heavy.1.nb
agccccagccccagaattcccaggagtttccattcggtgatcagcactgaacacagaggactcaccatggagtttgggctgagctgggttttccttgttgctattataaaaggtgtccagtgtcaggtgcagctggtggcgtcgtgggggagcttggtcaagcctgggacgggtccctgagactctcctgtgcagcctctggacttccccttcagtgacttctacatgaattggatccgccaggctccgagggagggctggagtgggtttcatacattagtggtagtggtattttaaatacgcagactctgtgaagggccgattcacatctccaggacaacgccaagactcactgtatctgacaaatgaacagcctgagagtcgagga

SEQ ID NO: 295865 - DNA, 337 bp, Homo sapiens
  misc_feature: NA.22.73.G07.2.454.heavy.1.nb
cagtcctggacctcctgtgcaagaacatgaaacatctgtggttcttccttctcctggtggcagctcccagatgggtcctgtcccagctgcagctgcaggagtcgggcccaggactggtgaagccttcggagaccctgtccctcacctgcattgtctctggcgactccatcactagttactactggagctggctccggcagtccccagggaaggactggagtggattgggtatatctattacactgggagcaccgactacacgcccctcctcatgagtcgagtcaccatttcactagacacgtccaagaaccagttctccctagaaactgaggtctgt

SEQ ID NO: 295866 - DNA, 461 bp, Homo sapiens
  misc_feature: NA.22.78.H01.1.454.heavy.1.nb
tcgagactctcctgtagaggctctggattcacctttaagtcttatgccatgacctggatccgccagactccggggaagggactggagtgggtcgcgaccatcactggaactggaattagtacttactacgcagagtccgtgaagggacggttcaccatctccagagacaactcccaggacactgtttattagacatgaagagcctgcgcactgcggacacggccgtctatttctgtgtcaaagccagcgggcggatctacgatcctaacggctattactacggatttgacacctggggccagggaaccctggtcaccgtctcctcagcctccaccaagggcccatccggtcttccccctggccaccctcctccaagacgcacctctgggcacagcggccctgggctgcctggtcaaggactacttccacgcgtatgtctgagcgggctggcaaggcgcata

SEQ ID NO: 295867 - DNA, 492 bp, Homo sapiens
  misc_feature: NA.22.86.H09.1.454.heavy.1.nb
gcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcgtctggattcaccttcagtggctatggcatgcactggctccgccaggctccgggcaaggggctggagtgggtggcaattatatggtatgatggaagtaataaagactatgtggactccgtgaagggccgattcaccatctcagagacaactccaagaacactctgtttctccaaatgaacagcctgagaggcgaggacacggcagtgtattactgtgcgagagatcgacatgactacgggaaagtcttttgatctcgtggggccaagggacacgtggtcaccgtctcttcagcctccacc

SEQ ID NO: 295868 - DNA, 413 bp, Homo sapiens
  misc_feature: NA.23.10.A10.1.454.heavy.1.nb
acggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaaccccctttacattccgtccctcgagagtcgagtcaccatttcactggagccgtccaagaaccagtactccctgaggctgcggtctgtcgacccccgcggacacggccgtatattactgtgcgggcttaggtcattgtgttggcgatgtctgcactaccgcgcgcaattattacgtgggtcgtttgggcacgagggaccacggtcaccgtctcct

SEQ ID NO: 295869 - DNA, 321 bp, Homo sapiens
  misc_feature: NA.23.13.B02.1.454.heavy.1.nb
caaccagattcctcctctaaagaaggccctgggagcacagctcatcaccatggactggacctggaggtgcctctttgtggtggcagcagttacaggtgtccaggcccaggcccacctggtgcaatctggggctgtggtggagaagcctgggtcctcggtgagggtctcctgcaggtcttcgtggcggctccatcagcagatacactttcaactgggtgcgacacggcccctgggcaaggccttgagtggctgggaaggtcatccctctccttggagtctcaacctacgcacaacacttccagggcagggtcactattaccg

SEQ ID NO: 295870 - DNA, 616 bp, Homo sapiens
  misc_feature: NA.23.17.B06.1.454.heavy.1.nb
tagccctggactccaaggcctttccacttggtgatcagcactgagcacagaggactcaccatggaattggggctgagctgggttttccttgttgctattttagaaggtgtccagtgtgaggtgcagctggtggagtctgggggaggcttggtccagcctggggggtccctgagactctcctgtgcagcctctggattcacctttagtacctattggatgacctgggtccgccaggctccgagggaagggctggagtgggtggccaacataaggcaagatggaggtgagaaatactatgtggactctgtgaagggccgattcaccatctccagagacaacgacaagaactcactgtatctgcaaatgaacagcctgagagccgaggacacggctgtgtattattgtgcgagagacaggtccagaaaggagggggagagctttgactgctggggccagggaaccctggtcaccgtctcctcagcctccaccaagggcccatcggtcttccccctggccgccctgctccaggagcacctccgagagcacagccggccctgggctgcctggtcaaggactacttccatactcgcgtctgagcgggctggcaaggcgcata

SEQ ID NO: 295871 - DNA, 339 bp, Homo sapiens
  misc_feature: NA.23.23.C01.2.454.heavy.1.nb
accacatctgtcctcgagaggacaccctgtgaccacagctcctcaccatggactggacctggacgatcctcttcttggtggcagcagccagaagtgcccactcccacgaggaattggtgcagtctgggcctgaggtgaagaagcctggggcatcagtgaaagtcacctgcaaggcttcaggatacaccttcaccaaatttgatatcaactgggtgcgacaggcccctggaaaagggctcgagtggatgggctgggtgagtcctagtgttgagaataccgggcattctcagaagttcaaggccaggctcagcctgacctggaacacttccagaagaacag

SEQ ID NO: 295872 - DNA, 562 bp, Homo sapiens
  misc_feature: NA.23.27.C05.1.454.heavy.1.nb
gagagtcatggacctcctgtgcaagaacatgaagcacctgtggttttgcctcctgctggtggcagctcccagatgggccctgtcccaggcgcaagtgcaggagtcgggcccaggactggtgaggccttcggaaaccctgtctctttcctgcactgtctctactgtctccgtcaccgatccctgctggggctgggtccggcaaccccagggaaggtcttgagtggattggagatatctgtcccggtaggggcacttattacaacccgtccctcaaaagacgggccgccctatcaggggacacggccaagaaggaattctcgctgagtttgacttctgtgaccgccgcagacacggccgtctatttttgtgcgaggagaaactactacttcgatctctggggccgcggcatcctggtcactgtctcctcggcttccaccaagggcccatcggtcttccccctggccgccctgctccaggagcacctctggggcacagcggccctgggctgcctggtcaaggactacttccatactcgcgtctgagcgggctggcaaggcgcata

SEQ ID NO: 295873 - DNA, 52 bp, Homo sapiens
  misc_feature: NA.23.46.E02.1.454.heavy.1.nb
catgacttactactggagttggatccggcagcccgccgggaagggactgcag

SEQ ID NO: 295874 - DNA, 224 bp, Homo sapiens
  misc_feature: NA.23.46.E02.2.454.heavy.1.nb
tggattgggcgcatatatggtagtgggaggaccacctacaacccctccctcgagagtcgagtttccatatcagtggacacgtccaagagccagttctccctgaggatgacctctgtgaccgccgcagacacggccatatatttctgtgcgagaggacctcaccgtgatcaaagtgattagttggggccgggcatcctggtcaccgtctcgtcggcctccaccaa

SEQ ID NO: 295875 - DNA, 382 bp, Homo sapiens
  misc_feature: NA.23.50.E06.1.454.heavy.1.nb
aaccacacccctccttgggagaatcccctagatcacagctccgcaccatggactggacctggagcatccttttcttggtggcggcagcaacaggtgcccactcccaggttcaactggaacaatctggagctgaggtgaagaggcctggggcctcagtgaaggtctcctgcaaggcttctggttacatctttaggaactatgctatcaactgggtgcgacaggcccctggacaagggcttgagtggatggggtggatcagcgtctacgatgataacacagactttgcacagaagttccagggcagagtctccatgagcacagacacatccacgagcacagtctacatggaactgaggagtctgacatctgacgacacggccgt

SEQ ID NO: 295876 - DNA, 359 bp, Homo sapiens
  misc_feature: NA.23.60.F05.1.454.heavy.1.nb
tgggtttgattagaagtaaaagttatggtgggacaacaaaatacgccgcgtctgtggaaggcagattcaacatctcaagaaatgattccacaagtgtcgcctatctgcaaatgaacagcctgaaaaccgaggacacaggcgtgtattactgtacgagcagatttctctggttcggggatccccaactttgactactggggccagggaaccctggtcaccgtctcctcagcctccaccaagggcccatcggtcttccccctggcaccctcctccaagagcacctctggggcacagcggccctggctgcctggtcaaggactactccatactcgcgtctgagcgggctggcaaggcgcata

SEQ ID NO: 295877 - DNA, 44 bp, Homo sapiens
  misc_feature: NA.23.64.F09.1.454.heavy.1.nb
cccagggccgctgtgccccagaggtgctcctggagcagggcgcc

SEQ ID NO: 295878 - DNA, 374 bp, Homo sapiens
  misc_feature: NA.23.67.G01.1.454.heavy.1.nb
agttgtttcatatgatggaagtaatagaaagtatctcgactccgtggcgggccgattcaccatctccagagacagatctacgaagacggtgtatctccaaatcaacaacctgagaactgaggacacggctgtgtattactgtgcgagagactcggggcggccggtccgtcccccaggacgtacggctactattccgacatggacatctggggcgaagggaccacggtcatcgtctcctcagcctccaccaagggcccatcggtcttccccctggcgccctgctccaggagcacctccgagagcacagcggccctgggctgcctggtcaaggactacttccatactcgcgtctgagcgggctggcaaggcgcata

SEQ ID NO: 295879 - DNA, 385 bp, Homo sapiens
  misc_feature: NA.23.72.G06.1.454.heavy.1.nb
ggtaggtttcattagaagcaaagcttatggtgggacaacagaatacgccgcgtctgtgaaaggcagattcaccatctcaagagatgattccaaaagcatcgcctatctgcaaatgaacagcctgaaaaccgaggacacagccgtgtattactgtactagagggcgacattacgatattttgactggttattctcccggaggctactactacatggacgtctggggcaaagggaccacggtcaccgtctcctcagcctccaccaagggcccatcggtcttccccctggcaccctcctccaagagcacctctggggcacagcggccctgggctgcctggtcaaggactacttccatactcgcgtctgagcgggctggcaaggcgcat

SEQ ID NO: 295880 - DNA, 96 bp, Homo sapiens
  misc_feature: NA.23.75.G09.2.454.heavy.1.nb
cacgtccatcaccacagcctacatggagctggaggggcggtgaggatacgtgacgacacggccgtttattattgtgcgagaggagggtacattcag

SEQ ID NO: 295881 - DNA, 368 bp, Homo sapiens
  misc_feature: NA.23.76.G10.1.454.heavy.1.nb
ccctcctaagaagaagcccctagaccacagctccacaccatggactggacctggaggatcctcttcttggtggcagcagcaacaggtgcccactcccaggtgcaactggtgcaatctgggtctgagttgaagaagcctggggcctcagtgaaggtttcctgcaaggcttctggatacaccttcactacctatgctatgaattgggtgcgacaggcccctggacaagggcttgagtggatgggatggatcaacaccaacactgggaacccaacgtatgcccagggcttcacaggacggtttgtcttctccttggacacctctgtcagcatggcatatctgcagatcagcagcctaaaggctgaggacac

SEQ ID NO: 295882 - DNA, 291 bp, Homo sapiens
  misc_feature: NA.23.80.H03.2.454.heavy.1.nb
ggagccttagccctggattccaaggcctatccacttggtgatcagcactgagcaccgaggcttcaccatggaactggggctccgctgggttttccttgtcgctattttagaagctgtccagtgtgaggtgcaggtggtggagtcgtgggggaggcctggtcaggcctggggagtccctgagaatttcctgtacatcctctgaattcagtccttatacctggaactgggtccgccaggctccgagggaaggcctagagtgggtctcgtccatcagtcgaagcagtagttaaa

SEQ ID NO: 295883 - DNA, 353 bp, Homo sapiens
  misc_feature: NA.24.20.B09.1.454.heavy.1.nb
gctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcgtggggacaactggttcgacccctggggccagggaaccctggtctccgtctcctcagcctccaccaagggcccatcggtcttccccctggcgccctgctccaggagcacctccgagagcacagcggccctgggctgcctggtcaaggactacttccacatagtagtctgagcgggctggcaaggcgcata

SEQ ID NO: 295884 - DNA, 44 bp, Homo sapiens
  misc_feature: NA.24.35.D02.8.454.heavy.1.nb
agcccaaatcttgtgacacacctccccgtgcccacggtgcccag

SEQ ID NO: 295885 - DNA, 171 bp, Homo sapiens
  misc_feature: NA.24.36.D03.2.454.heavy.1.nb
  modified_base (151)..(151): a, c, t, g, unknown or other
  misc_feature (151)..(151): n is a, c, g, or t
ctggagtgggtttcagttatgtatggcgatgggaggacatactacgcagactccgtggaggggccggttcaccctctccagagacaattccaagaacacgttgtatctacaaatgaacagcctaagggtcacgacacggccgtctattacngcgcgagtgactcccggact

SEQ ID NO: 295886 - DNA, 421 bp, Homo sapiens
  misc_feature: NA.24.37.D04.7.454.heavy.1.nb
tgctttctgagactcatggacctcctgtgcaagaacatgaagcacctgtggttcttcctcctgctggtggcggctcccagaagggtcctgtcccatttccagttgcgtgagtcgggcccaggactggtgaagcctgcggagaccctgtccctcatttgctctgtctctggtgactccttcagtaacacagattattattgggcctggatccggcagcccccagggaagagcctggagttggttgcgagtatccattatcatgggcgaacccccttctacattccgtccctcgagagtcgagtcaccatttcactggagccgtcaagaaccagtactccctgaggctgcggtctgtcgacccccgcggacacggccgtatattactgtgcgggcttaggtcattgtgttgcgtatgtctgca

SEQ ID NO: 295887 - DNA, 154 bp, Homo sapiens
  misc_feature: NA.24.37.D04.8.454.heavy.1.nb
tatgcgccttgccagcccgctcagactactatgtggaagtagtccttgaccaggcagcccagggccgctgtgcccccagaggtgctcttggaggagggtgccagggggaagaccgatgggcccttggtggaggctgaggagacggtgaccgtgg

SEQ ID NO: 295888 - DNA, 379 bp, Homo sapiens
  misc_feature: NA.24.4.A04.1.454.heavy.1.nb
caggcggcggtctgcaatgggtggcagttgtctcttatgatggctttcacacctactatgcaacgccagtgaggggccattcaccgtctcccgagacaataccaagaacatggtctatctgcagatggacagcctgcgcactgaggacacagctgtctattactgtgcgcgatcagaagtggcgggaacctggggctactcctttgactcctggggccaggggaccctggtcgccgtctcctccgcctccaccaagggcccatcggtcttccccctggcgccctgctccaggacgcacctccgagagcacagcggccctgggctgcctggtcaaggactacttccacatagtagtctgagcgggctggcaaggcgcata

SEQ ID NO: 295889 - DNA, 338 bp, Homo sapiens
  misc_feature: NA.24.41.D08.1.454.heavy.1.nb
ccttcacagaccctgtccctcacttgcactgtctctggtggctccatcaatagtggtacttactattggagctggatccggaagcccgccgggaagggactggagtggattggccatatctacgccaatgggagaaccaggtacaacccctccctccagagtcgagtcaccatttcactggacccgtcaagaccaattgtccctgagtctgaattctgtgaccgccgcagacacggccacttatactgtgcgagagaggcgcagtggccgcaactaagtcgtttcactattatggtatggacgcctggggccgagggaccacggtcaccgtctcctca

SEQ ID NO: 295890 - DNA, 340 bp, Homo sapiens
  misc_feature: NA.24.45.E01.1.454.heavy.1.nb
ccgacacccctccttgggagaatcccctagatcacagctcctcaccatggactggacctggagcatccttttcttggtggcagcagcaaccggtgccctctcccaggttcagctggagcagtctggagctgaggtgaagaagcctggggcctcagtgaaggtctcctgcaaggcttctggttatacttttaacacctatggtatcacctgggtgcgacaggcccctgggcaaggacttgagtggatgggatggatcagcgattatagtggaaacacaaactatgcacagaaatttcggggcagagtcacatgacacagacacatccacggccacagccta

SEQ ID NO: 295891 - DNA, 582 bp, Homo sapiens
  misc_feature: NA.24.53.E09.1.454.heavy.1.nb
gaggagccttagccctggagtccaaggcctttccacttggtgatcagcactgagcacagaggactcaccatggaattggggctgagctgggttttccttgttgctattttagaaggtgtccagtgtgaggtgcaactggtggagtcgtgggggaggcttggtccagcctggggggtccctgagactctcctgtgcagcctctggattcccctttagtgacttttggatgacctgggtccgccaggctccagggacggggctggagtgggtggccaatataaggcacgatggacgtagcatgtactatgtggactctgtgaagggccgattcaccatctccagagacaacgcccagaactcactgtatctggaaatgaccagcctgagagtcgaggacacggctatgtattactgtgcgaccatatcagcacctggagtcgcatctgaatacttccagcattggggccagggcaccctggtcaccgtctcctcagcctccaccaaggcccatccggtccttccccctggccgccctgctccaggacgcacctccgagacgcacagcggccctgggctgcctgg

SEQ ID NO: 295892 - DNA, 405 bp, Homo sapiens
  misc_feature: NA.24.59.F04.1.454.heavy.1.nb
agaggagcccagccctgggattttcaggtgttttcatttggtgatcaggactgaacagagagaactcaccatggagtttgggctgagctggctttttcttgtggctattttaaaaggtgtccagtgtgaggtgaagttgttggagtctgggggagccttggttcggcccggggggtccctgagactctcatgtgcagcctctggattcacatttaactacaatggcatgagttggctccgccaggctccgaggggaaggggctgggagtgggtcgccgtcgggttagtgggagtggctacaacacattctacgcgggctccgtgaagggccgattcaccatctccaaggtactttccaagaacacgctgaatctaggaaatgaacagtctgagagtcgacgacac

SEQ ID NO: 295893 - DNA, 599 bp, Homo sapiens
  misc_feature: NA.24.62.F07.1.454.heavy.1.nb
gcttcaccagtcctggacctcctgtgcaagaacatgaaacatctgtggttcttcctcctcctggtggcagctcccagatgggtcctgtcccaggttcaacttcaggagtcgggcccaggactggtgaagccttcacagaccctgtccctcacttgcactgtctctggtgctccatcaatagtgtacttactattggagctggatccggaagcccgcgggaaggactggagtggattggccatatctacgccaatgggagaaccaggtacaacccctccctccagagtcgagtcaccatttcactggacccgtccaagaaccaattgtccctgagtctgaattctgtgaccgccgcagacacggccacttattactgtgcgagagaggcgcagtggccgcaactaagtcgtttctactattatggtatggacgcctggggccgagggaccacggtcaccgtctcctcagcctccaccaagggcccatcggtcttcccctggcaccctcctccaagagcacctctggggcacagcggccctgggctgcctggtcaaggactacttccacatagtagtctgagcgggctggcaaggcgcata

SEQ ID NO: 295894 - DNA, 367 bp, Homo sapiens
  misc_feature: NA.24.68.G02.1.454.heavy.1.nb
ctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcaggagtggctaggaaaaagtcgtagtctcattcccgtcgacctcgtggggccagggtaccctggtcaccgtctcctcagcttccaccaagggcccatcggtcttccccctggccgccctgcctccaggacgcacctctcgggggcacagcggccctgggctgcctggtcaaggactacttccacatagtagtctgagcgggctggcaaggcg

SEQ ID NO: 295895 - DNA, 283 bp, Homo sapiens
  misc_feature: NA.24.70.G04.1.454.heavy.1.nb
ataggggctgtctatcatatcgggaacaccttttacaatccgtccctcgagagtcgactctccatatccattgacacgtccaagaatcagttctcgttgaggctgcactctgtcacggccgcggacacggccgtttatttctgcgcgagatggggtggatgggcagctcggtggggacaactggttcgacccgtggggccagggaaccctggtctccgtctcctcagcctccaccaaggcccatcggtccttccccctggccgccctgctccaggacgcacct

SEQ ID NO: 295896 - DNA, 359 bp, Homo sapiens
  misc_feature: NA.24.76.G10.1.454.heavy.1.nb
agcactagaagtcggcggtgtttccattcggtgatcagcactgaacacagaggactcaccatggagtttggcctgaactgggttttcctcgttgctcttttaagaggtgtccagtgtcaggtgcagctggtggagtctgggggaggcgtggtccagcctgggaggtccctgagactgtcctgtgcagcgtctggacacatcttcaatacctatggcatgcactgggtcccgccaggctccgaggcaaggggctgggagtgggtgctaggtttatttggtttgatggaactaatgaatactatgcagagtccgtgaagggccgattcacatctccagagacaattccaggagtaattttg

SEQ ID NO: 295897 - DNA, 114 bp, Homo sapiens
  misc_feature: NA.24.78.H01.1.454.heavy.1.nb
tgctcgatttagtgtgagtagtttgggtttggggagagctgctcagttaggacccagagggaaccatggaaaccccagcgcagcttctcttcctcctgctactctggctcccag

SEQ ID NO: 295898 - DNA, 357 bp, Homo sapiens
  misc_feature: NA.24.78.H01.4.454.heavy.1.nb
ccagcactagaagtcggcggtgtttccattcggtgatcagcactgaacacagaggactcaccatggagtttgggctgagctgggttttcctcgtcgctcttttaagaggtgtccagtgtcaggggcagctggtggagtcgtgggggcggcgtggtccaaccgtgggaggtccctgagactctcctgtgcggcctcccgattcaccttcaatacttatggcatgcactgggtccgccaggctccaggcaaggggctggagtgggtggccgctatcttattgatggaagtaatcaatattatgcagactccgtgaagggccggttcaccatctccagagacaattccaacaatactctg

SEQ ID NO: 295899 - DNA, 277 bp, Homo sapiens
  misc_feature: NA.24.85.H08.2.454.heavy.1.nb
ggggtccctgagactctcctgtgcagcctctggattcgccttcaataacttctggatgcactgggtccgccaagctccgagggaagggctgatttgggtctcacgtattaacattgatgggatagctcacactatgcggactccgtgaagggccgattcaccatctccagagacaacgccagaaacacactgtatctgcaaatgagcagcctagaaagccgacgacacggctgtgtattactgtgcaagaggggccagcattactcctactactccg

SEQ ID NO: 295900 - DNA, 135 bp, Homo sapiens
  misc_feature: NA.24.85.H08.3.454.heavy.1.nb
acacggtacgtgctgttgtactgctcctcccgcggctttgtcttggcattatgcacctccacgccgtccacgtaccagttgaacttgacctcagggtcttcgtggctcacgtccaccaccacgcatgtgacctca

SEQ ID NO: 295901 - DNA, 267 bp, Homo sapiens
  misc_feature: NA.25.11.A11.1.454.heavy.1.nb
tgagagtcatggacctcctgtgcaagaacatgaaacacctgtggttcttcctcctgctggtggcggctcccagatgggtcctgtcccagttgcagctgcaggagtcgggcccaggactggtgaagccttcggagaccctgtccctcacctgcactgtctctggtgctccatcaggactactagtcactactgggcctggactccgccacgcccccagggaagggctggagtggattggcagtacatatcatactgggagaaccttct

SEQ ID NO: 295902 - DNA, 178 bp, Homo sapiens
  misc_feature: NA.25.11.A11.2.454.heavy.1.nb
tatgcgccttgccagcccgctcagactgtacagtggaagtagtccttgaccaggcagcccagggccgctgtgcccccagaggtgctcctggagcagggcgccagggggaagaccgatgggcccttggtggaaggtgaggagacggttaccagggttccctggccccagtcacttgctc

SEQ ID NO: 295903 - DNA, 371 bp, Homo sapiens
  misc_feature: NA.25.12.B01.1.454.heavy.1.nb
tggagatggttttctcgatgggggctggagtggctttcatacattagtggaagtggtcatgacattaactacgcagactctgtgaagggccgattcaccatctccagggacaacgccaggaagtccctctatctgcgactgagcaacctgagagtcgaagacacggccatttactactgtacgacagacccccgagatgtgactcctggggcccgggaaccctggtctccgtctcctcagcctccaccaagggcccatcggtcttcccctggcaccctcctccaagagcacctcgagagcacagcggccctgggctgcctggtcaaggactacttccactgtacagtctgagcgggctggcaaggcgcata

SEQ ID NO: 295904 - DNA, 268 bp, Homo sapiens
  misc_feature: NA.25.22.B11.2.454.heavy.1.nb
gaagcctcccccagagttcccaggagtttccattcggtgatcagcactgaacacagaggactcaccatggagtttgggctgagctgggttttccttgttgctcttgtaaaaggtgtccattgtcaggtgcagttggtgcagtcgtgggggagcttcgtcaagcctggagggtccctgagactctcctgtgaagtctctggattcaccatcaatgactatttatggcctggatccgccaggctccgagggaagggctggagtggatttc

SEQ ID NO: 295905 - DNA, 309 bp, Homo sapiens
  misc_feature: NA.25.23.C01.2.454.heavy.1.nb
tgttggagaccctgtccctcacctgcagtgtctctggtggctccgtcagtgcttattactggagctggatccgccagtccgccgggaggggactggagtggattgggcgtatatatacgaatggattaaccacctacaacccctccctcaagagtcgagtcaccatatcagcggacacgtccagggatcaggtgttcctgcatctgacttctgcgactgccgcggacacggccctatactactgtgccagagattcggactgcgacgatttttcggagaattattatctttagtgtcttttgacattgg

SEQ ID NO: 295906 - DNA, 107 bp, Homo sapiens
  misc_feature: NA.25.23.C01.4.454.heavy.1.nb
tatgcgccttgccagcccgctcagactgtacagtggaagtagccttgaccaggcagcccagggccgctgtgcccagcacctgaactcctgggggaccgtcagtcttc

SEQ ID NO: 295907 - DNA, 153 bp, Homo sapiens
  misc_feature: NA.25.25.C03.2.454.heavy.1.nb
tatgcgccttgccagcccgctcagactgtacagtggaagtagtccttgaccaggcagcccagggccgctgtgcccccagaggtgctcctggagcagggcgccagggggaagaccgatgggcccttggtggaagctgacgagaccgtgaccagg

SEQ ID NO: 295908 - DNA, 126 bp, Homo sapiens
  misc_feature: NA.25.28.C06.1.454.heavy.1.nb
agagcccaaatcttgtgacacacctcccccgtgcccaaggtgcccagaggtgctcctggagcagggcgccaggggaagaccgatgggcccttggtggaagctgaggagacggtgaccagggtgccc

SEQ ID NO: 295909 - DNA, 112 bp, Homo sapiens
  misc_feature: NA.25.28.C06.2.454.heavy.1.nb
gggcaccttgagcactgaacgcagcggactcaccatggagtttgggctgaactgggttttcctcgttgctcttttaagaggtgtccagtgtcaggcgcatctggtggagtct

SEQ ID NO: 295910 - DNA, 351 bp, Homo sapiens
  misc_feature: NA.25.28.C06.3.454.heavy.1.nb
gggggaggcgtggtccagcctgggaagtccctgagactctcctgtgtggcgcctagactcaccttcagtagttatggcttcgtctgggtccgccagtgtccaggcaaggggctggagtggctgggagttacttggtctgacagacaaatgacatatcacgcggagtccgtgaggggccattcaccatctccagggacaattccaagagaaccctctatctgcaaatgaacaacttgagagtcgaggatacggccgtttattactgtgcgacctcaggagtggctaggaaaagtcgtagtctcattcccgtcgacctctggggccagggcaccctggtccaccgtctcctca

SEQ ID NO: 295911 - DNA, 16 bp, Homo sapiens
  misc_feature: NA.25.28.C06.4.454.heavy.1.nb
gggcaccgtggagtct

SEQ ID NO: 295912 - DNA, 327 bp, Homo sapiens
  misc_feature: NA.25.33.C11.1.454.heavy.1.nb
gagaggagccccagccctgagattcccaggcgtttccattcggtgatcagcactgaacacagagaacgcaccatggaggttggactgagctgggttttccttgttgttttttaaaaggtgcccagtgtgaagtgcggctggaggagtctgggggaggcgtggtacagccggggggtcccttagactctcctgtaaagtctctggattcaattttgatgaatatactatgcactgggtccgtcaggctcaggggacgggtctagagtgggtctctcttataaattgggatggttccagtatagactatgtaggctctgtgaagggccg

SEQ ID NO: 295913 - DNA, 126 bp, Homo sapiens
  misc_feature: NA.25.33.C11.4.454.heavy.1.nb
gtggcgcctagactcaccttcagtagttatggcttcgtctgggtccgccagtgtccaggcaaggggctggagtggctgggagttacttggtctgacagacaaatgacatatcacgcggagtccgtg

SEQ ID NO: 295914 - DNA, 106 bp, Homo sapiens
  misc_feature: NA.25.33.C11.5.454.heavy.1.nb
tatgcgccttgccagcccgctcagactgtacagtggaagtagtccttgaccaggcagcccagggccgctgtgcccagcacctgaactcctgggggaccgtcagtct

SEQ ID NO: 295915 - DNA, 289 bp, Homo sapiens
  misc_feature: NA.25.35.D02.1.454.heavy.1.nb
gaggagcccagcactagaagtcggcggtgtttccatccggtgatcagcactgaacacagaggactcagcatggagtttgggctgcgctgggttttcctcgttgctcttttaagaggtgtccagtgtcagatgcaactggcggaggtcggggggagcgtggtccaggccggggaagtccctgagactctcctgtgcagtgtccgcgtccaccttccgtcgttttggcattcactgggtccgccaggctccaggcaagggctggagtgggtggcggtcatagtggtgggat

SEQ ID NO: 295916 - DNA, 281 bp, Homo sapiens
  misc_feature: NA.25.36.D03.10.454.heavy.1.nb
gtgggagaggagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggagcgtggtccagcctgggagtccctgagactctcctgtgaagcctctggatttagttcagtggttctggcatgcactgggtccgccaggctccgaggcaaggggccgagtggttggcagtta

SEQ ID NO: 295917 - DNA, 104 bp, Homo sapiens
  misc_feature: NA.25.36.D03.12.454.heavy.1.nb
tatgcgccttgccagcccgctcagactgtacagtgaggagggtgggaacagagtgaccgaggggcagccttgggctgacttaggacggtcagcttggtccctcc

SEQ ID NO: 295918 - DNA, 406 bp, Homo sapiens
  misc_feature: NA.25.36.D03.5.454.heavy.1.nb
gggagggcctgaagtgggtcggcctcatgagaccgagggcctctggagggacagtggagcatgacgcgtctctgatgggcaggttcagcctctcaagggacgactctaaagccatcgcctatctgcaaatgaccagcctgacagtcgaagactcagccatctattattgtgcgagactgcctgtctctgattcggggacttattggacgaactacttcacttattcccacatggacgtttggggcaaggggaccacggtcaccgtctcctcagcctccaccaagggcccatcggtcttccccctggcgccctgctccaggacgcacctcgagagcacagcggccctgggctgcctggtcaaggactacttccactgtacagtctgagcgggctggcaaggcgcata

SEQ ID NO: 295919 - DNA, 304 bp, Homo sapiens
  misc_feature: NA.25.36.D03.8.454.heavy.1.nb
ggagaggagccccagccctgagattcccaggtgtttccattcagtgatcagcactgaacacagaggactcaccatggagttgggactgagctggattttcctttggctattttaaaaggtgtccagtgtgaagtgcaactggtggagtcgtgggggagcttggtacagcctggcaggcccctgagactctcctgtgcagcctctggattcacctttgatgattatgccatgcacgtgggtccggcaagctccgaggggaggccgtggagtgggtctcgaggttattagttggaataggtggtag

SEQ ID NO: 295920 - DNA, 306 bp, Homo sapiens
  misc_feature: NA.25.36.D03.9.454.heavy.1.nb
aaccagattcttcctctaaagaacgcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtggacatcaaccgcacgccggaacaacagaggtcgcacatcagtttcagggcaga

SEQ ID NO: 295921 - DNA, 324 bp, Homo sapiens
  misc_feature: NA.25.37.D04.1.454.heavy.1.nb
  modified_base (283)..(283): a, c, t, g, unknown or other
  misc_feature (283)..(283): n is a, c, g, or t
gagcccagcactgggattccgaggtgtttccattcggtgatcagcactgaacacagaggactcaccatggcgttttggctgagctgggttttccttgttgctgttttaaaaggtgtccagtgtgaggtgcagctggcggagtctggaggaggcctgatccagccgtggggggtccctgagactctcctgtgcagcctctgggttcagcgttagtcacagctacttgatctgggtccgccaggctccgaggggaaggggctgggagtgcgtctcagttatttanagcgataataccacctactacgcagactccgtgaacgggcc

SEQ ID NO: 295922 - DNA, 300 bp, Homo sapiens
  misc_feature: NA.25.38.D05.1.454.heavy.1.nb
gagcccagcactagaagtcggcggtgtctccattcggtgatcagcactgaacacagaggactcaccatggagtttgggctgagctgggttttcctcgttgcttcttttaagaggtgtccagtgtcaggtgcagctggtggagtcgtgggggagcgtggtccagcctgggaagtccctgagactctcctgtgcaacatctggattcgccttcagtaactttggcatccactgggtccccaggctccaggcaagggctagagtgggtacttttagtgggcatgatggcagtgataaagctat

SEQ ID NO: 295923 - DNA, 99 bp, Homo sapiens
  misc_feature: NA.25.38.D05.3.454.heavy.1.nb
tatgcgccttgccagcccgctcagactgtacagtgaggagggcgggaacagagtgacagtggggttggccttgggctgacctaggacggtcagcttggt

SEQ ID NO: 295924 - DNA, 381 bp, Homo sapiens
  misc_feature: NA.25.4.A04.1.454.heavy.1.nb
caagcctccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtccctgacactctcctgcacagcttccggactcacctttggtgagcatgctatgacctgggtccgccaggctccgagggagggtctggagtggcttgggttcattagaagcgaagcctagtggtgggcaacacaatacgccgcgtctgtaaaaggcagattcagcctctcaagagatgattaccaaagcatcgcctatctgcacat

SEQ ID NO: 295925 - DNA, 303 bp, Homo sapiens
  misc_feature: NA.25.4.A04.3.454.heavy.1.nb
cagtcctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtgttatcactactggagctggatccgccagcacccagggaagggcctggagtggattgggtacatctattaccgtgggagcaccttctacaacccgtcctcaatacgtcgagtcaccatctcattagac

SEQ ID NO: 295926 - DNA, 354 bp, Homo sapiens
  misc_feature: NA.25.41.D08.1.454.heavy.1.nb
ggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggcccatcggtcttccccctggcgccctgctccaggagcacctccgagagcacagcggccctgggctgcctggtcaaggactacttccactgtacagtctgagcgggctggcaaggcgcata

SEQ ID NO: 295927 - DNA, 328 bp, Homo sapiens
  misc_feature: NA.25.46.E02.1.454.heavy.1.nb
gttggccgtattaagaccaatagtgaaggtgggacaagagactacgctgcatccgtgaaagacagattcaccatctcaagggatgattcaaagaccacgctgtatctgcagatgaacagcctgaaggtcgaggacacagccgtttattactgtacctcctttgaaagcaactcgggggactactggggccagggaaccctggtcaccgtctcctcagcctccaccaagggcccatcggtcttccccctggcgccctgctccaggagcacctccgagagcacagcggccctggctgcctggtcaaggctacttccactgtacagtctga

SEQ ID NO: 295928 - DNA, 503 bp, Homo sapiens
  misc_feature: NA.25.53.E09.1.454.heavy.1.nb
gagcccagcactagaagtcggcggtgtttccattcggtgatcagcactgaacacagaggactcaccatggagtttgggctgagctgggttttcctcgttgctcttttaagaggtgtccactgtcaggtgcacctggtggagtcgtgggggaggcgtggtccagcctgggaggtccctgagactctcctgtgaagcctctggatttagtttcagtggttctggcatgcactgggtccgccaggctccaggcaagggggccggagtggttggcagttatagcacatgatggaagttctgaatattatgcagactccgtgaagggccattcaccatctccagagacaattcccggaacattgtgtacttggaaatggtcagcctgagagtcgaggactcggctctgtattactgtgcgagatcgggaggtggtagtagttagttaccgggcgcagtgacgtgggggccaggggaccctgggtccaccgtctcctcacgcctccacc

SEQ ID NO: 295929 - DNA, 367 bp, Homo sapiens
  misc_feature: NA.25.53.E09.2.454.heavy.1.nb
ctcataagggaaatgctttctgagagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggacggcctggagtggattgcgattgtctttcatagtgggagtgcctactacagtccctccctcaagagtcgagtcaccagtttcggttgacacgtccacgcagcagttgtctctgacactgacgtctg

SEQ ID NO: 295930 - DNA, 181 bp, Homo sapiens
  misc_feature: NA.25.53.E09.4.454.heavy.1.nb
gttcagcgttagtcacagctacttgatctgggtccgccaggctccagggaaggggctggagtgcgtctcagttatttatagcgataataccacctactacgcagactccgtgaagggccgattccttatctccagagacaattccaggaacaccctctatcttcaaatgaacgccctgagg

SEQ ID NO: 295931 - DNA, 129 bp, Homo sapiens
  misc_feature: NA.25.57.F02.2.454.heavy.1.nb
tatgcgccttgccagcccgctcagactgtacagtgaggagggcgggaacagagtgaccagggggcagccttgggctgacctaggacggtcagcttggtccctccgccgaacaccgtcggaccactcaga

SEQ ID NO: 295932 - DNA, 415 bp, Homo sapiens
  misc_feature: NA.25.59.F04.1.454.heavy.1.nb
ggttttccttgtcgctattttagaaggtgtccagtgtgaggtggtgctggtggagtctgggggaggcctggtcaagcctggggggtcccgaagactctcttgtgcagcctctggattcaacttcaaaggctacagcatgaactggatccgccaggctccggggaaggtctgcagtggatttcatccattagtggtcttaagcgtgactaaattttatgcagactcggtgaacggccggttcaccatctccagagacaacgccgacgactttctctttctgcaaatgaacagcctcagagccgaggacacggctgtttattctgtgcgagaggagtgggcgaaaactggctctacggaggtgatgcttttgatttctggggccaagggactatggtcaccgtctcttcagcctcac

SEQ ID NO: 295933 - DNA, 350 bp, Homo sapiens
  misc_feature: NA.25.60.F05.1.454.heavy.1.nb
ggattggggagtgtcgcttatagtgggaccacctactacaacccgtccctcaagagtcgattcaccatatcagtggacacgtcccagaaccagttctccctgaagttgaattttgtgaccgccgcggacacggccctatattattgtacggcaggggcgacagcagatggtggagcaagtgactggggccagggaaccctggtaaccgtctcctccacctccaccaagggcccatcggtcttccccctggcaccctcctccaagagcacctctgggggcacagcggccctgggctgcctggtcaaggactacttccactgtacagtctgagcgggctggcaaggcgcata

SEQ ID NO: 295934 - DNA, 217 bp, Homo sapiens
  misc_feature: NA.25.61.F06.1.454.heavy.1.nb
gtttcatacattagtagtagtggtagtaccatatactacgcagactctgtgaagggccgattcaccatctccagggacaacgccaagaactcactgtatctgcaaatgaacagcctgagagccgaggacacggccgtgtattactgtgcgagagacagttacgatattttgactggttattatgggggggcctacgtactactactacatggacgtc

SEQ ID NO: 295935 - DNA, 295 bp, Homo sapiens
  misc_feature: NA.25.62.F07.1.454.heavy.1.nb
gattgggcgtctctatagtagtagggcgtcgaggtacaatccttccctcgagagccgagtcaccatgtcgctggacaggtcctccaatcagttctccctgaggctgacctctgtgaccgccgcagacacggccgtgtattattgtgcgagagaaaatgggggggagcagagttttgacgaggaaagtggtggtaatgtcggctaccttgacctctggggccagggaatcctggtcaccgtctcctcagcttccaccaagggcccatcggtcttcccctggcgccctgcttccagg

SEQ ID NO: 295936 - DNA, 332 bp, Homo sapiens
  misc_feature: NA.25.66.F11.1.454.heavy.1.nb
agccttgggattcccaagtgttttcattcagtgatcaggactgaacacagaggactcaccatggagtttgggctgagctggattttccttgcagctattttaaaaggtgtccactgtgaggtgcagctggtggagtctgggggaggcttgggtgaaacctgggggatccctcagactctcctgtgcagcctctaggttccctttcaagaacgcctggatgagttgggtccgccaggctccgagggaaggggctggagtgggtggccgtattaagaccaatagtgaaggtgggacaagagactacgctgcatccgtagaaagacagattcacc

SEQ ID NO: 295937 - DNA, 371 bp, Homo sapiens
  misc_feature: NA.25.69.G03.1.454.heavy.1.nb
ggttggccgtcttagaagtaaagttaaaaattacgcgacagcatacgctgcgtcggtgcaaggcagattcaccatctccagagatgattcggaaaacacggcgtatcttcacatgaatagcctgaaagacgacgacacggccacatattactgtattccccgagttgaaatcctcgcgaccagaatcctcgtattacatggagttctggggcaaagggaccaaggtcaccgtctcctcagcctccaccaaggcccatcggtcttccccctggcagccctgctccagagcacctctggggcacagcggccctgggctgcctggtcaaggactacttccactgtacagtctgagcgggctggcaaggcgcata

SEQ ID NO: 295938 - DNA, 277 bp, Homo sapiens
  misc_feature: NA.25.7.A07.1.454.heavy.1.nb
ccctccttgggagaatcccctagatcacagctcctcaccatggactggacctggagcatccttttcttggtggcagcagcaacaggtgcccactcccaggttcaactggtgcagtctggacctgaggtgaagaagcctggggcctcagtgaaggtctcctgcaaggcttctggttacacctttagcagctatggcatcagctgggtgcgacaggcccctggacaagggcttgagtggatggcagtggatcagccttaacatggtatcacagactatg

SEQ ID NO: 295939 - DNA, 350 bp, Homo sapiens
  misc_feature: NA.25.70.G04.1.454.heavy.1.nb
gtctcacgtcttaataatgatggcagtaccacaaattacgcggactccgtgaagggccgattcaccatttccagagacaacgccaagaacacggtgtatctgcaaatgagtagtctgagagccgaggacacggctgtctattactgtgcaagaggaggcatagcagcagctggctttgactgctggggccagggaacccctggtcaccggtctcctcagcctccaccaagggcccatcggtcttcccctggcaccctcctccaagagcacctctggggcacagcggccctgggctgcctggtcaaggactacttccactgtacagtctgagcgggctggcaaggcgcata

SEQ ID NO: 295940 - DNA, 350 bp, Homo sapiens
  misc_feature: NA.25.71.G05.1.454.heavy.1.nb
  modified_base (292)..(292): a, c, t, g, unknown or other
  misc_feature (292)..(292): n is a, c, g, or t
tggattccaaggcctttccacttggtgatcagcactgagcaccgaggattcaccatggaagtggggctccgctgggttttccttgtcgctattttagaaggtgtccagtgtgaggtggtgctggtggagtcgtgggggaggcctggtcaagccgtggggggtcccaagactctcttgtgcagcctctggattcaacttcaaaggctacagcatgaactggatccgccaggctccggggaaggtctgcagtggatttcatccattagtggtcttaagcgtgactaaattttangcagactcggtgaacggccgttcaccatctccagacgacaacgccgacgtactttctc

SEQ ID NO: 295941 - DNA, 294 bp, Homo sapiens
  misc_feature: NA.25.71.G05.2.454.heavy.1.nb
ctggactccaaggcctttccacctggtgatcagcactgagcacagaggactcaccatggaattggggctgagctgggttctccttgttgctattttagaaggtgtccagtgtgaggtgcagttggaggagtcgtgggggaggcttggtccaggccgggggggtccctgagactctcctgtgcagcctctggattcagttttagcagtattttggatgagctgggtccgccaggccccaggggaaggggctgggtgtgggtagccaatacacgaagatggaggtgagaaatacta

SEQ ID NO: 295942 - DNA, 86 bp, Homo sapiens
  misc_feature: NA.25.75.G09.2.454.heavy.1.nb
gtggcatctgggagccagagtagcaggaggaagagaagctgcgctggggcttccatggttccgtctgggtcctaactgagcagttc

SEQ ID NO: 295943 - DNA, 349 bp, Homo sapiens
  misc_feature: NA.25.76.G10.1.454.heavy.1.nb
gccctggattccaaggcctatccacttggtgatcagcactgagcaccgaggattcaccatggaactggggctccgctgggttttccttgttgctattttagaaggtgtcctgtgtgaggtgcaactggtggagtcgtgggggaggcctggtcaagccgtggggggtccctgagactctcctgtgtagcctccggattcagcttcagcaaatatagtgtgaactgggtccgccaggctccgaggggaaggggctgggagtgggtcgcattcgtgagtagtagtagtacttataaatactacgcagagtcagtggagggccgattcactatctccagagacaacaccaaga

SEQ ID NO: 295944 - DNA, 354 bp, Homo sapiens
  misc_feature: NA.25.77.G11.1.454.heavy.1.nb
gattgggagtgtttattatacaggggccacttggcgttacccgcccctcaggagtcgcgtttcgatgtccgttgacacggccacgaatcacttcaccctgaccctaacgtctgtgaccgccgcagacgcggccatatactattgtggggcgagtctgccgtcatacagtagtggccagttcgacctgtggggcccgggaaccctggtcgccgtctcatcggcctccaccaagggcccatcggtcttccccctggcaccctcctccaagagcacctctgggggcacagcggccctgggttgcctggtcaaggactacttccactgtacagtctgagcgggctggcaaggcgcata

SEQ ID NO: 295945 - DNA, 575 bp, Homo sapiens
  misc_feature: NA.25.78.H01.1.454.heavy.1.nb
gagagtcatggacctcctgtggaagaacttgaggcacctgtggttctgcctcctactggtggcggctcccagatgggtcctgtcccagctgcaggagtcgggcccaggactggtgaggccctcggaaaccctgtccctcgcttgcactgtctctttcgactccatcagtagttgtttcttactattggggctggatccggcggcccccgggaaggcctggagtggttgggcagtgtccaatacggtagacctccccactaccgccccatccctcaggggtcgcctcacgttgtcaattgacacctctaagaagcagttctctctgggtctgacttctgtcaccgccgcggacacggccacatactattgtgtctcggacacatgggccgacgactacccctttctctactggggccgggaatcgtggtcaccgtctcctcagcctccaccaagggcccatcggtcttccccctggcaccctcctccaagagcacctctgggggcacagcggccctgggctgcctggtcaaggactacttccactgtacagtctgagcgggctggcaaggcgcata

SEQ ID NO: 295946 - DNA, 290 bp, Homo sapiens
  misc_feature: NA.25.79.H02.1.454.heavy.1.nb
ctgggagttacttggtctgacagacaaatgacatatcacgcggagtccgtgaggggccgattcaccatctccagggacaattccaagagaaccctctatctgcaaatgaacaacttgagagtcgaggatacggccgtttattactgtgcgacctcgaggagtggctggaaaaagtcgtagtctcattcccgtcgacctctggggccagggcaccctggtcaccgtctcctcagcttccaccaagggcccatccggtcttccccctggccgccctgctcccaggacgcacc

SEQ ID NO: 295947 - DNA, 333 bp, Homo sapiens
  misc_feature: NA.25.87.H10.1.454.heavy.1.nb
agagtcatggacctcctgtgcaagaacatgaagcacctgtggttcttcctcctgctggtggcggcgcccagatgggtcctgtcccagctgcgtctgcaggagtcgagcccagggcaggtgaagccttcggagaccctgtccctcacctgctctgtctctggtgactccatcaccagtaatgctcattactggggctggctccgccacgcccccgagggaacggcctggagtggattgcgattgtctttcatagtgggagtgcctactacacgtccctccctcaagagtcgagtcaccatttcggtgacacgtccacgcagcagttgtctctga

SEQ ID NO: 295948 - DNA, 298 bp, Homo sapiens
  misc_feature: NA.26.12.B01.2.454.heavy.1.nb
aggagccccagccctgagactcccaggtgcttccattcagtgatcagcactgaacacagaggactcaccatggagttgggactgaactggattttccttttgacctattttaaaaggtgtccagtgtgaagggcagctggtggagtcgtgggggagacttggtccagcctggcaagtccctaagactctcctgtgtcgcttctggattcacctttgatgaatatgccatgcactgggtcctcgaggccaccgaggggaggggcctgggagtgggtctcgaggtatcagttacaatagt

SEQ ID NO: 295949 - DNA, 99 bp, Homo sapiens
  misc_feature: NA.26.21.B10.2.454.heavy.1.nb
cgcaggaccagactccttcaaggtgatctgggacaagacccatgaagggatggtcagcagcaggagcgtggagcaaagcgtgtccatggtggggcgaca

SEQ ID NO: 295950 - DNA, 224 bp, Homo sapiens
  misc_feature: NA.26.23.C01.2.454.heavy.1.nb
ccagcctgggggctccctgagactctcctgtacaacgtctggattcaacttcaattattatgttctacactgggtccgccaggctccaggcaaggggctggagtgggtggcaggtatgtcacatgatggattcagtagatactacatagactccgtgaagggccgatcgaccatcctccagagacgttccgagaacacattaaatctaggaaattaaacttcgt

SEQ ID NO: 295951 - DNA, 112 bp, Homo sapiens
  misc_feature: NA.26.26.C04.2.454.heavy.1.nb
ggagactgcgtcatcactatttctgccggtggaatctgggagccagagtagcaggaggaagagaagctgagctggggcttccatggttccctctgggtcctaactgagcagt

SEQ ID NO: 295952 - DNA, 273 bp, Homo sapiens
  misc_feature: NA.26.40.D07.1.454.heavy.1.nb
cagcacccagcaaccacatctgtcctctagagaatcccctgagagctccgttcctcaccatggactggacctggaggatcctcttcttggtggcagcagccacaggagtcccctcccaggtgcacgttggtgcagtctggggctgaggtgaagaagccgtggggcctcagtgaaggtctcctgcaaggcttctgcatataccttcagcaaccactacatgcacgtgggtgcgacaggcccctggacaagggcttgagtggatgggactgactc

SEQ ID NO: 295953 - DNA, 282 bp, Homo sapiens
  misc_feature: NA.26.42.D09.1.454.heavy.1.nb
tactttctgagagtcctggacctcctgtgcaagaacatgaaacacctgtggttcttcctcctgctggtggcagctcccagatgggtcctgtcccagttccagctgcaggagtccggctcaggactggtgaagccttcacagaccctgtccctcacctgcactgcctctggtgctccatcagtagtggtgttactcgtgggctggatccggcagccacgagggaagggcctggagtggattggctacatctatcatacgtgggacacctactacaacccgtcc

SEQ ID NO: 295954 - DNA, 258 bp, Homo sapiens
  misc_feature: NA.26.5.A05.1.454.heavy.1.nb
ccctccttgggagaatcccctagatcacagctcctcaccatggactggacctggagcatccttttcttggtggcagcagcaacaggtgcccactcccaggttcagttgctgcagtctggagctgagatgaagaagcctggggcctcagtgaaggtctcctgtcaggcttctggttacaactttcgtgaccatggtatcagctgggtgcgacaggcccctggacaagggcttgagtgggtgggatggatcgagccctta

SEQ ID NO: 295955 - DNA, 417 bp, Homo sapiens
  misc_feature: NA.26.57.F02.1.454.heavy.1.nb
  modified_base (315)..(315): a, c, t, g, unknown or other
  misc_feature (315)..(315): n is a, c, g, or t
ggaggagctccagccttgggattcccagctgtctccactcggtgatcggcactgaatacaagagactcaccatggagtttgggctgagctgggttttccttgttgctattttaaaaggtgtccagtgtcaggtgcagctggtggagtccgggggaggcttggtccaggccgggggggtccctgaaactctcatgtgcaggctctggattcacattcagtgactcggctatatactgggtccgccagtctgccgggaaagggctggagtggcttggccgtattagaaccaaacctgacaagtacgcgacaatttangctgcgtcggtgcaaggcaggttcaccatctccagagatgattcagagaacacggcgtatctgcaaatgaacagacctagaaaccgaggacacggccgtgta

SEQ ID NO: 295956 - DNA, 107 bp, Homo sapiens
  misc_feature: NA.26.57.F02.2.454.heavy.1.nb
accgcttcagcccaaactccggactggtgagtctcttccgtaacttacgagtcgccgatcaccgagtcgggacgacaggctgggaatcccaaggctgggaggctcct

SEQ ID NO: 295957 - DNA, 457 bp, Homo sapiens
  misc_feature: NA.26.60.F05.1.454.heavy.1.nb
  modified_base (235)..(235): a, c, t, g, unknown or other
  misc_feature (235)..(235): n is a, c, g, or t
cccagccctgggattttcaggtgttttcatttggtgatcaggactgaaccgagagaactcaccatggagtttgggctgagctggctctttcttgtggcttttttaaaaggtgtccagtgtgaggtgcaactgttggcgtcgtgggggagacttggtacacccgtggggggtccctgagactctcctgtgcagcctctggattcacctttagcaactctgtcatgggctgggtccncaggctccggggaagggctggcgtgggtctcaagtattgatgagaatggtggaagcacattctacgtagactccgtgaagggccgcttcaccatctccagagacaatttcaggagcacgctgtttctgcaaatgaacagcctgagagccgaggacacggccctctatttctgtgcgaaagtctatagcagtgccccctagcgcacttctttgacttcgtggg

SEQ ID NO: 295958 - DNA, 293 bp, Homo sapiens
  misc_feature: NA.26.71.G05.2.454.heavy.1.nb
ctgtgccccaccatggacacgctttgctccacgctcctgctgctgaccatcccttcatgggtcttgtcccagatcaccttgaaggagtctggtcctgcgctggtggagcccacgcagaccctcacgctgacctgctccgtctctggattctcactcaccacgactgaggtgaatgtggcctgggtccgtcaggcccccggaaaggccctggagtggcttgcactcatttactggagtgatctcaagcggtacaatccgtctctgagaatcgactcaccatcaccaggacacct

SEQ ID NO: 295959 - DNA, 335 bp, Homo sapiens
  misc_feature: NA.26.72.G06.2.454.heavy.1.nb
accacacccctccttgggagaatcccctagatcacagctcctcaccatggactggacctggagcgtccttttcttggtggcagcagcgacaggtgcccactcccaggttcagctggtgcagtctggaggtgaggtgaagaagcctggggcctcagtgaacgtctcctgcaaggcttctggttacagctttaccgactatggtatcacctgggtgcgacaggcccctggacaaggacttgagtggatgggatggatcagcccttataatggtaacacgaagtatgcaccgaagctccagggcagactctccatcgaccacagacacatccacgagc

SEQ ID NO: 295960 - DNA, 259 bp, Homo sapiens
  misc_feature: NA.26.73.G07.1.454.heavy.1.nb
ccctcctaagaagaagcccctagaccacagctccacaccatggactggacctggaggatcctcttcttggtggcagcagcaacaggtgcccactcccaggtgcagctggtgcaatctgggtctgagtggaagaggcctggggcctcagtgacggtttcctgcagggcctctgggtacacgatcactacccatgctatcaactgggtgcgacaggcccctggacaaggacttgagtggttggatggatcaacaccaacac

SEQ ID NO: 295961 - DNA, 329 bp, Homo sapiens
  misc_feature: NA.26.78.H01.2.454.heavy.1.nb
ctgctggagggcacggtcaccacgcagctggtggagtctgggggaggcgtggtccagcctgggaggtccctgagactctcctgtgcagcctctggattcaccttcagttactatactatgcactgggtccgccaggctccaggcaaggggctggagtgggtggcagttatatcatatgatggaagcagcacatattacacagactccgtgaagggccgattcaccatctccagagacaatttgaagaacacgctgtatctgcaaatgaacagcctgagagctagaagacacggctgtgttttactgtgcgagagagatgacgatgtaca

SEQ ID NO: 295962 - DNA, 63 bp, Homo sapiens
  misc_feature: NA.26.78.H01.3.454.heavy.1.nb
cctgggctgcctggtcaaggactacttccagtatagtctctgagcgggctggcaaggcgcata

SEQ ID NO: 295963 - DNA, 351 bp, Homo sapiens
  misc_feature: NA.26.80.H03.1.454.heavy.1.nb
cccagcaaccacatctgtcctctagagaatcccctgagagctccgttcctcaccatggactggacctggaggatcctcttcttggtggcagcagccacaggagcccactcccaggtgcagctggtgcagtctggggctgaagtgaagaagcctggggcctcagtgaaggtctcctgcaaggcttctggatacaccttcaccgcctactatatccactgggtgcggcaggcccctggacaagggcttgagtggatgggacacatcagccctaacactggtgacacaaactatgcacagagatttcagggcagggtcaccatgaccacggacacgtccataagcacagttaca

SEQ ID NO: 295964 - DNA, 384 bp, Homo sapiens
  misc_feature: NA.26.86.H09.1.454.heavy.1.nb
ggaagggactggagtggattggggaagtctttcatactgggacccccgactacaacccgtccctcgagggtcgagtcgtcatatcgttagacaagtccaagaaccagttctccctgaggctgacttccgtgaccgccgcggacacggccgtctattactgtgcgagggtggtcggggacttcgaagatatggactatttgtattactacatggacgtctggggcaaagggaccacggtcaccgtctcctcagcctccaccaagggcccatcggtcttccccctggcaccctcctccaagagcacctctggggcacagcggccctgggctgcctggtcaaggactacttccagtatagtctctgagcgggctggcaaggcgcata

SEQ ID NO: 295965 - DNA, 356 bp, Homo sapiens
  misc_feature: NA.27.42.D09.1.454.heavy.1.nb
attggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattagttggggccagggaaccctggtcaccgtctcctcagcctccaccaagggcccatcggtcttccccctggcaccctcctccaacgagcacctctgggggcacagcggccctgggctgcctggtcaaggactacttccagacgacgctctgagcgggctggcaaggcgca

SEQ ID NO: 295966 - DNA, 420 bp, Homo sapiens
  misc_feature: NA.27.57.F02.1.454.heavy.1.nb
gaggagccttagccctggactccaaggcctttccacttggtgatcagcacggagcacagaggacccacatggaactggggctgagctgggttttccttgttgctattttagaaggtgtccagtgtgaggtgcaactggtggattctggaggaggtgtggtccagcctggagaatccctgagactctcctgtgcagcctctggattcacctttagtagttattggatgagctgggtccgccagactccagggaaggggctggagttcgtggccaacataaaccaagatggaaggtaaagaaaactatgtggactctgtgaagggccgattcaccatctccagagacaacgccaagaagtcactgtatctgcaaatgaacagcctgagagccgaggacacggctgtatactactgtgcgaga

SEQ ID NO: 295967 - DNA, 606 bp, Homo sapiens
  misc_feature: NA.28.57.F02.1.454.heavy.1.nb
ccccgccctgggtttcccaggtgttctcatttggtgatcagcactgcacacagaagagtcatgacggagtttgggctgagctgggttttccttgttgctatttttaaaggtgtccagtgtgaggtgcagctggtggagtcgtgggggaggcttggtccagccgtggggggtccctgagactctcctgtgcagcctctggattcaccttcagtatttatgctatgcactgggtccgccaggctccagggaagggactggaatatgtctcaggtattagaagtaatgcgaataacatatattatgcaaactctgtgaagggcagattcaccatctccagggacaattccaagaacacgctgtatcttcaaatgggcagcctgagagctgaggacacggctgtatattactgtgggagaggagcggaattggaactagggttgtggggccagggagccctggtcaccgtctcctcagcctccaccaagggcccatcggtcttcccctggcgccctgctccaggagcacctccgagagcacagcggccctgggctgcctggtcaaggactacttccatagcgtactctgagcgggctggcaaggcgcata

SEQ ID NO: 295968 - DNA, 182 bp, Homo sapiens
  misc_feature: NA.28.85.H08.1.454.heavy.1.nb
tatgcgccttgccagcccgctcagagtacgctatgaggaggcgggaacagagtgaccgagggggcagccttgagctgacctaggacggtcagcttggtccctccgccgaagatcacagtgcgggtgcctgcaaatgagcagcagtaataatcaccgtcatcgtcagcctggagcccagagat

SEQ ID NO: 295969 - DNA, 104 bp, Homo sapiens
  misc_feature: NA.28.89.I01.1.454.heavy.1.nb
tatgcgccttgccagcccgctcagagtacgctatgaggagggcgggaacagagtgaccgagggggcagccttgggctgacctaggacggtcagtttggtccctc

SEQ ID NO: 295970 - DNA, 534 bp, Homo sapiens
  misc_feature: NA.29.14.B03.1.454.heavy.1.nb
tcttgtggctattttaaaaggtgtccagtgtgacgtgcagttggtggagtctgggggcgcctgggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccggggcccgacttgaccacgtggggccagggggacgctggtcaccgtctcctcagcctccaccaagggcccatcggtcttccccctggccaccctcctccaagagcacctctgggggcacagcggccctgggctgcctggtcaaggactacttccagtactctatctgagcgggctggcaaggcgcata

SEQ ID NO: 295971 - DNA, 277 bp, Homo sapiens
  misc_feature: NA.29.24.C02.1.454.heavy.1.nb
tgtgccccaccatggacacactttgctccacgctcctgctgctgaccatcccttcatgggtcttgtcccagatcaccttgaaggagtctggtcctacgctggtgaaacccacacagaccctcacgctgacctgcaccttctctgggtttacactcgaaactactggagtgggtgtggcctggatccgtcagcccccaggaaacggcccttgaatggcttgcactcatttattggaatgatgatgagcgctacagcccatctctgcagaacgagggtc

SEQ ID NO: 295972 - DNA, 88 bp, Homo sapiens
  misc_feature: NA.29.25.C03.1.454.heavy.1.nb
tatgcgccttgccagcccgctcagatagagtactggaagtagtccttgaccaggcagcccagggccgctgtggcaggaccgtcagtct

SEQ ID NO: 295973 - DNA, 342 bp, Homo sapiens
  misc_feature: NA.29.27.C05.2.454.heavy.1.nb
acgtattaatagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttccccctggcgccctgctccaggagcacctccgagagcacagcggccctgggctgcctggtcaaggactacttcctatgtatactctgagcgggctggcaaggcgcata

SEQ ID NO: 295974 - DNA, 243 bp, Homo sapiens
  misc_feature: NA.29.30.C08.1.454.heavy.1.nb
gagtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcata

SEQ ID NO: 295975 - DNA, 230 bp, Homo sapiens
  misc_feature: NA.29.30.C08.2.454.heavy.1.nb
  modified_base (215)..(215): a, c, t, g, unknown or other
  misc_feature (215)..(215): n is a, c, g, or t
ggtctcaagtattgctggtagtggtgatagcacatactacgcagccatcgtgaagggccggttcaccatctccagggacagttcgaagaacacactgttctgcaaatgaacagcctgagagtcgaggacacggccgtatattactgtgcgctttcaccctggagtgggagttacaaggcatacttccaccactgggccgggcacctggtcagcgntctcctcacgcctcc

SEQ ID NO: 295976 - DNA, 107 bp, Homo sapiens
  misc_feature: NA.29.34.D01.2.454.heavy.1.nb
tatgcgccttgccagcccgctcagcgtagactagggaagtagtccttgaccaggcagcccagggccgctgtgcccagcacctgaactcctggggggaccgtcagtct

SEQ ID NO: 295977 - DNA, 108 bp, Homo sapiens
  misc_feature: NA.29.37.D04.2.454.heavy.1.nb
tatgcgccttgccagcccgctcagctcgcgtgtcggaagtagtccttgaccaggcagaccagggccgctgtgcccagcacctgaactcctgggggaccgtcagtcttc

SEQ ID NO: 295978 - DNA, 329 bp, Homo sapiens
  misc_feature: NA.29.42.D09.1.454.heavy.1.nb
gattggctacatctatcatactgggagcacctactacaacccgtccctcaacagtcgagtcaccatctcactagacaagtccaactaccagttctccctaaacctgacctctgtgaccgccgctgacacggccgtgtattactgtgcgagagacatatttcactatgatactagtgggctccactcctggggccagggaaccctggtcaccgtctcctcagcctccaccaagggcccatcggtcttccccctggcaccctcctccaagagcacctctgggggcacagcggccctgggctgcctggtcaaggactacttcctatgtatac

SEQ ID NO: 295979 - DNA, 328 bp, Homo sapiens
  misc_feature: NA.29.42.D09.3.454.heavy.1.nb
gattggctacatctatcatactgggagcacctactacaacccgtccctcaacagtcgagtcaccatctcactagacaagtccaactaccagttctccctgaagctgacgtctgtgaccgccgcggacacggccgtgtattactgtgccagagaagtgcggactggccattataaatactactttgattattgggccagggaaccctggtcacgtctcctcagcctcaccaaggcccatcggtcttccccctggcaccctcctccaagagcacctctgggggcacagcggccctgggctgcctggtcaaggactacttccagtactcta

SEQ ID NO: 295980 - DNA, 357 bp, Homo sapiens
  misc_feature: NA.29.5.A05.1.454.heavy.1.nb
ccctcctcagaagcccccagagcacaacgccccaccatggactggacctggaggatcctctttttggtggcagcagccacaggtgcccactcccaggtccagcttgtgcagtctggggctgaggtgaagaagcctggggcctcagtgaaggtttcctgcaaggcttcaggatacaccttcactaggtatgctatacattgggtgcgccaggcccccggacaaaggcttgagtggatgggatggatcaacgctggcaatggtaacaacaaaaaattcaacaagaagttccgagggcagagtacactttaccaggacacatccgcgaggattacttatatggagctgagcagctagaga

SEQ ID NO: 295981 - DNA, 355 bp, Homo sapiens
  misc_feature: NA.29.68.G02.1.454.heavy.1.nb
gtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttcaccactgggccggggcaccctggtcagcgtctcctcagcctccaccaagggcccatcggtcttccccctggcaccctcctccaagagcacctctggggcacagcagccctgggctgcctggtcaaggactacttccacgtagcgtgctgagcgggctggcaaggcgcat

SEQ ID NO: 295982 - DNA, 631 bp, Homo sapiens
  misc_feature: NA.29.70.G04.1.454.heavy.1.nb
gagaagagccccagccttgggattcccaagtgctttcattcagtgagcaggactgaacacagaggactcaccatggagtttgggctgaggtggattttgcttgttaccattttaaaaggtgtccagtgtgcggtgcatttgatgggagtccgggggaggcttggtagagccggggcagtccctgagactctcgtgtgaaggctctggattcacattcagtgacgtctggatgagctgggtccgccagactccgagggaagggctagagtgggttggccgcattacaagtcagagggaccatgggaaagaggactatagtgtccccgtcaagggcagattctcgatttctcgagatgatctgaagaataccgtgtatctacatatgagtggcctgcgagccgaggacacaggcatctactactgcgcgacatcggtgacccagtggcagttgttccttgaagactggggccagggaaccccggtcaccgtctccccagcctccaccaagggcccatcggtcttccccctggccgccctgcctccaggagcacctccgagagcacagcggccctgggctgcctggtcaaggctacttccagtactctatctgagcgggctggcaaggcgcata

SEQ ID NO: 295983 - DNA, 629 bp, Homo sapiens
  misc_feature: NA.29.78.H01.1.454.heavy.1.nb
agactgacggtccacccctgggatcttcaggtgttttcatttggtgatcaggacggaacagagagaactcaccatggagtttgggctgagcgtggtctttttctagtggctattttaaaaggtgtccagtgtgacgtgcagttggtggagtctgggggcgcctggggtacggccgggggggtcgctgagactctcctgtgcggcctctggattaagttttaggagtcatgccatgaactgggtccgccaggctccagggaaggggctggagtgggtctcggctattagtggcagtggtggcgctatatattatgcagacgccctgaagggccggttcaccatttccagagacaattcgaagaacacgctgtatctgcaaatggagagcctgagactcgacgacacggccgtctattattgtgttaaaggcgagctggaatacgggaccgggcccgacttgaccactggggccaggggacgctggtcaccgtctcctcagcctccaccaagggcccatcggtcttccccctggccaccctcctccaagacgcacctctggggcacagcagccctgggctgcctggtcaaggactacttccagtactctatctgagcgggctggcaaggcg

SEQ ID NO: 295984 - DNA, 321 bp, Homo sapiens
  misc_feature: NA.29.81.H04.1.454.heavy.1.nb
aggagccttagccctggattccaaggcctatccacttggtgatcagcactgagcaccgaggattcaccatggaactggggctccgctgggttttccttgttgctattttagaaggtgtccagtgtgaggtgcagctggtggagtctgggggaggcctggtcaaggccgggggggtccctgagactctcctgtgcagcctctggattcatcttcagtagttttagcatgaactgggtccgccaggctccgagggaaggggctgggagtgggtctcatccattagtggtagtaacagtgacagatactacgcagactcagtga

SEQ ID NO: 295985 - DNA, 374 bp, Homo sapiens
  misc_feature: NA.29.85.H08.4.454.heavy.1.nb
ggagccccagccctgagattcccaggtgtttccattcggtgatcagcactgaacacagagaacgcaccatggagtttggactgagctgggttttccttgttgctattttaaaaggtgtccagtgtgaagtgcagctggtggagtctgggggagtcgtggtacagcctggggggtccctgagactctcctgtgcagcctctggattcaagtttaatgtatttttccatacactgggtccgtcaagctccggggaaggtctggagtgggtctctcttattaatcgagacggtgctactacattctatgcagactctgtgaagggccattcaccatctccagagacaacaacaagtacctccctagtatctgcaaat

SEQ ID NO: 295986 - DNA, 350 bp, Homo sapiens
  misc_feature: NA.2.38.D05.2.454.heavy.1.nb
tgtccagtgtgaggtgcagctggtggagtccgggggaggcttagttcagcctggggggtccctgagactctcctgtgcagcctctggattcaccttcagtagctactggatgcactgggtccgccaagctccgagggaaggggctggtgtgggtctcacgtattaatagtgatgggagtagcacaagctacgcggactccgtgaagggccgattcaccatctccagagacaacgccaaagaacacgctgtatctgacaaatgaacagtctgagagccgaggacacggctgtgtattactgtgcaagagatagcagcagctggtacgccgactacgtgggccagggaccct

SEQ ID NO: 295987 - DNA, 333 bp, Homo sapiens
  misc_feature: NA.2.77.G11.1.454.heavy.1.nb
cctgtgcagcctctggattcatcttcagtgactactacatggactgggtccgccaggctccagggaagaggctggagtgggttggccgtattagaaatagagccaagagttacagcacagactacgccgcgtctgtgaaaggcagattcaccatctcaagagatgattcaaagaactcactgtatctgcacatgaacagcctagaaaaccgaggacacggccgtgtatcactgtgttagagatcggagttggagctatgagtacgtggggccagggaaccctggtcaccgtctcctcagcctccaccgaacgggcccagtccggtccttcccc

SEQ ID NO: 295988 - DNA, 359 bp, Homo sapiens
  misc_feature: NA.2.80.H03.1.454.heavy.1.nb
gtcgcgcgcagtcatattgatgggactgtcacaggctacggggactccgtgaagggccgattcaccacctccagagacaacgccaagaacacggtgtatctgcagatccatggtctgacagtcgaggacacggctgtttattactgtgcaagggacggcgggggcacactagctggtactatcctcgtgtctggttcgacacctggggccagggaatactggtcaccgtctcctcagcctccaccaagggcccatcggtcttccccctggcgccctgctccaggagcacctccgagagcacagcggccctgggctgcctggtcaaggctacttcctgtcgagcgtctgagcgggctggc

SEQ ID NO: 295989 - DNA, 415 bp, Homo sapiens
  misc_feature: NA.2.86.H09.1.454.heavy.1.nb
ttgggtacagcctggggggtccctgagactctcctgtgcagcctctggattcacctttagtaactttgtcatgaggtgggtccgccaggctccaggaaaggggctggagtgggtctcagctattgatggtggttctgttgtcccacactacgcggcctccgtgaagggccggttcaccatgtccagagacaattcgaaaaacacgctgtatctgcaaatgaacaccctgagagccgaggacacggccatctattattgtgcgaaggacagtaggggccggcgcgggagcgaatgacttcgtggggccagggaaccctggtcaccgtctcctcagcctccaccgaacgggcccagtccggtccttcccccgtggccgccctgcctccaggacgcacctccgagagcacagcggccc

SEQ ID NO: 295990 - DNA, 278 bp, Homo sapiens
  misc_feature: NA.2.86.H09.2.454.heavy.1.nb
gtacagcctggggggtccctgagactctcctgtgcagcctctggattcacctttagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagatagcagcagctggta

SEQ ID NO: 295991 - DNA, 223 bp, Homo sapiens
  misc_feature: NA.30.1.A01.1.454.heavy.1.nb
ctggctccagctcaggaaacacagcttccttgaccatcactgggctcaggcggaagatgaggctgactattactgtaactcccgggacaccagtggtaacagtcggggagtgttcggcggagggaccaagctgaccgtcctaggtcagcccaaggctgccccctcggtcactctgttcccaccctcctcacgtagcgtgctgagcgggctggcaaggcgcata

SEQ ID NO: 295992 - DNA, 106 bp, Homo sapiens
  misc_feature: NA.30.12.B01.1.454.heavy.1.nb
tatgcgccttgccagcccgctcagcacgctacgtggaagtagtccttgaccaggcagcccagggccgctgtgcccagcacctgaactcctgggggaccgtcagtct

SEQ ID NO: 295993 - DNA, 87 bp, Homo sapiens
  misc_feature: NA.30.12.B01.2.454.heavy.1.nb
gaggtgctcttggaggacgggtggccagggggaagaccgagtgggcccttggtggaggctgaggagacggtgaccgtgccctccagc

SEQ ID NO: 295994 - DNA, 163 bp, Homo sapiens
  misc_feature: NA.30.17.B06.1.454.heavy.1.nb
gggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccct

SEQ ID NO: 295995 - DNA, 245 bp, Homo sapiens
  misc_feature: NA.30.19.B08.1.454.heavy.1.nb
  modified_base (180)..(180): a, c, t, g, unknown or other
  misc_feature (180)..(180): n is a, c, g, or t
ggatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctanaccaagactactgggccagggaaccctggcgccgtctcctcagccctccaccaaggcccatcggt

SEQ ID NO: 295996 - DNA, 164 bp, Homo sapiens
  misc_feature: NA.30.25.C03.1.454.heavy.1.nb
tatgcgccttgccagcccgctcagcacgctacgtggaagtagtccttgaccaggcagcccagggccgctgtgcccccagaggtgctcttggaggagggtgccagggggaagaccgatgggcccttggtggaggctgaggagacggtgaccgtgccctccagcag

SEQ ID NO: 295997 - DNA, 107 bp, Homo sapiens
  misc_feature: NA.30.27.C05.2.454.heavy.1.nb
tatgcgccttgccagcccgctcagcacgctacgtggaagtagtccttgaccaggcagcccagggccgctgtgcccagcacctgaactcctgggaggaccgtcagtct

SEQ ID NO: 295998 - DNA, 241 bp, Homo sapiens
  misc_feature: NA.30.30.C08.1.454.heavy.1.nb
gtgggtggccaacataaaccaagatggaagtgaacagtactatgtggactctgtgaagggccgattcaccatctccagagacaacgccaagaactcactgtctcctcagcctccaccaagggcccatcggtcttcccctggcgccctgctccaggagcacctccgagagcacagcggccctgggctgcctggtcaaggactacttccacgtagcgtgctgagcgggctggcaaggcgcata

SEQ ID NO: 295999 - DNA, 357 bp, Homo sapiens
  misc_feature: NA.30.45.E01.1.454.heavy.1.nb
gatttcatatattagtgctggtgctactaccatgaagtacgcagactctgtgaggggccgattcaccatttccagggacgacgccaagaaatcagtatatctacaaatgagtagcctgagagacgaggacacggctgtgtattactgtgcgggccggggagccactcggaccaccctacaccaagactactggggccagggaaccctggtcgccgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcata

SEQ ID NO: 296000 - DNA, 360 bp, Homo sapiens
  misc_feature: NA.30.68.G02.1.454.heavy.1.nb
ggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgctttcaccctggagtgggagttacaaggcatacttccaccactggggccggggcaccctggtcagcgtctcctcagcctccaccaagggcccatcggtcttccccctggcaccctcctccaagagcacctctgggggcacagcagccctgggctgcctggtcaaggactacttccacgtagcgtgctgagcgggctggcaaggcgcata

SEQ ID NO: 296001 - DNA, 420 bp, Homo sapiens
  misc_feature: NA.31.14.B03.1.454.heavy.1.nb
ctcgttgctcttttaagaggtgtccagtgtcaggtgcacctggtggaatctgggggaggcgtggtccggcctggggggtccctgagactctcctgtgccatgtctgcgtctgaattcatcctcaggcactatggcatgcactgggtccgccaggccccaggcaagggactggagtgggtggcatttatacaatttgatggagataaaaaattttacgcagactccgtgaagggccgattcaccatctccagagacccttccaaccatacgctgtatctccaaatgaacatggtgacagttgaagacacggcaacttattattgtgcgaaagattcgttggttcgagcatcaatgtggatagggtgctcgacacgtgggccagggacacgtggtcaccgtctcctcacgcctcaccaaggg

SEQ ID NO: 296002 - DNA, 87 bp, Homo sapiens
  misc_feature: NA.31.23.C01.1.454.heavy.1.nb
tatgcgccttgccagcccgctcagcagtagacgtgaggagggcgggaacagagtgaccgaggggcagccttgggctgacctaggacg

SEQ ID NO: 296003 - DNA, 355 bp, Homo sapiens
  misc_feature: NA.31.68.G02.1.454.heavy.1.nb
gttgcccgtattaaaagtaaaactgatggtgagacaacagactacgctgcacccgtgaaaggcagattcgccatctcaagagatgattcagagaacacgctgtatctacaaatgaacagcctccaaaccgaggacacagccgtctatttctgtaccacacacatgagtgggagtactacttctactactggggccagggaaccctggtctccgtctcctcggcctccaccaagggcccatcggtcttccccctggcgccctgctccaggagcacctccgagagcacagcggccctgggctgcctggtcaaggactacttccacgtctactgctgagcgggctggcaaggcgcata

SEQ ID NO: 296004 - DNA, 50 bp, Homo sapiens
  misc_feature: NA.33.10.A10.1.454.heavy.1.nb
ccaccaccacgcatgtgacctcaggggtccgggagatcatgagggtgtcc

SEQ ID NO: 296005 - DNA, 328 bp, Homo sapiens
  misc_feature: NA.33.10.A10.2.454.heavy.1.nb
  modified_base (299)..(299): a, c, t, g, unknown or other
  misc_feature (299)..(299): n is a, c, g, or t
agtgtcaggtgcatctggtggagtctgggggaggcgtggtccagcctggggggtccctgagactctcctgtgcagcctctggattcaccttcagttactatggcatgcactgggtccgccaggctccaggcaaggggctggagtggctatcagttatatcacatgatagaaaataatactatgcggactccgtgaagggccattcagcatctccagagacaattccaagaacacgttgtatctgcaaatgaacggtgtgagacctgacgacacggctgtgtatttctgtgacgaaagtnttattacgatgatttgactggttactcgt

SEQ ID NO: 296006 - DNA, 337 bp, Homo sapiens
  misc_feature: NA.33.14.B03.1.454.heavy.1.nb
cttcggcacaatacagtacgcccacaaatttcaagacagagtgcaagttttcgcgaacgaatcaacgaccacagtccacatggagttgaggagcctgacatctgaagacacggccgtatattactgtgcgagagatcaaaatgtggcgcaaagtggttacgggtttgactcctggggccagggaaccctggtcatcgtctcctcagcctccaccaagggcccatcggtcttccccctggcaccctcctccaagagcacctctgggggcacagcggccctgggctgcctggtcaaggactacttccagtgtgtgtactgagcgggctggcaaggcgca

SEQ ID NO: 296007 - DNA, 297 bp, Homo sapiens
  misc_feature: NA.33.28.C06.2.454.heavy.1.nb
tgagagtcatggatctcatgtgcaagaaactgaagcacctgtggttcttcctcctgctggtggcggctcccagatgggtcctgtcccagctgcagctgcaggagtcgggcccgggactggtgaagccttcggagaccctgtccctcacctgcactgtctctggtgctccatcagcagaagtctttactactggggctggatccgccagcccccagggaagggctggagtggattgggaatatctattatagtgggagcagctactacaacccgtcctacaagagtcgagtcaccata

SEQ ID NO: 296008 - DNA, 106 bp, Homo sapiens
  misc_feature: NA.33.28.C06.3.454.heavy.1.nb
tatgcgccttgccagcccgctcagtacacacactggaagtagtccttgaccaggcagcccagggccgctgtgcccagcacctgaactcctgggggaccgtcagtct

SEQ ID NO: 296009 - DNA, 335 bp, Homo sapiens
  misc_feature: NA.33.3.A03.1.454.heavy.1.nb
tccagctcacatgggaaatactttctgagagtcctggacctcctgtgcaagaacatgaaacatctgtggttcttccttctcctggtggcagctcccagatgggtcctgtcccaggtgcagctgcaggagtcgggcccaggactggtgaagccttcggcgaccctgtccctcacctgcacagtctctggtgactccatcaggaattactactggagctggatccggcagcccccagggaggggactggagtggattggttatgtctttcacaatggcaataccgactacaacccctcctcaagagtcgagtcaccacatcagtagacacgtccaag

SEQ ID NO: 296010 - DNA, 276 bp, Homo sapiens
  misc_feature: NA.33.38.D05.1.454.heavy.1.nb
ggagcccagcactagaagtcggcggtgtttccattcggtgatcagcactgaacacagaggactcaccatggagtttgggctgagctgggttttcctcgttactcttttaagaggtgtccagtgtcaggtgcagctggtggagtcgtgggggagcgtggtccagcctgggagtccctcagactctcctgtgcagcgtctggattcaccttcagtagccatgatatgcactgggtccgccaggccccaggcgaaggggctgggagtgggtggcagtta

SEQ ID NO: 296011 - DNA, 106 bp, Homo sapiens; identical to SEQ ID NO: 296008
  misc_feature: NA.33.38.D05.3.454.heavy.1.nb

SEQ ID NO: 296012 - DNA, 300 bp, Homo sapiens
  misc_feature: NA.33.4.A04.1.454.heavy.1.nb
ctggacctcctgtgcaagaacatgaaacacctgtggttctccctcctgctggtggcagctcccagatgggtcctgtcccaggtgcagctgcaggagtcgggcccaggactggtgaagccttcacagaccctgtccctcacctgcactgtctctggtgctccatcaccagtggttatcactactggagctggatccgccagcacccagggaagggcctggagtggattgggtacatctattaccgtgggagcaccttctaccaacccgtccctcaatagtcgagtcaccatctcattagac

SEQ ID NO: 296013 - DNA, 60 bp, Homo sapiens
  misc_feature: NA.33.4.A04.3.454.heavy.1.nb
tagacacgtctaagaaccagttcctccctgaagttgaacgtctgtgactgccgcggacac

SEQ ID NO: 296014 - DNA, 292 bp, Homo sapiens
  misc_feature: NA.33.45.E01.2.454.heavy.1.nb
cgaagccttcggagaccctgtccctcacctgctctgtctctggtggctccctcagtacttactactggaactggattcggcagcccccagggaagggactggagtggattgcctatattcattatgattggtccaccaatcgcaacccctccctcaagagtcgagtcaccatgtcagtggacacgtccaagaaccagttctccctgaacctgaagtctgtgaccgccgcggacacggccatgtatttctgtgcgagaggtggtttcggctcccgagacgaggcggctagtac

SEQ ID NO: 296015 - DNA, 106 bp, Homo sapiens; identical to SEQ ID NO: 296008
  misc_feature: NA.33.53.E09.1.454.heavy.1.nb

SEQ ID NO: 296016 - DNA, 358 bp, Homo sapiens
  misc_feature: NA.33.57.F02.1.454.heavy.1.nb
gagaagagccccagccccagaacttcccaggagtttccattcggtgatcagcactgaacacagaggactcaccatggagtttgggctgagctgggttttccttgttacaattataaaaggtgtccagtgtcaggtgcaactggtggagtcgtgggggagacctggtcaagcctggagggtccctgagactctcctgtgcagccgctggattcagcttcagtgactactacatgggctggatccgacaggctccgaggggaagggctgggagtggatttcattcattagtaatcgtcttgctcccagagtccattagaatatgacagaatctgtgagaggccgattcaccgtctccaga

SEQ ID NO: 296017 - DNA, 106 bp, Homo sapiens; identical to SEQ ID NO: 296008
  misc_feature: NA.33.57.F02.2.454.heavy.1.nb

SEQ ID NO: 296018 - DNA, 297 bp, Homo sapiens
  misc_feature: NA.33.59.F04.1.454.heavy.1.nb
aagagccccagccccagaattcccaggagtttccattcggtgatcagcactgaacacagaggactcaccatggagtttgggctgagctgggttttccttgttgctattataaaaggtgtccagtgtcaggtgcaactggtggagtcgtgggggaggcttggtcaagcctggagggtccctgagactctcctgtgcagcctctggattcaccttcagtgacttctacatgagctggatccgccaggctccaggagggctgggagtgggtttcatacattggtagtagtggtagaacca

SEQ ID NO: 296019 - DNA, 107 bp, Homo sapiens
  misc_feature: NA.33.59.F04.2.454.heavy.1.nb
ctatgcgccttgccagcccgctcagtacacacactggaagtagtccttgaccaggcagcccagggccgctgtgcccagcacctgaactcctgggggaccgtcagtct

SEQ ID NO: 296020 - DNA, 351 bp, Homo sapiens
  misc_feature: NA.33.60.F05.8.454.heavy.1.nb
gtcgcaactattagtggcggtggaactcatacatactacgccgactccgtgaagggccgcttcaccatctccagagacaattccaacaacacggtgtttctgcaaatgaatagcctgagagtcgaggacatggccatatattactgtgcgagagttagcagtggctggtatcctttctccagcactggggccagggtaccctggtcaccgtctcctcagcctccaccaagggcccatcggtcttccccctggcgccctgctccaggagcacctccgagagcacagcggccctgggctgcctggtcaaggctacttccagtgtgtgtactgagcgggctggcaaggcgcata

SEQ ID NO: 296021 - DNA, 332 bp, Homo sapiens
  misc_feature: NA.33.62.F07.1.454.heavy.1.nb
ccttcacagaccctgtccctcacctgcactgtctctggtggctccatcaacagcggtggttactactggagctggatccgcaaccacccagggaagggcctggagtggattgggaacatctattacagtgggagtaccgactacaacctgtccctcaagagtcgaattaccatatcagtagacacgtctaagaaccagttttccctgaacctgaggtctgtgactgccgcggacacggccgtgtattactgtgcgggatatagtggctacgatgcggcttttgatatctggggccaagggacaagtggtcaccgtctcttcagcctccacca

SEQ ID NO: 296022 - DNA, 311 bp, Homo sapiens
  misc_feature: NA.33.78.H01.2.454.heavy.1.nb
tcagttcctcctctaaagaagcccctgggagcacagcgcatcaccatggactggacctggaggttcctctttgtggtggcagcagctacaggtgtccagtcccagttccaactggtacaatctgggtctgaggtgaagaggcctgggtcctcggtgagggtctcctgcagtgtctctgggagcgccttcagcacctatgccatcacctgggtgcgacaggcccccggacaagggcttgagtggatggggggtatcgatccctctcttcggcacaatacagtacgcccacaaatttcaagacagagtgcaag

SEQ ID NO: 296023 - DNA, 279 bp, Homo sapiens
  misc_feature: NA.33.80.H03.2.454.heavy.1.nb
atgggtcctcggtgaaggtctcctgcaaggcctctggatacatcttcagtggctatactatcaactgggtgcgacaggcccctggacaagggcttgagtggatgggagggatcatccctataaactacccacagaaattccagggcagactcacaattaccgcgacgaatccacgagcacagcctacatggagctgaccagcctgacatctgagacacggccatgtattatgtgcgagagtctcgtcgtaatttccgttttttggagttggttataacg

SEQ ID NO: 296024 - DNA, 288 bp, Homo sapiens
  misc_feature: NA.33.85.H08.4.454.heavy.1.nb
gtcgggcccaggactggtgaagccttcggagactctgtccctcacctgcactgtctctgatgtctccatcggtagtttctactggagttggatccggcagcccccagggaggggtactgggagtggattgggtttactcttttacagtgggatcaccaactacaaccctccctcaagagtcgagtcaccatatcactagacacgtccaggaaccagttctccctgaaggtgaactctgtgaccgctgcggacacggccgtgtattactgtgcgagagcttcgtatatc

SEQ ID NO: 296025 - DNA, 402 bp, Homo sapiens
  misc_feature: NA.34.1.A01.1.454.heavy.1.nb
tcctcctctaaagaagcccctgggagcacagctcatcaccatggactggacctggaggttcctctttgtggtggcagcagctacaggtgtccagtctcaggtgcagctggtgcagtctggggctgaggtgaagaagcctgggtcctcggtgaaggtctcctgcaaggcttctggaggcaccttcaacagctttggtatcaactgggtgcgacaggcccctggacaagggcttgagtacatgggaggaatcatccctatttgaatacaggaaataacgcaacagaagtttcagggcagagtgtcgatcaccgcggacgaatccacgaacacagtttacgtggagttgagcagcctgagatctagaagacacggccatgtattactgtgcgagagaggtggtag

SEQ ID NO: 296026 - DNA, 287 bp, Homo sapiens
  misc_feature: NA.34.14.B03.1.454.heavy.1.nb
tgccccaccatggacacactgtgctccacgctcctgctgctgaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcagcccccaggaaagggcctggagttcctagcgctcgtttattggggtgctgatgagcgctacagtccatctctgaagaccaggctcaccatcacgacgga

SEQ ID NO: 296027 - DNA, 299 bp, Homo sapiens
  misc_feature: NA.34.19.B08.1.454.heavy.1.nb
ctggggcctctgtgaaggtctcctgcaagacttctggatataccttcaccgaatactttatacactgggtgcgacaggcccctggacaaggctttgagtggctgggacggatcagacctaacagtggtggcacaaactttgcacagaagtttcagggcagggtcaccatgaccagggacacgtccatcagcacagcctacatggagctgagtggactgagatctgacgacacggccgtatattactgtgtgagagatattgactactgggccagggaaccctggtccaccgtctcctca

SEQ ID NO: 296028 - DNA, 613 bp, Homo sapiens
  misc_feature: NA.34.20.B09.1.454.heavy.1.nb
ccctgggattttcgggtgttttcatttggtgatcaggtctgaacagagagaactcaccatggagtttgggctgagctggcttttctggtggcaactttaaaaggtgtccagtgtgacgtacagctgttggagtcggggggagccttgacacagccggggggatctctgagactctcctgtgaagcctctggttcacctttagcgactatgccatgagctgggtccgccagactccagggaagggcctgcagtggtcgcggttattagtggaagcactgctgtcacatcccacgctgactctgtgaagggccgattcaccgtctccagagacaattctaagaagcttcgtttttctgcaaatgaacagcctgagagtcgatgacacggccgtctattactgtgcgaaggagaggggccgtggctgggccaaccatgctttcgatgtctggggccaagggacaatggtcaccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcata

SEQ ID NO: 296029 - DNA, 371 bp, Homo sapiens
  misc_feature: NA.34.26.C04.1.454.heavy.1.nb
gaggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggcccagcctgggactccctgagactctcctgtgcagcgtctggattcaccttcagtagtcatggcatgcactgggtccgccaggcctccgaggcaaggggctgggagtggggtgcagttatatggtatgagtggaagtagtcaatactatgcagactccgtgaagggccgattcaccgtctccagagacaatcccaagaacacgctgtatct

SEQ ID NO: 296030 - DNA, 273 bp, Homo sapiens
  misc_feature: NA.34.31.C09.1.454.heavy.1.nb
gtgggtctcaactattagtggtggtggtggtagcacatactacgcagactccgtgaagggccggttcaccatctccagagacaattccaagaacacgctgtttctgcaagtgaacagcctgagagccgaggacacggccgtatactactgtgcgaaagatgtgacaacgggttactagtggttcggggagtcaaccccgtttttgatatctggggccaagggacactggtcaccgtctcttcagcctccaccaggcccatccggtccttcccc

SEQ ID NO: 296031 - DNA, 106 bp, Homo sapiens
  misc_feature: NA.34.35.D02.3.454.heavy.1.nb
tatgcgccttgccagcccgctcagtacacgtgatggaagtagtccttgaccaggcagcccagggccgctgtgcccagcacctgaactcctgggggaccgtcagtct

SEQ ID NO: 296032 - DNA, 447 bp, Homo sapiens
  misc_feature: NA.34.38.D05.2.454.heavy.1.nb
tggggggtccctgagactctcctgtgcagcctctggattcaccttcagtagtcactggatgcactgggtccgtcaagttccagggaaggggctggtgtgggtttcacgtattacgagtgatgggactgacacaatctacgcggactccgtgaagggccgattcaccccctccagagacaacgccaagaacacactatatctgcaaatgaacagtctgagagccgaggacacggctgtctattactgtgcaagaggtggctacaatcatggttttgatctctggggccaagggacaatggtcaccgtctcttcagcctccaccaagggcccatcggtcttcccctggccgccctgctccaggagcacctccgagagcacagcggccctgggctgcctggtcaaggactacttccatcacgtgtactgagcgggctggcaaggcgcata

SEQ ID NO: 296033 - DNA, 356 bp, Homo sapiens
  misc_feature: NA.34.46.E02.1.454.heavy.1.nb
attgggtatatctttcacagtgggaccaccacctacaacccttccctcgagagtcgagtcaccatctcaatagacacgtccaagaagcagttctccctacagctgacctctgtgaccgctgcggacacggccgtatattactgtgcgagaggtttcgataccttgacctactccaactactttgactactggggccagggaaccctgatcaccgtctcctcaacctccaccaagggcccatcggtcttccccctggcaccctcctccaagagcacctctgggggcacagcggccctgggctgcctggtcaaggactacttccatcacgtgtactgagcgggctggcaaggcgcata

SEQ ID NO: 296034 - DNA, 374 bp, Homo sapiens
  misc_feature: NA.34.60.F05.1.454.heavy.1.nb
gtctcatcgattacttacagtggtgatctcgtctactacgcaaagtcagtgaagggccgattcaccatctccagagacaacgccaagaactcactatttctacaaatgaaacgcctgagagtcgaggacacaggtgtttattactgtgcgagagagccccaccgctcatttgcctcggggacttattattactacggtctggacgtctggggcaaggggaccgcggtcgccgtctcttcagcctccaccaagggcccatcggtcttccccctggcaccctcctccaagagcacctctgggggcacagcggccctgggctgcctggtcaaggactacttccatcacgtgtactgagcgggctggcaaggcgcata

SEQ ID NO: 296035 - DNA, 367 bp, Homo sapiens
  misc_feature: NA.34.62.F07.1.454.heavy.1.nb
ggtctcatccattagtcgtaacagtacttacatatactacgcagactcagtgaagggccgattcaccacctccagagacaacgccaagaactcactatatctgcaactgaacagcctgagagtcgaggacacggctgtatattactgtgcgagagtttccctttattgtagtgataccagttgctatgatggggacctttactactggggccaggggaccctggtcaccgtctcctcagcctccaccaagggcccatcggtcttccccctggcacccctcctccaagacgcacctctgggggcacagcggccctgggctgcctggtcaggactacttccatcacgtgtactgagcgggctggcaagg

SEQ ID NO: 296036 - DNA, 352 bp, Homo sapiens
  misc_feature: NA.34.70.G04.1.454.heavy.1.nb
ttgggtatgtcgatcacagtgggagcaccaactacaacccctccctcaagagtcgactcaccatctccgtacacacgtctaagaagcaattctccctgaggctgacttctgtgaccgctgcggacacggccctgtattactgtgcgagagggctttcggacatctatggttactctttaggctactggggccagggaatactggtcaccgtctcctcagcctccaccaagggcccatcggtcttccccctggccaccctcctccaagacgcacctcgtggggcacagcggccctgggctgcctggtcaaggctacttccatcagtgtactgagcgggctggcaaggcgcata

SEQ ID NO: 296037 - DNA, 362 bp, Homo sapiens
  misc_feature: NA.34.71.G05.1.454.heavy.1.nb
accacacccctcctaagaagaagcccctagaccacagctccacaccatggactggacctggaggatcctcttcttggtggcagcagcaacaggtgcccactcccaggtgcagctggtgcaatctgggtctgagttgaagaagcctggggcctcagtgaaggtttcctgcaagccttctggatacaccttcactagctatgctatgcattgggtgcgacaggcccctggacaagggcttgagtggatgggatggatcaacaccaacactgggaacccaacgtatgcccagggcttcacaggacgtttgtcttctccttggacacctctgtcagcacggcatatctgcagatcagcagcctaat

SEQ ID NO: 296038 - DNA, 168 bp, Homo sapiens
  misc_feature: NA.34.71.G05.3.454.heavy.1.nb
tatgcgccttgccagcccgctcagtacacgtgatggaagtagtccttgaccaggcagcccagggccgctgtgcccccagaggtgctcttggaggagggtgccagggggaagaccgatgggcccttggtggaggctgaggagacggtgaccagggcccatcggtcttcc

SEQ ID NO: 296039 - DNA, 344 bp, Homo sapiens
  misc_feature: NA.34.74.G08.1.454.heavy.1.nb
catatctattacagtgggagcaccaactacagcccctccctcacgggtcgagtcaccatctcagtagacacgtccaagaaccagttgtccctgaacctgcggtcagtgaccgctgcggacacggccgtctattactgtgcgaggagttgtagtagtggtacctgcgccttcgactacgtggggccgggaaccctggtcaccgtctcctcagcctccaccaagggcccatcggtcttccccctggcaccctcctccaagagcacctctgggggcacagcggccctgggctgcctggtcaaggactacttccatcacgtgtactgagcgggctggcaaggcgcata

SEQ ID NO: 296040 - DNA, 532 bp, Homo sapiens
  misc_feature: NA.34.78.H01.1.454.heavy.1.nb
gcgtcggaccatcccttcatgggtcttgtcccagatcaccttgaaggagtctggtccgacgctggtgaaacccaaacagaccctcacgctgacctgcaccttctctggtttctcactcaccagtgaagaagaggctgtggcctgggtccgtcacgcccccaggaaacgggcctggagttcctagcgctcgtttattggggtgctgatgagcgctacagtccatctctgaagaccaggctcaccatcacgacggacacccccaaaaaccaggtgatcctgacactgaccaagttggaccctgtggacacagccacctattattgtgcacacctaaaaccagcccgtggcggggactactttgactactggggccaggggaccctggtcaccgtctcctcagcctccaccaagggcccatcggtcttcccctggcgccctgctccaggagcacctccgagagcacagcggccctgggctgcctggtcaaggactacttccatcacgtgtactgagcgggctggcaaggcgcata

SEQ ID NO: 296041 - DNA, 144 bp, Homo sapiens
  misc_feature: NA.34.78.H01.3.454.heavy.1.nb
ggagcccagcactagaggtcggcggtgtttccattcggtgatcagcactgaacacagaggactcaccatggagtttgggctgagctgggttttcctcgttgctcttttaagaggtgtccagtgtcaggtgcagctggtggagtc

SEQ ID NO: 296042 - DNA, 111 bp, Homo sapiens
  misc_feature: NA.34.78.H01.4.454.heavy.1.nb
tatgcgccttgccagcccgctcagtacacgtgatgaggagggcgggaacagagtgacagtgggttggccttgggctgacctaggacggagacggtggtccctacagaatgt

SEQ ID NO: 296043 - DNA, 374 bp, Homo sapiens
  misc_feature: NA.34.87.H10.1.454.heavy.1.nb
acacaacaaccacattcctcctctaaagaagcccctgggagcacagcgcatcaccatggactggacctggaggttcctctttgtggtggcagcagctacaggtgtccagtcccaactgcaactggtgcagtctggggctgaggtgaagagcctgggtcgtcggtgaacgtctcctgcgagacctctggagacgatttcactgtctttactgtcaattgggtgcgacaggcccctggacaaggacttgagtggatgggcaggatcaccctcctctggacacctctctacgcacagaagttccaggacagagtctcgattaccgcggacgaggtcacgtctacagtctacataactattatccactatcatctgac

SEQ ID NO: 296044 - DNA, 385 bp, Homo sapiens
  misc_feature: NA.35.15.B04.2.454.heavy.1.nb
tggagtctgggggaggcttggtcaagcctggagggtccctgagactgtcttgtgcagcctctggattcaccttcagagactatttcatgacctggatccgccagactccagggaagggactgggagtgggtctcacacatcagcagtactggcaatcccatgtactacgcagactctgtgaagggccgattcaccatttttagggacaacgccaagggttcgctgtatctgcaaatgaacagcctgagagtcgaggacacggccatctattactgtgcaagagtctgtagtggtggcagttgttggctacggtactacgacggtatggacgtcgtggggccaagggaccaaggtcaccgtctcctcagcttccaccaagggccca

SEQ ID NO: 296045 - DNA, 89 bp, Homo sapiens
  misc_feature: NA.35.18.B07.1.454.heavy.1.nb
acatctggcacctcggagccagagtagcaggagccccaggagctgagcggggagcctcatgtccatgctgtgtcctgactgagactgac

SEQ ID NO: 296046 - DNA, 427 bp, Homo sapiens
  misc_feature: NA.35.19.B08.1.454.heavy.1.nb
cctggggcctcagtgaaggtctcctgcaagacttctggatacaccttcaccgaatactttatacactgggtgcgacaggcccctggacaagggtttgagtggctggggcggatcagccctaacagtggtgccacactctctgcacagaaatttcagggccgggtcaccatgaccagggacacgtccagcaacacaacctatatggaggtgaatggactgagatctgacgacacggccgtatattactgtgtgcgagatattgactacgtggggccagggaaccctggtcaccgtctcctcagcctccaccaagggcccatccggtcttccccctggccgccctgcctccaggacgcacctccgagacgcacagcggccctgggctgcctggtcaaggactacttccacgatctgtactgagcgggct

SEQ ID NO: 296047 - DNA, 355 bp, Homo sapiens
  misc_feature: NA.35.20.B09.1.454.heavy.1.nb
tcaactattgatggtagtgctcataacacatggtacgcagactccgtgaggggccggttcaccatctccagagacaattccaggaacacgctgtatctacaaatggacagtctgagagccgaggacacggccttatattactgtgcgaaagttcgaacagtggctggcacgaggtcgggatatgactactggggccagggaaccctggtcaccgcctcctcagcctccaccaagggcccatcggtcttccccctggcaccctcctccaagagcacctctggggcacagcggccctgggctgcctggtcaaggactacttccacgatctgtactgagcgggctggcaaggcgcata

SEQ ID NO: 296048 - DNA, 288 bp, Homo sapiens
  misc_feature: NA.35.20.B09.2.454.heavy.1.nb
agcccagccctgggattttcaggtgttttcatttggtgatcaggactgaacagagagaactcaccatggagtttgggctgagcgtggtcttttctagtggctaattttaaaaggtgtccagtgtgaggtgcagctgttggagtcgtgggggaggcttggcacagccgtgggggtccctgagactctcctgtgcagcctctggattcacctttagcacctatggcatgagctgggtccgccgggctccgaggggaagggctgggagtgggtctcgaactattgatggta

SEQ ID NO: 296049 - DNA, 179 bp, Homo sapiens
  misc_feature: NA.35.21.B10.2.454.heavy.1.nb
caccatgaccgaggacacatctacagacacagcctacatggagctgcgcagcctgagatctgacgacacggccgtgtattattgtgcaacagaaaattacgatatgtggagtggttattacacggaaaactctggggccagggaaccctgctcaccgtctcgtcagcctccaccgaagg

SEQ ID NO: 296050 - DNA, 351 bp, Homo sapiens
  misc_feature: NA.35.23.C01.1.454.heavy.1.nb
caatcatagtggaaccacctactacaacccgtccctcaagagtcgagtcaccatatcagtagactcgtccaagaaccagttctccctggagctgagctctgtgaccgccgcggacacggctgtgtattactgtgcgagagcgttccttagcagcggctggccccgctccaagtactactttgactcctggggccagggaaccctggtcaccgtctcagcttccaccaagggcccatcggtcttccccctggcgccctgctccaggagcacctctgggggcacagcggccctgggctgcctggtcaaggactacttccacgatctgtactgagcgggctggcaaggcgcata

SEQ ID NO: 296051 - DNA, 288 bp, Homo sapiens
  misc_feature: NA.35.25.C03.1.454.heavy.1.nb
gagcccagcactagaagtcggcggtgtttccattcggtgatcagcactgaacacagaggactcaccatggagtttgggctgagctgggttttcctcgttgctcttttaagaggtgtccagtgtcaggtgcagctggtgcagtcgtgggggcggcgtggtccagcctgggacgtccctgagactctcctgtgaagcctctggattctccttcaagaactatggcatgcacgtgggtcccgccaggctccgaggcaaggggctggagtgggtgcagtgatatcatttgat

SEQ ID NO: 296052 - DNA, 108 bp, Homo sapiens
  misc_feature: NA.35.25.C03.2.454.heavy.1.nb
tatgcgccttgccagcccgctcagtacagatcgtggaagtagtccttgaccaggcagcccagggccgctgtgcccagcacctgaactcctgggggaccgtcagtcttc

SEQ ID NO: 296053 - DNA, 634 bp, Homo sapiens
  misc_feature: NA.35.27.C05.1.454.heavy.1.nb
agaggagcccagccctgggattttcaggtgttttcatttggtgatcaggactgaacagagagaactcaccatggagtttgggctgagctggcttttctgtggctattttaaaaggtgtccagtgtgaggtgcagctgttggagtcgtgggggaggcttggtacagccgtggggggtccctgagactctcctgtgagcctctggattcacctttaggaactatgccatgtgctgggtccgccaggctccagggaaggggctggagtgggtctcagttattagtggtagtggtgatactatacactacgcagactccgtgaagggccggttcaccatctccagagacaattccaagaacacactgaatctgcaaatgaacagcctgagagccgaggacacggccgtatattactgtgcgaaagacatatcgcgtattactatgcttcggagacttaaattgagctttgactactggggccagggaaccctggtcaccgtctcctcagcctccaccaagggcccatcggtcttccccctggcaccctcctccaagagcacctctggggcacagcggccctgggctgcctggtcaaggactacttccacgatctgtactgagcgggctggcaaggcgc

SEQ ID NO: 296054 - DNA, 430 bp, Homo sapiens
  misc_feature: NA.35.3.A03.1.454.heavy.1.nb
cagtcctggacctcctgtgcaagaacatgaaacacctgtggttcttcctcctgctggtggcagctcccagatgggtcctgtcccaggtgcagctgcaggagtcgggcccaggactggtgaagccttcacagaccctgtccctcacctgcactgtctctggtggctccatgagcagtggtggttactactggagttggatccgccagcacccagggaagggcctggagtggattgggtacatctattacagtgggaggacccactacaacccgtccctcaagagtcgacttaccatatcagtagacacgtctaagaaccagttctccctgaagctgagctctgtgactgccgcggacacggccgtgtattactgtgcgagagatccttactatggttcggggattattataattatcgcgtcttttgatta

SEQ ID NO: 296055 - DNA, 262 bp, Homo sapiens
  misc_feature: NA.35.33.C11.1.454.heavy.1.nb
gagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaatactatgcatgcactgggtccgccaggctccaggcaaggggctggagtgg

SEQ ID NO: 296056 - DNA, 456 bp, Homo sapiens
  misc_feature: NA.35.34.D01.1.454.heavy.1.nb
  modified_base (398)..(398): a, c, t, g, unknown or other
  misc_feature (398)..(398): n is a, c, g, or t
gttggagaccttgcacttgtactccttgccattcagccagtcctggtgcaggacggtgaggacgctgaccacacggtacgtgctgttgtactgctcctccggtgtttccattcggtgatcagcactgaacacagaggactcaccatggagtttgggctgagctgggttttcctcgttgctcttttaagaggtgtccagtgtcaggtgcagcgtgggggagtcgtgggggaggcgtggtccagccgtgggaggtccctgagactctcctgtgcagcgtctggattcaccttcagtagttatggcatgcacgtgggtccgccaggctccgagggaaggggctgggagtgggtttcacgtattacgagtgatgggactgacacaatctacgcggactccgngaagggccgattccacccctcagacgacaacgccaagaacacactatatctagacaaa

SEQ ID NO: 296057 - DNA, 180 bp, Homo sapiens
  misc_feature: NA.35.34.D01.3.454.heavy.1.nb
tatgcgccttgccagcccgctcagtacagatcgtggaagtagtccttgaccaggcagcccagggccgctgtgcccggaggtgctcctggagcagggcgccaggggaagaccgatgggcccttggtggaggctgaggagacggtgaccagggttccctggccccagtagtcaaaatgccac

SEQ ID NO: 296058 - DNA, 97 bp, Homo sapiens
  misc_feature: NA.35.34.D01.5.454.heavy.1.nb
tatgcgccttgccagcccgctcagtacagatcgtgaggagggtgggaacagagtgaccgaggggcagatagcagcccgtcaaggcgggagtggagac

SEQ ID NO: 296059 - DNA, 331 bp, Homo sapiens
  misc_feature: NA.35.36.D03.2.454.heavy.1.nb
gaggagccttagccctggattccaaggcctatccacttggtgatcagcactgagcaccgaggattcaccatggaactggggctccgctgggttttccttgttgtctttttagaaggtgtccagtgtgaggtgcagctggtggagtcgtgggggagcctggtcaagcctggagacgtccctgagactctcctgtgtagcctctggattcaccttcaatatgtatagcatgacctgggtccgccaggctccgtgggaaggggctggagtgggtctcatctattggaagtagtgttgtttatacattattagtggagacggtcgggtgggggcc

SEQ ID NO: 296060 - DNA, 125 bp, Homo sapiens
  misc_feature: NA.35.42.D09.1.454.heavy.1.nb
attggcgatatctctcatagtgggagcaccaactacaacccctccctcaagagtcgagtcatcatatcagttgacacgtccaagaaccacttctccctggagttgaacagtgtgaccgctgcgga

SEQ ID NO: 296061 - DNA, 319 bp, Homo sapiens
  misc_feature: NA.35.43.D10.1.454.heavy.1.nb
cccagccctgggattttcaggtgttttcatttggtgatcaggactgaacagagagaactcaccatggagtttgggctgagttggctttttcttgtggctactttaaaaggtgtccagtgtgaggtgcagctgctggagtcggggggaggcttggtacggcctggggggtccctaagactctcctgtgcagcctctggattcaccttttacaactttgccatgaactgggtccgccagactccagggaagggtctggagtgggtctcgcgtattcgtggcagtggcaggtggtcccgacacatattacgcagacgccgtg

SEQ ID NO: 296062 - DNA, 399 bp, Homo sapiens
  misc_feature: NA.35.44.D11.1.454.heavy.1.nb
actcccagctgtttctgcttgctgatcaggactgcacacagagaactcaccatggagttcggctgagctgggttttccttgttgccattttaaaaggtgtccagtgtgaggtgcagctggtggagtccgggggaggcttagttcagccgtggggggtccctgagactctcctgtgcagcctctggattcaccttcagtagtcactggatgcactgggtccatcaagttccaggggaaggggctgggtgtgggtttcacgtattacgagtgatgggactgacacaatctacgcggactccgtgaagggccattccacccctcagacgacaacgccaagaacacactatatctgacaaatgaacagtctgagagccgaggacacggctgtctattactgtg

SEQ ID NO: 296063 - DNA, 253 bp, Homo sapiens
  misc_feature: NA.35.52.E08.1.454.heavy.1.nb
cccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcgttaggtaaagccgtggggggtccctcgagactctcctgtacagtctctggattcagtctaagtgacgcctggatgaactgggtccgccaggctccgaggcc

SEQ ID NO: 296064 - DNA, 217 bp, Homo sapiens
  misc_feature: NA.35.54.E10.1.454.heavy.1.nb
gagaggagcccagccctgggattttcaggtgttttcatttggtgatcaggactgaacagagagaactcaccatggagtttgggctgagcgtgtcttttctaggtggctatttaaaaggtgtcagtgtgaggtgcagctgttggagtcgtgggggagcttggcacagcctgggggggtccctgagctctcctgtgcagcctctggattcagttttagc

SEQ ID NO: 296065 - DNA, 267 bp, Homo sapiens
  misc_feature: NA.35.6.A06.2.454.heavy.1.nb
cagccctgggattttcaggtgttttcatttggtgatcaggactgaacagagagaactcaccatggagtttgggctgaggtggtctttttcttgtggctattttaaaaggtgtccaatgtgaagtgcacctgttggagtcgtgggggaggcttggtacaggcgggggggtccctgagactctcctgtgcagcctctggattcacctttagcaactatgccatgagctgggtccgccaggctccgagggggagggctgggcgtgggtct

SEQ ID NO: 296066 - DNA, 239 bp, Homo sapiens
  misc_feature: NA.35.61.F06.2.454.heavy.1.nb
attgggtacatctacaacagtgggaacaccgagtacaacccgtccctcacgcgtcgagtgaccatgtcagtagacttgtcgaagaatctgttctccctgaaattgaactctgtgacggccgcggacacggccttatattactgtgcgagagacgcccccctgccctactttgatagtagtggttatcaggtctgggggccgagggacaatggtcatcgtctcttcacgcctccaccaac

SEQ ID NO: 296067 - DNA, 441 bp, Homo sapiens
  misc_feature: NA.35.67.G01.1.454.heavy.1.nb
ggagcccagcactagaagtcggcggtgtttccatccggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgaagcgtctggattcatcttcaataactatggcatgcactgggtccgccaggctccaggcaagggactggagtggttggcagttgtgtggtatgatggaagtaatagatactatgcagacaccgtgaagggccgattcaccatctccagagacaattccaagaacactttgttcctgcaaatgaacagcctgagagccgaggacacggcgatatattactgtgcgagaagcgatgggagcctacccccgga

SEQ ID NO: 296068 - DNA, 138 bp, Homo sapiens
  misc_feature: NA.35.68.G02.1.454.heavy.1.nb
gtcgggtctcaactattgatggtagtgctcataacacatggtacgcagactccgtgaagggccggttcaccatctccagagacaattccaggaacacgctatatctgcaaatgaacagcctgagagccgaggacacgg

SEQ ID NO: 296069 - DNA, 379 bp, Homo sapiens
  misc_feature: NA.35.70.G04.1.454.heavy.1.nb
ggagcccagccctgggattttcaggtgttttcatttggtgaacaggactgaacagagagaagtcaccatggagtttgggctgagctggctttttcttgtggctattttaaaaggtgtccagtgtgaggtgcagctgtcggagtcgtgggggaggcttggtacagccgtggggggtccctgagagtctcctgtgcagcctctggagtcaccttgagtagctatggcatgagctgggtccgccaggctccgaggggacggggctgggagtgggtctcttctattagtgctagtggtggtctcacatactacgcagactctgtgaagggccggttcaccgtctccagagacaattccaagaacaccctgtactctgacaaat

SEQ ID NO: 296070 - DNA, 371 bp, Homo sapiens
  misc_feature: NA.35.77.G11.1.454.heavy.1.nb
ggtgacagttatatcagatgatggaagtaatgaatactatgcagactccgtgaagggccgattcaccatctccagagacaattccaagaacacggtgtatctgcaaatgaatagcctgagagctgaggacacggctgtgtattactgtgctaaagaacgaatagcagcagccaatttatattactactactattacgtatggacgtctggggccaagggaccacggtcaccgtctcctcagcctccaccaagggcccatcggtcttccccctggcaccctcctccaagacgcacctctgggggcacagcggccctgggctgcctggtcaaggctacttccacgatctgtactgagcggctggctaaggcgc

SEQ ID NO: 296071 - DNA, 355 bp, Homo sapiens
  misc_feature: NA.35.79.H02.1.454.heavy.1.nb
gtctcacttattagtggtagcgccgacttcacacactacgcagactccgtgatgggccggttctccatctccagagacaattccaacaacacggtgtatctgcaaatgaacagcctgagagccgacgatacggccgtatactactgtgcgaaacttgccgactacgatattttgagtggtcttgactactggggccagggagccctggtcatcgtctcctcagcctccaccaagggcccatcggtcttccccctggcaccctcctccaagagcacctctgggggcacagcggccctgggctgcctggtcaaggctacttccacgatctgtactgagcgggctggcaaggcgcata

SEQ ID NO: 296072 - DNA, 260 bp, Homo sapiens
  misc_feature: NA.35.82.H05.2.454.heavy.1.nb
ccagccttgggattcccaagtgttttcattcagtgatcaggactgaacacagaggactcaccatggagtttgggctgagctggattttccttgctactattttaaaaggtgtccagtgtgaggtgcagctggtggagtcgtgggggaggcttggtaaagccgtggggggtccctcagactctcctgtacagtctctggattcagtctaagtgacgcctggatgaactgggtccgccgaggcctccgaggccaggggctgg

SEQ ID NO: 296073 - DNA, 57 bp, Homo sapiens
  misc_feature: NA.35.85.H08.1.454.heavy.1.nb
tagcaggaggaagagaagctgcgctggggcttccatggttccgtctgggtcctaact

SEQ ID NO: 296074 - DNA, 363 bp, Homo sapiens
  misc_feature: NA.35.87.H10.1.454.heavy.1.nb
gagaggagccccagccttgggattcccaagtgttttcattcagtgatctggactgaacacagaggactcaccatggagtttgggctgagctggattttccttggtgctattttaaaagttgtccagtgtgaggtgcacctggtggagtcgggcggaggcttcgttaagccaggagggtccctaagactctcctgtgcagtttctggattccctttcaatgtcgcctggatgaactgggtccgccaggctccgagggaagggactggagtgggttgcccgcattaaaaggagaattgatggcgggacaacagactacgcttcacccgttcagggcagattcaccgtctccagagatgattccat

SEQ ID NO: 296075 - DNA, 403 bp, Homo sapiens
  misc_feature: NA.36.10.A10.1.454.heavy.1.nb
gccttagccctggactccaaggcctttccacttggtgatcagcactgagcacagaggactcaccatggaattggggctgagctgggttttccttgttgctattttggaaggtgtccagtgtgaggtgcaattggtggagtctgggggaggcctcgtccagcctggggggtccctgagactctcctgtgtagcctctgaattcccctttacggcttattggatgagctgggtccgccaggctccgagggaaggggctggagtgggtggccaacataaagcaagatggaagtaggagggagtatgtggaatctgtgaagggccgtttcaccatctccagagacaacgccaagaactccgtgcatctgcaaatgaacagtctgagagccgaggacacggctattta

SEQ ID NO: 296076 - DNA, 279 bp, Homo sapiens
  misc_feature: NA.36.14.B03.1.454.heavy.1.nb
gtccagccgggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccattcaccatctccagagacagcgccaatcactcactgtatctgacaaatgaacagcctgagagccgaagacacggctgtttattactgtgcgagagagggctacgttttggag

SEQ ID NO: 296077 - DNA, 286 bp, Homo sapiens
  misc_feature: NA.36.2.A02.2.454.heavy.1.nb
gcccagccctgggattttcaggtgttttcatttggtgatcaggactgaacagagagaactcaccatggagtttgggctgagctggtctttttctgtggctattttaaaaggtgtccagtgtgaggtgcagctgttggagtcgtgggggaggcttggtacagccgtggggggtccctgagactctcctgtgcagcctctggattcacctttagcagctatgccatgacctggtccgccaggctccgagggaggactggagtgggtctcgtctattagtggaagtggt

SEQ ID NO: 296078 - DNA, 462 bp, Homo sapiens
  misc_feature: NA.36.23.C01.1.454.heavy.1.nb
ctttctgagactcatggacctcctgcacaagaacatgaaacacctgtggttcttcctcctcctggtggcagctcccagatgggtcctgtctcaggtgcagctgcagcagtcgggcccaggagtggtgaagccttcggagaccctgtccctcacctgcgctgtgtctggagcctccctcggcggagatgaatggtggagttgggtccgccagcccccagggaaggggctgagttggattggtgaaataaatgagaccgggggcaccaactacaatgcgtccctcaggggtcgagtcaccatatctgcagacaagtccaagaaccacttctccctgaggctgacctctgtgaccgccgcggactcggccatatattattgtgcgagtagtttttgcaggatcttggggcggtatcgacgtctggggtcaagggatcacggtcatcgtctcctcagcctcaccaa

SEQ ID NO: 296079 - DNA, 277 bp, Homo sapiens
  misc_feature: NA.36.24.C02.1.454.heavy.1.nb
accacacccctccttgggagaatcccctagatcacagctcctcaccatggactggacctggagcatccttttcttggtggcagcagcaacaggtgcccactcccaggttcagctggtgcagtctggaggtgaggtgaagaagcctggggcctcagtgaaggtctcctgcaagacttctggttacagtctttacagctatggtatcaactgggtgcgacacgacccctggacaagggcttgagtggatgggatggatcagcgcttacaatggtaaaac

SEQ ID NO: 296080 - DNA, 372 bp, Homo sapiens
  misc_feature: NA.36.26.C04.1.454.heavy.1.nb
gaacagccggggggtccctgagactctcctgtgtagcctctggattcacctttagcacctattccatgagttgggtccgccaggctccggggaaggggctggagtgggtctcaagtgttagtggtgatggtgctaacacatactacgcaggctccgtgaagggccgcttcaccatctccagagacaattccgagagcacggtgtttctgcaaatgagccgcctgaaagccgaggacacggccatttactactgtgcgagaatgcagacagtgggagctgacacctggggccaggggcaccctggtcaccgtttcctcagcctccaccaagggcccatccggtcttccccctggccgccctgcctccaggacg

SEQ ID NO: 296081 - DNA, 397 bp, Homo sapiens
  misc_feature: NA.36.27.C05.1.454.heavy.1.nb
ctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaaggggctgggagtgggtctcatccattagtagtagtagtagttacatatactacgcagactcagtgaagggccgattcaccatctccagagacaacgccaagaactcactgtatctgacaaatgaacagcctgagagccgaggacacggctgtgtattactgtgcgggatgc

SEQ ID NO: 296082 - DNA, 377 bp, Homo sapiens
  misc_feature: NA.36.29.C07.1.454.heavy.1.nb
cttcaccagtcctggacctcctgtgcaagaacatgaaacatctgtggttcttccttctcctggtggcagctcccagatgggtcctgtcccaggtgcagctgcaggagtcgggcccaggactggtgaagccttcgcagaccctgtccctcacctgcactgtctctggtggctccatcagtacttactactggagttggatccggcagcccccagggaagggactggagtggattgggtatatgtatcacagtgggagaaccaactacagtccctccctcaagagtcgagtcaccatatcagtagacacgtccaagaaccagttctccctgaagctgagctctgtgaccgctgcggacacggccgtgtattattgtgcg

SEQ ID NO: 296083 - DNA, 602 bp, Homo sapiens
  misc_feature: NA.36.30.C08.1.454.heavy.1.nb
cctgggactcccagctgtttctgcttgctgatcaggactgcacacagagaactcaccatggagtttgggctgagctgggttttccttgttgccattttaaaaggtgtccagtgtgaaatgcagctggtggagtccgggggaggcttggttcagccgggggggtccctgagactctcctgtgcagcctctggattccccttcagtgactactggatgcactgggtccgccaagctccagggaaggggctggtgtgggtctcacgtattagtagtgatgggagttacacaactaatgtggagtccgtggagggccgattcaccatctccagagacaacgccaagaacacgctgtatctgcaaatgaacagtctgagagccgaggacacggctgtgtattattgtgcaactttcgggattagttggaccgacgcgcaatggggccagggaaccctggtcaccgtctcctcagcctccaccaagggcccatcggtcttccccctggcgccctgctccaggagcacctccgagagcacagcggccctgggctgcctggtcaaggactacttccagacagcgtactgagcgggctggcaaggcgcata

SEQ ID NO: 296084 - DNA, 466 bp, Homo sapiens
  misc_feature: NA.36.33.C11.1.454.heavy.1.nb
gtacagcctggggggtccctgagactctcctgtgcagcctctggattcacctttagcagctatggcatgagctgggtccgccaggttccagggaagggactgcagtgggtctcatctattagtgctagtggtggtactacattctacgcagactccctggaggggccggttcaccatctccagagacaattccaagagcacgctgtatctacaaatgaacaacctgagagccgaggacacggccttatattactgtgcgaaatattctgacgtcgtagcacctcgcccctatttgactactggggccagggaaccctggtcaccgtctcctcagcctccaccaagggcccatcggtcttcccctggcaccctcctccaagagcacctctgagagcacagcggccctgggctgcctggtcaaggactacttccagacagcgtactgagcgggctggcaaggcgcata

SEQ ID NO: 296085 - DNA, 110 bp, Homo sapiens
  misc_feature: NA.36.34.D01.3.454.heavy.1.nb
ctctcggaggtgctcctggagcagggcgccagggggaagaccgatgggctgtcctacagtcctcaggactctactccctcagcagcgtggtgaccgtgacctccagcaac

SEQ ID NO: 296086 - DNA, 351 bp, Homo sapiens
  misc_feature: NA.36.34.D01.5.454.heavy.1.nb
accacacccctccttgggagaatcccctagatcacagctcctcaccatggactggacctggagcatccttttcttggtggcggcagcaacaggtgcccactcccaggttcacctggtgcagtctggagctgaggtgaagaagcctggggcctcagtgaaggtctcctgcaaggcttctggttacatctttaggaggtatgcaatcacctgggtgcgacaggcccctggacaagggcttgagtggatgggatggatcagcgcttacaatggtaacacaaattatgaacagaagttccagggcagagtcaccatgaccacaaacacatccacgagcacagcctacatggagct

SEQ ID NO: 296087 - DNA, 230 bp, Homo sapiens
  misc_feature: NA.36.35.D02.2.454.heavy.1.nb
ctcctgtgaagcctctggattcacctttgacaagtgtgccatgacctgggtccgccaggctccagggaaggggctggagtgggtctcagttattagtggtagtggtagtagcacagattacgcagactccgtgaagggccggttcaccatctccagagacaattccaacagcacgctgtatttgcacatgaacagcctgagagccgaggacacggccatatattattgtg

SEQ ID NO: 296088 - DNA, 180 bp, Homo sapiens
  misc_feature: NA.36.35.D02.3.454.heavy.1.nb
gtccagtgtgaggtgcagctgctggagtcgtgggggaggcttggtacgaggccgggggggtccctgagactctcctgtgaagcctctggattcacctttgacaagtgtgccatgacctgggtccgccaggctccgagggaaggggctggagtgggtctcagttatagtggtagtggtagt

SEQ ID NO: 296089 - DNA, 106 bp, Homo sapiens
  misc_feature: NA.36.35.D02.5.454.heavy.1.nb
tatgcgccttgccagcccgctcagtacgctgtctggaagtagtccttgaccaggcagcccagggccgctgtgcccagcacctgaactcctgggggaccgtcagtct

SEQ ID NO: 296090 - DNA, 459 bp, Homo sapiens
  misc_feature: NA.36.36.D03.1.454.heavy.1.nb
gattttcaggtgttttcatttggtgatcaggactgaacagagagaactcaccatggagtttgggctgaactggctttttcttgtggctattttaaaaggtgtccagtgtgaggtgcagctgttggagtcggggggaggcttggtacagccgtggggggtccctgagactctcctgtgcagcctctggattctcctttagcacctatgccatgagctgggtccgccaggctccagggaagggactggagtgggtctcatccattagtggtcacggacttcatacatacttcgcagactccgtgaagggccggttcaccatgtccagagacaattccaagaacacacagtatctgcaaatgaacagcctgagagccgaggacacggccgtctatttctgtgcgaaagcctttagtgttaccggttatgagttcggaaagggggcgactacgtgggccaggg

SEQ ID NO: 296091 - DNA, 317 bp, Homo sapiens
  misc_feature: NA.36.4.A04.2.454.heavy.1.nb
cttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccaggccgggggggtccctgagactctcctgtgcagcctctggattcatcttgagtagttattggatgacttgggtccgccaggctccagggaaggggctgcagtgggtggccaacattaaggagatggaagtgagacatactatgtggactctgtgaaggg

SEQ ID NO: 296092 - DNA, 356 bp, Homo sapiens
  misc_feature: NA.36.45.E01.1.454.heavy.1.nb
gtctcaagtattgctggtagtggtagtactacatactacacagactccgtgaagggccggttcaccatctccagagacaattccaagaacacgatgtatctgcaaatgaacagtctgagagccgaagacgcggccgtatatcactgtgcgaaattccccggggagggggcagtggctggtactgcaagggcactttgagtcctggggccagggaaccctggtcaccgtgtcctcagcctccaccaagggcccatcggtcttccccctggccgccctgctccaggagcacctccgagagcacagcggccctgggctgcctggtcaaggctacttccagacagcgtactgagcgggct

SEQ ID NO: 296093 - DNA, 300 bp, Homo sapiens
  misc_feature: NA.36.46.E02.4.454.heavy.1.nb
tctcaggtatcagttacaatagtggtagcgtgggctatgcggactctgtgaggggccgattcaccatctccagagacaacgccaagaactccctgtatctgcaaatgaacagtctgaaacctgaggacacggccgtgtattactgtgcaaaaacgggagacccgcccaggtcgggggcttatcattacgactactggggccagggaacccggtcaccgtctcctcagcctccaccaagggcccatccggtcttcccccgtggccgccctgcctccaggacgcacctccgagacgcacagc

SEQ ID NO: 296094 - DNA, 182 bp, Homo sapiens
  misc_feature: NA.36.47.E03.1.454.heavy.1.nb
tatgcgccttgccagcccgctcagtacgctgtctggaagtagtccttgaccaggcagcccagggccgctgtgcccccagaggtgctcttggaggagggtgccaggggaagaccgatgggcccttggtggaggctgaggagacggtgaccagggttccctggccccaggggccgaaccaatta

SEQ ID NO: 296095 - DNA, 345 bp, Homo sapiens
  misc_feature: NA.36.5.A05.1.454.heavy.1.nb
tcggggctgccctttggttttggagatggttttctcgatgggggctggagtgggtggccaacataaaggaagatggaagtgaggactactatttggactctgtgaggggccgattcaccgtctccagagacaacgccagaaactcagtgtctctgcaaatgaacagcctgagagtcgaggacacggctgtgtattactgtgcgaccctaggatattgcaatggggttactgctccgcgggggcgctggtagatgcttttgacatctggggccaagggacgatggtcaccgtctcttcagcctccaccaagggcccatcggtcttccccctggccgccctgcctcc

SEQ ID NO: 296096 - DNA, 307 bp, Homo sapiens
  misc_feature: NA.36.53.E09.2.454.heavy.1.nb
gtaaagccggggggtccctgagactctcctgtgcagcctctggattcgtctttgatgattatgccatgagttgggtccgccaggctccagggaaggggctggaatgggtctcggccatcagtgtcagtggtgaaaagacattctacgcagactccgtgaagggccggttcaccatctccagagacaattccaacagtatactgtatctagacatgaacagcctgacagccgaggacacggccgtatattattgtgcgaaagggaccaatcctcatcatccctatactttgaatactggggccaggga

SEQ ID NO: 296097 - DNA, 114 bp, Homo sapiens
  misc_feature: NA.36.53.E09.3.454.heavy.1.nb
ggccaacatgaagccagatggaagtcagacatactatgtggactctgtgaagggccgattcaccatctccagagacagcgccaatcactcactgtatctgcaaatgaacagcct

SEQ ID NO: 296098 - DNA, 105 bp, Homo sapiens
  misc_feature: NA.36.57.F02.2.454.heavy.1.nb
tatgcgccttgccagcccgctcagtacgctgtctggaagtagtccttgaccaggcagcccagggccgctgtgcccagcacctgaactcctgggaggaccgtcagt

SEQ ID NO: 296099 - DNA, 501 bp, Homo sapiens
  misc_feature: NA.36.59.F04.1.454.heavy.1.nb
gagaggagcccagccctgggattttcaggtgttttcatttggtgatcagggctgaacagagagaactcaccatggagtttgggctgagctggcttttcttgtggctgttttaaaaggtgtccagtgtgaggtgcaggtgtcggaatcgtgggggaggcttggttcagccgtggggggtccctgagactctcctgtgcagtctctggattaatctttagtgactatgccatgatctgggtccgccaggctccgagggaaggggctggagtgggtctcagcaattaatggtaggggtgattcaccacattacgcggactccgtggggggccgttcaccatcaccagagacaactccaggagcacgctatatctgcaaatgcacagcctgagagtcgaggacacggccgtgtattattgtgcgagagatcccaacggtgaccacattggtgcttttgattttttggccacgggacaatggtcaccgtctcttcagcctccacca

SEQ ID NO: 296100 - DNA, 343 bp, Homo sapiens
  misc_feature: NA.36.61.F06.1.454.heavy.1.nb
gtggccaacataagacaagatggaagtaggaaagaatatgtggactctgtgaagggccggttcagcatctccagagacaacgccaagaactccgtggatctgcaaatggacagtctgagagccgaggacacggctgtctattactgcgcgagagaaggagtgggcggtttcgactactggggccaggggagccctggtcaccgtctcctcagcctccaccaagggcccatcggtcttcccctggcgccctgctccaggagcacctccgagagcacagcggccctggctgcctggtcaaggactacttccagacagcgtactgagcgggctggcaaggcgcata

SEQ ID NO: 296101 - DNA, 358 bp, Homo sapiens
  misc_feature: NA.36.62.F07.1.454.heavy.1.nb
ggtctcaggtattagtggtagtggtggcagcacatactacgcagactccgtgaagggccggttcaccatctccagagacaattccaagaacacactgtatctggaaatgaacagcctgagagccgaggacacggccctattttactgtgcgaaacggggggctttaggttcgcggccggctggttcgacctatggggccagggaccctggtcaccgtcgcctcagcctccaccaagggcccatcggtcttccccctggcaccctcctccaagagcacctctgggggcacagcggccctgggctgcctggtcaaggactacttccagacagcgtactgagcgggctggcaaggcgcata

SEQ ID NO: 296102 - DNA, 297 bp, Homo sapiens
  misc_feature: NA.36.65.F10.1.454.heavy.1.nb
accacatctgtcctctagagaatcccctgagagctccgttcctcaccatggactggacctggaggatcgtcttcttggtggcagcagtcacaggagcccactccccggtgaaattggtgcagtccggggttgaggtgacgaagcctggggcctcagtgaaggtcccctgccaggcttctggatacctcttcaacgcctattatatacactgggtgcgccaggcccctggacaagggcctgagtggatgggatgcgtcaaccccaacactggcgacacaaagtctgcacagaagtttc

SEQ ID NO: 296103 - DNA, 359 bp, Homo sapiens
  misc_feature: NA.36.67.G01.1.454.heavy.1.nb
catcctcgccctcctcctggctgttctccaaggagtctgtgccgaggtgcagctggtgcagtctggagcggaggtgaaaaagcccggggagtctctgaaaatctcctgtaaggcttctggatacacctttaccaacttctggatcggctgggtgcgccagatgcccgggaaaggcctggactggatggggatcgtctatcctggtgactctgataccagatacagcccgtcttccaaggccaggtcaccatctcagtcgacaagtccatcagcaccgcctacctccactggagtagcctgaaggcctcggacaccgccatatattactgtgcgagacatggaagctatagtgggaacta

SEQ ID NO: 296104 - DNA, 349 bp, Homo sapiens
  misc_feature: NA.36.7.A07.1.454.heavy.1.nb
cctccttgggagaatcccctagatcacagctcctcaccatggactggacctggagcatcctttttcttggtggcagcagcaacaggtgcccactcccaggttcaattggtgcagtctggagctgaactgaagaagcctggggccttagtaaacgtctcctgcaaggcttctggttactcctttcttacgtatggcatcagctgggtgcgacaggcccctggacaagggctcgagtggatggggtggatcaggcctaacaatggttacacaaactatgcacggaagttgcaggacagaatgaccatgaccacagacacgtccacgagcacagcgtacatggaactgagga

SEQ ID NO: 296105 - DNA, 333 bp, Homo sapiens
  misc_feature: NA.36.72.G06.1.454.heavy.1.nb
ggtctctggtatttattcgaatggtggtagtacagggtatgcagactctgtgaagggccgattcatcatctccagagacaacgccaagaattccctggatctggaaatgaacagtctgagagccgaggacacggccttgtactactgtgcgagagctccgtgggctgaccactggggccagggaaccctggtcaccgtctcctcagcctccaccaagggcccatcggtcttccccctggccaccctcctccaagacgcacctctgggggcacagcggccctgggctgcctggtcaaggactacttccagacagcgtactgagcgggctggcaa

SEQ ID NO: 296106 - DNA, 405 bp, Homo sapiens
  misc_feature: NA.36.76.G10.1.454.heavy.1.nb
tagccctggactccaaggcctttccacttggtgatcagcactgagcacagaggactcaccatggaattggggctgagctgggttttccttgttgctattttagaaggtgtccagtgtgaggtgcagttggtggagtcgtgggggaggcttggtccagccgtggggggtccctgagactctcctgtgcagcctctggattcacctttagtaactattggatgagttgggtccgcctggctccgaggtaagggcctggagtgggtggccaacatacagccggatggaagtgagaaacactatgtggagtctgtgaagggccgattcaccatctccagagacaacgccaagaactcactgtttctgaacatgaccagcctgagagccgaggactcggctctctattac

SEQ ID NO: 296107 - DNA, 484 bp, Homo sapiens
  misc_feature: NA.36.78.H01.1.454.heavy.1.nb
tacacctgtggctctcagagaggagccttagccctggactccaaggcctttccacttggtgatcagcactgaacacagaggactcaccatggaattggggctgacctgggttttccttgttgctattttagaaggtgtccagtctcaggtgcagctggtggagtcgtgggggaggcttggtccaggccgggggggtccctgagactctcctgtgtagcctctggattcacctttaacaactactggatgtcctgggtccgccaggctccagggaaggggctggaatgggtggccaacatgaagccagatggaagtcagacatactatgtggactctgtgaagggccgattcaccatctccagagacagcgccaatcactcactgtatctgcaaatgaacagcctgagagccgaagacacggctgtttattactgtgcgagagagggcacgttttggagtggttatgtccctttgactactgggg

SEQ ID NO: 296108 - DNA, 374 bp, Homo sapiens
  misc_feature: NA.36.79.H02.1.454.heavy.1.nb
tcggtctcagttatttacagtggtggtaacagataccacgcagactccgtgaagggccgattcaccatctccagagacacatccaagaacatgatttatcttcaaatgaacagcctgagagtcgaggacacagccgtatacttctgtgtgagagttaggacctctgactcggaaaatggatacagcgactcatatcaccacatggacgcctggggcagagggaccacggtcaccgtctcctcagcttccaccaagggcccatccgtcttccccctggcgccctgctccaggagcacctccgagagcacagccgccctgggctgcctggtcaaggactacttccagacagcgtactgagcgggctggcaaggcgc

SEQ ID NO: 296109 - DNA, 266 bp, Homo sapiens
  misc_feature: NA.36.84.H07.1.454.heavy.1.nb
gcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagacttctggatacaccttcaccggctactatatgcactgggtgcgacaggccctggacaagggcttgagtggatgggatggatcaacctaa

SEQ ID NO: 296110 - DNA, 372 bp, Homo sapiens
  misc_feature: NA.36.85.H08.1.454.heavy.1.nb
agcctggggcctcagtgaaggtgtcctgcaagacttcaggatacaccttcacagtttatgaaatcaactgggtgcgacaggccacaggacaagggcttgagtggatgggatgggtgaacccttatagtggtgacacagattatgcacagaagttccagggcagaatcaccatgaccagaaacagctccataaacacagtttacatggaactgaacagtctgagctccgaggacacggccgtatattactgtgcgagagacaacgtattttggactggtgaatacgaagggttcgacccgtggggccagggaaccctggtcaccgtctcctcagcctccaccaagggccccatccggtccttcccccgtggcc

SEQ ID NO: 296111 - DNA, 540 bp, Homo sapiens
  misc_feature: NA.36.86.H09.1.454.heavy.1.nb
gagaggagccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgtattagtggcatgcactgggtccggcaagctccagggaagggcctggagtgggtctcaggtattagttggaacagtggtaggataggctatgcggactctgtgaagggccgattcagcatctccagagacaacgccaagaattccctgtatctacaaatgaacagtctgagagctgaggacacggccttgtattactgtgcaaaagttttgagtttagagtagtaagggtctactactacggtatggacgtcgtggggccaagggaccacggtcaccgtctcctcagcctccaccaagggccccatcggtccttcccc

SEQ ID NO: 296112 - DNA, 365 bp, Homo sapiens
  misc_feature: NA.36.87.H10.1.454.heavy.1.nb
agcccagcactagaagtcggcggtgtttccattcggtgatcagcactgaacacagaggactcaccatggagtttgggctgagctgggttttcctcgttgctcttttaagaggtgtccagtgtcaggtgcagctggtggagtctgggggaggcgtggtccagcctgggaggtccctgagactctcctgtgcagcctctggattcaccttcaatacctatggcatgcactgggtccgccaggctccaggccaggggctggagtgggtggcagttatatcatatgatggaagtaataaatactatgcagactccgtgaagggccgattcaccatctccagagacaattccaagaacactctgtatctg

SEQ ID NO: 296113 - DNA, 357 bp, Homo sapiens
  misc_feature: NA.36.9.A09.1.454.heavy.1.nb
  modified_base (300)..(300): a, c, t, g, unknown or other
  misc_feature (300)..(300): n is a, c, g, or t
tagccctggactccaaggcctttccacttggtgatcagcactgagcacagaggactcaccatggaattggggctgagctgggttttccttgttgctattttagaaggtgtccagtgtgacgtgcaactggtggagtctgggggaggcttggtccagccgtggggggtccctgagactctcctgtgcagcctctggattcaactttggtagctattggatggactgggtccgccagtctccgagggaaggggctgggagtgggtggccaacatacgagggaggtggtggtacgaaaaactntgtggactctgtgcggggcattcaccatctccagagacaacgaccaaaactcactgt

SEQ ID NO: 296114 - DNA, 375 bp, Homo sapiens
  misc_feature: NA.37.1.A01.1.454.heavy.1.nb
gtggacgtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcata

SEQ ID NO: 296115 - DNA, 419 bp, Homo sapiens
  misc_feature: NA.37.10.A10.1.454.heavy.1.nb
  modified_base (371)..(371): a, c, t, g, unknown or other
  misc_feature (371)..(371): n is a, c, g, or t
tgtgcagcctctggattcagtttctataccgcctggatgagctggatccgccaggctccaggaaaggggctggagtgggtcggccgtagtaaaagcgaaggttctggtgggacaacagactacgctgcccccgtgaaaggcagattcaccatctcgagagatgaatcaaaaaccaccctgtatctgcacatgaacagcctgacaaccgaggacacagccgtctattactgtgtcatagatgattactttgataccagcggtacgaatttgtggaccctttgactactggggccagggaccctggtcaccgtctcctcagcctccaccaaggcccatcggtccttccccgtggccgccctgcctccgaggancacctccgagagcacagccggccctggggctgcctggtcaacggctac

SEQ ID NO: 296116 - DNA, 450 bp, Homo sapiens
  misc_feature: NA.37.12.B01.1.454.heavy.1.nb
gtgcagcctggggggtccctgagactctcctgtgcagcctctggattaatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggccaccgtctcctcagcctccaccaagggcccatcggtcttccccctggcgccctgctccaggagcacctccgggggcacagcggccctgggctgcctggtcaaggactacttccatctacactactgagcgggctggcaaggcgcata

SEQ ID NO: 296117 - DNA, 339 bp, Homo sapiens
  misc_feature: NA.37.12.B01.2.454.heavy.1.nb
gtgcagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacgggaaccctggtcaccgtctcctcagcctccaccaa

SEQ ID NO: 296118 - DNA, 296 bp, Homo sapiens
  misc_feature: NA.37.12.B01.3.454.heavy.1.nb
gtgcagcctggggggtccctgagactctcctgtgcagcctctggattcaccttttaatacctattggatgagttgggtccgccagttccagggaaggggctggagtgggtggccaacataaagcaagatggaagtgagaaatactatgtggactttgtgaagggccgattcaccatctccagagacaactccaagaactcagtgtatctacacatgaacaaccttagagtcgaggacacggctgtttattactgtagaaaaggccactatggagtctggggccgagggaccacggt

SEQ ID NO: 296119 - DNA, 245 bp, Homo sapiens
  misc_feature: NA.37.13.B02.1.454.heavy.1.nb
tggtacagcctggggggtccctgagactctcctgtgcagcctctggtttcatctttagcaactacgccatgagctgggtccgccaggctccagggaaggggctggagtgggtctcaggtattaatgggaatggtgataccacatactacgcagactcagtgaagggccggttcaccatctccagggacaattccaagaacacactgtctctgcaaatgaacagcctgagagtcgaggacacggcc

SEQ ID NO: 296120 - DNA, 99 bp, Homo sapiens
  misc_feature: NA.37.18.B07.1.454.heavy.1.nb
tattttggaaggtgtccagtgtgaggtgcaattggtggagtctgggggaggcctcgtccagccgtggggggtccctgagactctcctgtgtagcctctg

SEQ ID NO: 296121 - DNA, 307 bp, Homo sapiens
  misc_feature: NA.37.19.B08.1.454.heavy.1.nb
ctggggcctcagtgaaggtctcctgcaaggcttctggatacaccttcaccaattatgatatcaactgggtgcgacaggccactggacaagggcttgagtggatgggatggatgaaccctaacagtaataacacaggctatgcacagaagttccagggcagagtcaccttgaccaggaacacctccataaccacagcctacatggagctgagcagcctgagatctgaggacacggccgtgtattactgtgcgagaggcatctatagcagtggctggtacatctggggtccccactactactactacat

SEQ ID NO: 296122 - DNA, 468 bp, Homo sapiens
  misc_feature: NA.37.2.A02.1.454.heavy.1.nb
tggacctcctgtgcaagaacatgaagcacctgtggtttttcctcctgctggtggcagctcccagatgggtcctgtcccaggtgcaactgcaatagtcgggcccaggaatggtgaagccttcggagaccctgtccctcacctgcactgtctctggttactccatcagcagtggttactactggggctggatccggcagcccccagggaaggggctggagtggattgggactatctctcatagtgggagcacctactataacccgtccctcaagagtcgaggcgccatatcagtagacacgtccaagaaccagttctccctgaagctgagttctgtgaccgccgcagacacggccgtctattactgtgcgagagttggccccatagtaccagctgtcttccgccatgcttttgatatctggggccaagggacaatggtcaccgtctcttcagcctccaccaagggcccat

SEQ ID NO: 296123 - DNA, 115 bp, Homo sapiens
  misc_feature: NA.37.2.A02.2.454.heavy.1.nb
gttggccgaattagaagtaaagctaacagttacgcgacagcatatgttgcgtcggtgaaaggcaggttcaccatctccagagatgattcaaagacacggcgtttctgcaaatgaa

SEQ ID NO: 296124 - DNA, 617 bp, Homo sapiens
  misc_feature: NA.37.20.B09.1.454.heavy.1.nb
ccctgggattttcaggttgttttcatttggtgatcaggactgaacagagagaactcaccatggagcttgggctgagctggtctttttcttgtggctattttaaaaggtgtccagtgtgaggtggaggtgttggagtcgtgggggaggcttggtacggccgtggggggtccctgagactctcctgtgcagcctctggaataatctttagcaaatacgccatgatctgggtccgccaggctccgagggaaggggctggagtgggtctcagccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaacggtgaccacattggagcttttgacttctggggccaagggacaacggtcaccgtctcttcagcctccaccaagggcccatcggtcttccccctggcgccctgctccaggagcacctccgagagcacagcggccctgggctgcctggtcaaggactacttccatctacactactgagcgggctggcaaggcgcata

SEQ ID NO: 296125 - DNA, 439 bp, Homo sapiens
  misc_feature: NA.37.22.B11.1.454.heavy.1.nb
tgtgcagcctctggattcaccttcagcagctatgccatgacctgggtccgccaggctccagggaagggactggagtgggtctcgtctattagtggaagtggtgcttatacaaactacgcagcctccgtgaagggccgcttcaccatctccagagactattccaagagcactctgtatctgcaaatgaacagcctgagtgccgaggacacggccctatattattgtgcgaaatgtggggggagtgggggctactcctggcgttttgactacgtggggccagggagccctggtcaccgtctcctcagcctccaccaagggcccatccggtcttccccctggcgccctgctccaggagcacctccgagagcacagcggccctgggctgcctggtcaaggactacttccatctacactactgagcgggctggcaaggcgcata

SEQ ID NO: 296126 - DNA, 422 bp, Homo sapiens
  misc_feature: NA.37.23.C01.1.454.heavy.1.nb
tgagactctcctgcatagactcatacttgagtatgagttcattcttcatgggctgggcccgccaggctccagggaaggggctggagtgggtggccaacatagcgagcgatggaagtgagagaaattatgtggactctgtgaagggccgattcaccatctccagagacaactccaagaactcagtgtatctacacatgaacaaccttagagtcgaggacacggctgtttattactgtagaaaaggccactatggagtctggggccgagggaccacggtcaccgtctcctcagcctccaccaagggcccatcggtcttccccctggcgccctgctccaggagcacctccgagacgcacagcggccctgggctgcctggtcaaggactacttccatctacactactgagcgggctggcaaggcgc

SEQ ID NO: 296127 - DNA, 117 bp, Homo sapiens
  misc_feature: NA.37.25.C03.1.454.heavy.1.nb
gctttttcttgtggctattttaaaaggtttccagtgtgaggtgcagttgttggagtctgggggaggcctggtgcagcctggggggtccctgagactctcctgtgcagcctctggatt

SEQ ID NO: 296128 - DNA, 247 bp, Homo sapiens
  misc_feature: NA.37.25.C03.2.454.heavy.1.nb
aatgtttagcaactctggcatgaactgggtccgccaggctccaggcatggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccaggg

SEQ ID NO: 296129 - DNA, 258 bp, Homo sapiens
  misc_feature: NA.37.25.C03.4.454.heavy.1.nb
catctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacgg

SEQ ID NO: 296130 - DNA, 47 bp, Homo sapiens
  misc_feature: NA.37.26.C04.1.454.heavy.1.nb
tgggtacagcctggggggtccctgagactctcctgtgcagcctctgg

SEQ ID NO: 296131 - DNA, 35 bp, Homo sapiens
  misc_feature: NA.37.26.C04.12.454.heavy.1.nb
catactacgcagactccgtgaagggccgttcacca

SEQ ID NO: 296132 - DNA, 22 bp, Homo sapiens
  misc_feature: NA.37.26.C04.14.454.heavy.1.nb
aaggggctggagtgggtctcag

SEQ ID NO: 296133 - DNA, 242 bp, Homo sapiens
  misc_feature: NA.37.26.C04.15.454.heavy.1.nb
ccatttccggcaatggtggtggcacgcactacgcagactccgtgaagggccggttcaccgtctccagagacaattccaggaacactctatatctgcaaatgaacagcctgagagccgacgacacggccatatattattgtgcgaaagaccccaaggtgaccacattggagtcttttgacttctggggccaagggacaacggtcaccgtctcttcagcctccaccaagggcccatccggtctt

SEQ ID NO: 296134 - DNA, 180 bp, Homo sapiens
  misc_feature: NA.37.26.C04.16.454.heavy.1.nb
ttattagtggtagtggtagtagcacagattacgcagactccgtgaagggccggttcaccatctccagagacaattccaacagcacgctgtatttgcacatgaacagcctgagagccgaggacacggccatatattattgtgacgtaaactttccttttgacttggttattactccctagt

SEQ ID NO: 296135 - DNA, 230 bp, Homo sapiens
  misc_feature: NA.37.26.C04.17.454.heavy.1.nb
catggggctgcagtgggtctcaagtactagtgctcctggtaatagagcagactacgcagactccgtgaagggccggttcaccatctccagagacaattccaagaacacgctctatctgcaaatgaacagcctgagagccgaagacacggccgtatattactgtgtgaaaggctggggatggggggactacgtggggccagggaaccctggtcaccgtctcctcagcctcc

SEQ ID NO: 296136 - DNA, 166 bp, Homo sapiens
  misc_feature: NA.37.26.C04.18.454.heavy.1.nb
gttgtagtgattgttggatgggttgggtccgccaggctccagggaaggggctggagtgggtggccaacataaagcgagatggaagcgaagaaatactatgtggactctgtggaggggccattcacatctccacagacaaccgccaaagaaatcaattctttttgac

SEQ ID NO: 296137 - DNA, 66 bp, Homo sapiens
  misc_feature: NA.37.26.C04.2.454.heavy.1.nb
tttcatctttagcaactacgccatgagctgggtccgccaggctccagggaaggggctggagtgggt

SEQ ID NO: 296138 - DNA, 29 bp, Homo sapiens
  misc_feature: NA.37.26.C04.3.454.heavy.1.nb
ctcaggtattactggtagtggtaataccg

SEQ ID NO: 296139 - DNA, 36 bp, Homo sapiens
  misc_feature: NA.37.26.C04.4.454.heavy.1.nb
catactacgcagactccgtgacgggccggttcaccg

SEQ ID NO: 296140 - DNA, 20 bp, Homo sapiens
  misc_feature: NA.37.26.C04.5.454.heavy.1.nb
tctccagagacaattccaag

SEQ ID NO: 296141 - DNA, 236 bp, Homo sapiens
  misc_feature: NA.37.26.C04.7.454.heavy.1.nb
ggccaacatacagggaggtggtggtacgaaaaactatgtggactctgtgcggggccgattcaccatctccagagacaacgccaaaaactcactgtatctgcaaatggacggcctgagatccgaggacacggctgtgtattattgtgcgagagatttagactacaaagtttcgagtgactggtatgatgcttatgataccgtggggccaagggaccatggtcaccgtctcttcagcc

SEQ ID NO: 296142 - DNA, 226 bp, Homo sapiens
  misc_feature: NA.37.26.C04.8.454.heavy.1.nb
aattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggcacggcttatttattactgcgcgagagaaggact

SEQ ID NO: 296143 - DNA, 276 bp, Homo sapiens
  misc_feature: NA.37.26.C04.9.454.heavy.1.nb
ctcagccattagtagtagtggtggaagcacgtactacgctgactccgtgaagggccggttcgccctctccagagacaactccaacaacacgctgtctctgcaacttaacagcctgagagacgaggacacggccgtatattactgtgcgaaggaagggtctagcagtgcctggtactcccactactatatggacgtctggggcaaaggatcgctgtcacgtctcctcagcctccaccaagggcccatcggtcttccccctggccaccctcctccaac

SEQ ID NO: 296144 - DNA, 369 bp, Homo sapiens
  misc_feature: NA.37.29.C07.1.454.heavy.1.nb
  modified_base (184)..(184): a, c, t, g, unknown or other
  misc_feature (184)..(184): n is a, c, g, or t
tctcaggcattagtattgatggtgataccacatactacgcagactccgtgaagggccggtttaccatctccagagacaagtccaagaacacgctgtatctgcaaatgaacagcctgagagccgaggacacggccgtatattactgttcgaaagataggtactctggttcggcgacttttttaangtccatctttgaccactggggccagggaaccctggtcaccgtctcctcagcctccaccaagggcccatcggtccttccccctggccgccctgcctccaggagcacctccgagagcacagccggcctgggctgcctggtcaaggctacttccatctacactactgagcgggctggcaaggcgcata

SEQ ID NO: 296145 - DNA, 76 bp, Homo sapiens
  misc_feature: NA.37.29.C07.2.454.heavy.1.nb
tatgtggactctgtgaagggccgtttcaccatctccagagacaacgccaagaactccgtgcatctgcaaatgaaca

SEQ ID NO: 296146 - DNA, 368 bp, Homo sapiens
  misc_feature: NA.37.31.C09.1.454.heavy.1.nb
tgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccatctacactactgagcgggctggcaaggcgcata

SEQ ID NO: 296147 - DNA, 597 bp, Homo sapiens
  misc_feature: NA.37.33.C11.1.454.heavy.1.nb
aagagccttagccctggactccaaggcctttccacttggtgatcagcactgagcacagaggactcaccatggaattggggctgagctgggttttccttgttgctattttagaaggtgtccagtgtgaagtgcagctggtggactcgtgggggaggcctggtccagccgtggggggtccctgagactctcctgtgcaacctctggattcagttgtagtgattgttggatgggttgggtccgccaggctccagggaaggggctggagtgggtggccaacataaagcgagatggaagcgagaaatactatgtggactctgtgaggggccgattcaccatctccacagacaacgccaagaaatcaatctttttgcaaatgaacagtctgagagtcgaggacacggccatgtattactgtacgagagaacagacttggggccagggaaccctggtcaccgtctcctcagcctccaccaagggcccatcggtcttccccctggcgccctgctccaggagcacctccgagagcacagcggccctgggctgcctggtcaaggactacttccatctacactactgagcgggctggcaaggcgcata

SEQ ID NO: 296148 - DNA, 254 bp, Homo sapiens
  misc_feature: NA.37.33.C11.3.454.heavy.1.nb
tccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagtacggagtatagcagcagctctgactactggggccacggaaccctggtcaccgtctcctcagcctccaccaac

SEQ ID NO: 296149 - DNA, 517 bp, Homo sapiens
  misc_feature: NA.37.34.D01.1.454.heavy.1.nb
agaggagccttagccctggactccaaggcctttccacttggtgatcagcactgagcacagaggactcaccatggaattggggctgagctgggttttccttgttgctattttagaaggtgtccagtgtgacgtgcaactggtggagtcgtgggggaggcttggtccagcctggggggtccctgagactctcctgtgcagcctctggattcaactttggtagctattggatggactgggtccgccagtctccgagggaaggggctggagtgggtggccaacatacagggaggtggtggtacgaaaaactatgtggactctgtgcggggccgattcaccatctccagagacaacgaccaaaaactcactgtatctgcaaatggacggcctgagatccgaggacacggctgtgtattattgtgcgagagatttagactacaaagtttcgagtgactggtatgatgcttatgataccgtggggccaagggaccatggtcaccgtctcttcagcctccaccaa

SEQ ID NO: 296150 - DNA, 315 bp, Homo sapiens
  misc_feature: NA.37.35.D02.1.454.heavy.1.nb
cagcaaccacatctgtcctctagagaatcccctgagagctccgttcctcaccatggactggacctggaggatcgtcttcttggtggcagcagtcacaggagcccactcccaggtgaaattggtgcagtcttcctttgaggtgaagaagcctggggcctcagtgaaggtcccctgccaggcttctggatacatcttcaacgcctattatatacactggtgcgccaggcccctcgacaagggcctgagtggatgggatacatcaaccccgacactggcgacacaaagtctgcacatgactttcagggcagagtcacc

SEQ ID NO: 296151 - DNA, 412 bp, Homo sapiens
  misc_feature: NA.37.37.D04.1.454.heavy.1.nb
accacacccctccttgggagaatcccctagatcacagctcctcaccatggactggacctggagcatccttttcctggtggcagcagcaacaggtgcccactctcaggttcagctggtgcagtctggagctgaggtgaagaagcctggggcctcagtgaaggtctcctgcaaggcttctggttatacctttagcaattatggtatcaactgggtgcgacaggcccctggacaaggccatgagtggatgggatggatcagcgcttacaataataacacacactatgcacagaagttccagggcagagtcaccctgaccacagatacatccacgagcacagcctacatggagctgaggagcctgagatctgacgacacggccgtgtttactgtgcgagagtacagaatattgtaa

SEQ ID NO: 296152 - DNA, 373 bp, Homo sapiens
  misc_feature: NA.37.41.D08.1.454.heavy.1.nb
gtttcatacattagtattagtggcagtagaatatattacgcagactctgtgaagggccgattcaccatctccagggacaatttcaagaactcactgaatctgcaaatgaacagcctgagagccgaggacacggccgtatattactgtgcgagaaccggtagcgggtcgtcaggggggaatctttactattattactacatggacgtctggggcaaagggaccacggtcaccgtctcctcagcctccaccaagggcccatcggtcttccccctggcaccctcctccaagacgcacctctggggcacagcggccctgggctgcctggtcaaggctacttccatctacactactgagcgggctggcaaggcgcata

SEQ ID NO: 296153 - DNA, 347 bp, Homo sapiens
  misc_feature: NA.37.42.D09.1.454.heavy.1.nb
attgggtatatccattacagtgggaggaccaactacaacccctccctcaagagtcgagtcaccatatcagtagacacgtccaagaaccagttctccctgaagctgagctctgtgaccgctgcggacacggccgtatattactgtgcgagaaaccaacccttctactactacatggacgtctggggcaaggggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcata

SEQ ID NO: 296154 - DNA, 361 bp, Homo sapiens
  misc_feature: NA.37.46.E02.1.454.heavy.1.nb
ttggccgaattagaagtaaagctaacagttacgcgacagcatatgttgcgtcggtgaaaggcaggttcaccatctccagagatgattcaaagaacacggcgtttctgcaaatgaacagcctgaaaaccgaggacacggccgtgtattattgtatgtatagcagtggctcagggtactactacgggatggacgtctggggccaagggaccacggtcaccgtctcctcagcctccaccaagggcccatcggtcttccccctggcaccctcctccaagagcacctctgggggcacagcggccctgggctgcctggtcaaggactacttccatctacactactgagcgggctggcaaggcgcata

SEQ ID NO: 296155 - DNA, 417 bp, Homo sapiens
  misc_feature: NA.37.51.E07.1.454.heavy.1.nb
gagggagccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctggggagtccctgagactctcctgtgcagcctctggattcaccttcagtagctatagcatgaactgggtccgccaggctccgagggaaggggctggagtgggtctcatccattagtagtagtggtacttacatatactacgcagactcagtgaggggccattcaccatctccagagacaacgccaagaactcactgtatctagcaaatgaacagcctgagagccgaggacacggctgtgtattactgt

SEQ ID NO: 296156 - DNA, 316 bp, Homo sapiens
  misc_feature: NA.37.55.E11.2.454.heavy.1.nb
actctcctgtgcagcctctggattcacctttggcagctttgccatgagctgggtccgccaggctccgagggaagggctggaatgggtctcagccattagtagtagtggtggaagcacgtactacgctgactccgtgaagggccgttcgccctctccagagacaactccaacaacacgctgtctctgcaacttaacagcctgagagacgaggacacggccgtaatattactgtgcgaaggaggtctagcagtgcctggtactcccactactatatggacgtcgtgggcaaaggatcgcggtcaccgtctcctcagcc

SEQ ID NO: 296157 - DNA, 92 bp, Homo sapiens
  misc_feature: NA.37.55.E11.3.454.heavy.1.nb
ctttttcttgtggctattttaaaaggtgtccagtgtgaggtgcagctgtcggagtctgggggaggcttggtacagcctggggggtccctgac

SEQ ID NO: 296158 - DNA, 613 bp, Homo sapiens
  misc_feature: NA.37.57.F02.1.454.heavy.1.nb
agaggagccttagccctggactccaaggcctttccacttggtgatcagcactgagcacagaggactcaccatggaattggggctgagctgggttttccttgttgctattttggaaggtgtccagtgtgaggtgcaattggtggagtcgtgggggaggcctcgtccagcctggggggtccctgagactctcctgtgtagcctctgaattcccctttacggcttattggatgagctgggtccgccaggctccagggaaggggctggagtgggtggccaacataaagcaagatggaagtaagaaggagtatgtggactctgtgaagggccgtttcaccatctccagagacaacgccaagaactccgtgcatctgcaaatgaacagtctgagagccgaggacacggctatttattactgcgcgagagaaggactgggcggtttcgactacgtggggccagggaaccctggtcaccgtctcctcagcctccaccaagggcccatcggtcttcccctggcgccctgctccaggagcacctccgagagcacagcggccctgggctgcctggtcaaggactacttccatctacactactgagcgggctggcaaggcgcata

SEQ ID NO: 296159 - DNA, 267 bp, Homo sapiens
  misc_feature: NA.37.57.F02.2.454.heavy.1.nb
agactctcctgtgtagcctctgaattcccctttacggcttattggatgagctgggtccgccaggctccagggaaggggctggagtgggtctcaggtattactgctagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctct

SEQ ID NO: 296160 - DNA, 351 bp, Homo sapiens
  misc_feature: NA.37.60.F05.1.454.heavy.1.nb
gattggatacgtctattatagtgggagcacctactacaacccgtccctcaagagtcgagtttccatgtcagttgacacgtctaagaccaaatctccctcaggctgacctctgtgactgccgcggacacggccgtctattattgtgcagggtcccgaacagtagttgttccagctgcgattgactactggggccacggatcctggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcata

SEQ ID NO: 296161 - DNA, 415 bp, Homo sapiens
  misc_feature: NA.37.61.F06.1.454.heavy.1.nb
ggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgagaaatactatgtggactctgtgaagggccgattcaccatctccagagacaacgcccagaactcattgtatctgcaaatgaacagactgagagccgaggacacggctgtgtattactgtgcgagagaggaggcgattagtgtaaatggctgggccttctactactactactacatggacgtctggggcaaagggaccacggtcaccgtctcctcacgcctccaccaaggccca

SEQ ID NO: 296162 - DNA, 445 bp, Homo sapiens
  misc_feature: NA.37.62.F07.1.454.heavy.1.nb
ctcctgtgcagcttcaggattcagctttagcagctacgccatgagctgggtccgccaggctccagggaagggactggagtgggtctcaggtattggtggcagtggtgagaccacatactacgcagactccgtgaagggccggttcaccatctccagagacaattccaagaacaccctgtctctgcaaatgaacaacctgagagccgaggacacggccctatattactgtacgaaaatggcctacggatatgactactattgggactggtacttcgatctctggggccgtggcaccctggtcactgtctcctcagcctccaccaagggcccatcggtcttcccctggcgccctgctccaggagcacctccgagagcacagcggccctgggctgcctggtcaaggctacttccatctacactactgagcgggctggcaaggcgcata

SEQ ID NO: 296163 - DNA, 251 bp, Homo sapiens
  misc_feature: NA.37.62.F07.2.454.heavy.1.nb
ggtctcaggtattggtggcagtggtgagaccacatactacgcagactccgtgaagggccgcttcaccatctccagagactattccaagagcactctgtatctgcaaatgaacagcctgagtgccgaggacacggccctatattattgtgcgaaatggtggggggagtgggggctactccgtggtcgttttgactacgtgggccagggagccctggtcaccgtctcctcagcctcaccaagggccatcggtc

SEQ ID NO: 296164 - DNA, 358 bp, Homo sapiens
  misc_feature: NA.37.68.G02.1.454.heavy.1.nb
gtctcagttattagtggtagtggtagtagcacagattacgcagactccgtgaagggccggttcaccatctccagagacaattccaacagcacgctgtatttgcacatgaacagcctgagagccgaggacacggccatatattattgtgcgaaacttccttttgactggttattatcccctagtgaccactggggccagggaaccctggtcaccgtctcctcagcctccaccaagggcccatcggtccttccccctggccaccctcctccaagagcacctctgggggcacagcggccctgggctgcctggtcaaggactacttccatctacactactgagcgggctggcaaggcgcata

SEQ ID NO: 296165 - DNA, 361 bp, Homo sapiens
  misc_feature: NA.37.71.G05.1.454.heavy.1.nb
tggattccaaggcatttccacttggtgatcagcactgaacacaaaggactcaccatggagttgggctgttctggattttccttgttgctgttttagaaggagtccactgtgaggtacagctggtggaatcgtgggggagcttggtacagcctggagggtccctgagactctcctgtgcatcgtctggattcaccttccgagtcttttgacatgagctgggtccgccgggctccgaggggaagggtctggagtgggtctcatccatcagttacaatggtacaaaccatatactacgcagtatttgtgaagggccgcttcaccatctccagagacaacgccaagagctctctgttctgcatat

SEQ ID NO: 296166 - DNA, 117 bp, Homo sapiens
  misc_feature: NA.37.76.G10.2.454.heavy.1.nb
tctgtgaagggccgattcaccatctccagagactattccaagagcacttctgtatctgacaaatgaacagcctgagtgccgaggacacggtccctatatttattgtgacgaaagtgg

SEQ ID NO: 296167 - DNA, 93 bp, Homo sapiens
  misc_feature: NA.37.77.G11.1.454.heavy.1.nb
gtgggtctcagctattaatgggaatggtgataccacatactacgcagactccgtgaagggccggttcaccatctccagggacaattccaagaa

SEQ ID NO: 296168 - DNA, 58 bp, Homo sapiens
  misc_feature: NA.37.77.G11.2.454.heavy.1.nb
cacactgtctctgcaaatgaacagcctgagagtcgaggacacggccttatattactgt

SEQ ID NO: 296169 - DNA, 78 bp, Homo sapiens
  misc_feature: NA.37.77.G11.3.454.heavy.1.nb
ggtgaccagggttccctggccccagtcgtcaaagtaccaggaccagccgctgctataaggggctagaggtcccttcac

SEQ ID NO: 296170 - DNA, 369 bp, Homo sapiens
  misc_feature: NA.37.80.H03.1.454.heavy.1.nb
gagttgggcgtgtctatagtagtggcagtaccgactacaaccctccctcaagggtcgagtcaccatgtcagtagacacgtccaagaatcagttttccctgaaggtgacctctgtgaccgccgcggacacggccgcgtattactgtgcgagaggtcggtcggggtctacgatttttggactacttttactactacatggacgtctggggcaaagggaccaaggtcaccgtctcctcagcctccaccaagggcccatcggtcttccccctggcaccctcctccaagagcacctctgggggcacagcggcctgggctgcctggtcaaggactacttccatctacactactgagcgggctggcaaggcgcata

SEQ ID NO: 296171 - DNA, 295 bp, Homo sapiens
  misc_feature: NA.37.80.H03.2.454.heavy.1.nb
cggtccccccaggagttcaggtgctgggcacggtgggcatgtgtgagttttgtcacaagatttgggctcaactctcctgtgcagcctctggattcacctttaatacctattggatgagttgggtccgccaggttccagggaaggggctggagtgggtggccaacataaagcaagatggaagtgaagaaatactatgtggactctgtgaagggccgattcaccatctccagagacaacgcccaagaactcattgtatctgacaaatgaacagactgagagccgaggacacggctgt

SEQ ID NO: 296172 - DNA, 368 bp, Homo sapiens
  misc_feature: NA.37.83.H06.2.454.heavy.1.nb
cagccctgggattttcaggtgttttcatttggtgatcaggactgaacagagagaactcaccatggagtttgggctgagctggtctttttcttgtggctattttaaaaggtgtccagtgtgaggtgcagctgctggagtcgtgggggaggcttggtacagccgggggggtccctggagactctcctgtgaagcctctggattcacctttgacaagtgtgccatgacctgggtccgccaggctccgagggaaggggctgggagtgggtctcagttattagtggtagtggtagtagcacagattacgcagactccgtgaagggccggttcaccatctccagagacaattccaacagcacgctgtattgcac

SEQ ID NO: 296173 - DNA, 411 bp, Homo sapiens
  misc_feature: NA.37.87.H10.1.454.heavy.1.nb
gtacagcctggggggtccctgagactctcctgtgcagcctctggtttcatctttagcaactacgccatgagctgggtccgccaggctccagggaaggggctggagtgggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactacgtggggccacggaaccctggtcaccgtctcctcacgcctccaccaacgggcccactccggtccttccccctggccaccctcctccaacgacgccacctcgtcggggcacgacgccgg

SEQ ID NO: 296174 - DNA, 205 bp, Homo sapiens
  misc_feature: NA.37.87.H10.2.454.heavy.1.nb
gtacagcctggggggtccctgagactctcctgtgcagcctctggattcaactttggtagctattggatggactgggtccgccagtctccagggaaggggctggagtgggtggccaacatacaggggaggtggtggtaacgaaaaactatgtggactctgtgcgggccgattcaccatctccagagacaacgaccaaaaactcact

SEQ ID NO: 296175 - DNA, 118 bp, Homo sapiens
  misc_feature: NA.38.13.B02.2.454.heavy.1.nb
tatgcgccttgccagcccgctcagtcgatcacgtggaagtagtccttgaccaggcagcccagggccgctgtgcccagcacctgaactcctgggggaccgtcagtcttcctcttccccc

SEQ ID NO: 296176 - DNA, 410 bp, Homo sapiens
  misc_feature: NA.38.14.B03.1.454.heavy.1.nb
gaggagcccagccctgagattttcaggtgttttcatttggtgatcaggactgaacagagagaactcaccatggagtttgggctgaactggctttttctcgtggctattttaaaaggtgtccagtgtgaggtgcagctgttggagtcgtgggggagcttggtacagcctggggggtccctgagactctcctgtgcagcctctggattcacctttaagaattatgccatgaactgggtccgccaggctccgagggaaggggctggagtgggtctcatctatgagcgctagtggtggtagggcagactactcagactccgtgaacgggccggttcaccatttccagagacaattccaagaacacgctgtctctgttaatgaacagcctgagagtcgaggacacggccaatata

SEQ ID NO: 296177 - DNA, 125 bp, Homo sapiens
  misc_feature: NA.38.14.B03.2.454.heavy.1.nb
tatgcgccttgccagcccgctcagtcgatcacgtggaagtagtccttgaccaggcagcccagggccgctgtgcccccagaggtgctcttggaggagggtgccagggggaagaccgatgggccctt

SEQ ID NO: 296178 - DNA, 103 bp, Homo sapiens
  misc_feature: NA.38.14.B03.3.454.heavy.1.nb
tatgcgccttgccagcccgctcagtcgatcacgtgaggagggtgggaacagagtgaccgaggggcagccttgggctgacctaggacggtcagtttggtccctc

SEQ ID NO: 296179 - DNA, 414 bp, Homo sapiens
  misc_feature: NA.38.16.B05.1.454.heavy.1.nb
gtctttttcttgtggctattttaaaaggtgtccagtgtgaggtgcaggtgtcggagtctgggggaggcttggttcagcctggggggtccctgagactctcctgtgcagtctctggatttaacctttagtgactatgccatgatctgggtccgccaggctccgagggaggggctggagtgggtctcagcaattaatgggtaggggtgattcaccatattacgcagactccggtggggggccgttcaccatcaccagagacaactccaggagcacactatatctaacaaatgcacagcctgagagtcgaggacacggccgtgtattattgtgcgagagatccccaaggtgaccaccttggtgcttttgattttctgtggccaagggacaatggtcaccgtctcttcagcctccacc

SEQ ID NO: 296180 - DNA, 353 bp, Homo sapiens
  misc_feature: NA.38.20.B09.1.454.heavy.1.nb
agttattagtggtagtggtagtagcacagattacgcagactccgtgaagggccggttcaccatctccagagacaattccaacagcacgctgtatttgcacatgaacagcctgagagccgaggacacggcccatatattattgtgcgaaacttccttttgactggttattactcccctagtgaccactggggccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcata

SEQ ID NO: 296181 - DNA, 336 bp, Homo sapiens
  misc_feature: NA.38.22.B11.2.454.heavy.1.nb
ccaccaccacgcatgtgacctcaggggtccgggagatcatgagggtgtccttgggttttggggggaagaggaagactgacggtccccccagcagcaacaggtgcccactcccaggttcagctggtgcagtctggagctgaggtgaagaagccgtggggcctcagtgaaggtctcctgcaaggcttctggttacacctttaccaactatggtatcaactgggtgcgacaggcccctggacaagggcttgagtggatgggatggatcagcgcttacaataataacacacactatgcacagaagttccagggcagagtcaccgtgaccacggacacact

SEQ ID NO: 296182 - DNA, 404 bp, Homo sapiens
  misc_feature: NA.38.23.C01.1.454.heavy.1.nb
agagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccagggacgggctgggagtgggtggccactataaaccacgatggaactgaaaaagctatgtggactctgtgaagggccgattcaccgtctccagagacaacgccaagaattcactgtatttgcaaatgaacagcctgagagtcgaagacacggcc

SEQ ID NO: 296183 - DNA, 82 bp, Homo sapiens
  misc_feature: NA.38.23.C01.3.454.heavy.1.nb
catgtggcagttatgtcacatgatggaagaaaaaaatttacgcagactccctgaagggtcgattcaccatctccagagacaa

SEQ ID NO: 296184 - DNA, 417 bp, Homo sapiens
  misc_feature: NA.38.25.C03.1.454.heavy.1.nb
accacacccctccttgggagaatcccctagatcacagctcctcaccatggactggacctggagcatccttttcttggtggcagcagcaacaggtgcccactcccaggttcaattggtgcagtctggagctgcggtgaagaggcctggggcctcagtgaacgtctcctgcaaggcttctggttactacttttagcagttatggtgtcagctgggtgcgacaggcccctggacaagggcttgagtggatgggatggatcagcacttacaatggaaacacaaagtatgcacataatttccagggcagagtcatcatgaccacagacacatccacgagcactgcctacatggaactgaggaacctgagatctgacgacacggccttatattattgtgcgagagacaaattcctccttacat

SEQ ID NO: 296185 - DNA, 337 bp, Homo sapiens
  misc_feature: NA.38.26.C04.2.454.heavy.1.nb
acaaccacattcctcctctaaagaagcccctgggagcacagctcatcaccatggactggacctggagttcctctttgtggtggcagcagctacaggtgtccagtcccaggtgcagttggtgcagtctggggctgaggtgaagaagcctgggtcctcggtgaaggtcccctgcaaggcttctggaggcaccttcagcacctatactttcagctgggtgcgacaggcccctggacaagggcttgagtggatgggaggatcctcccgatctttggcaaaccacactacgcacacaagttccaggacagactcacgattaccgcggacgaatccacgagca

SEQ ID NO: 296186 - DNA, 109 bp, Homo sapiens
  misc_feature: NA.38.26.C04.3.454.heavy.1.nb
ctatgcgccttgccagcccgctcagtcgatcacgtggaagtagtccttgaccaggcagcccagggccgctgtgcccagcacctgaactcctgggggaccgtcagtcttc

SEQ ID NO: 296187 - DNA, 332 bp, Homo sapiens
  misc_feature: NA.38.27.C05.2.454.heavy.1.nb
acccagcaaccacatctgtcctctagagaatcccctgagagctccgttcctcaccatggactggacctggaggatcgtcttcttggtggcagcagtcaaaggagcccactcccaggtgaaattggtccagtctgggtttggcgtgaggaagcctggggcctcagtgattgtcccctgccaggcttccggatatatcttcgacttctactatttacactgggtgcgccaggtccctggacaagggcctgagtggatgggatgcatcaacccagaactggcacacaaagtctgcacagaagtttcagggcagggtcaccatgaccgagacacgt

SEQ ID NO: 296188 - DNA, 106 bp, Homo sapiens
  misc_feature: NA.38.27.C05.3.454.heavy.1.nb
tatgcgccttgccagcccgctcagtcgatcacgtggaagtagtccttgaccaggcagcccagggccgctgtgcccagcacctgaactcctgggggaccgtcagtct

SEQ ID NO: 296189 - DNA, 624 bp, Homo sapiens
  misc_feature: NA.38.28.C06.1.454.heavy.1.nb
aggagcccagccctgggattttcaggcgttttcatttggtgatcaggactgaacagagagaactcaccatggagtttgggctgagctggctttttcttgtggctattttaaaaggtgtccagtgtgaggtgcaggtgtcggagtctgggggaggcttggttcagcctggggggtccctgagactctcctgtgcagtctctggattaacctttagtgactatgccatgatctgggtccgccaggctccaggggaaggggctggagtgggtctcagcaattaatgggtaggggtgattcaccatattacgcagactccggtggggggccgttcaccatcaccagagacaactccaggagcacactatatctacaaatgcacagcctgagagtcgaggacacggccgtgtattattgtgcgagagatcccaacggtgaccaccttggtgcttttgatttctgtggccaagggacaatggtcaccgtctcttcagcctccaccaagggcccatcggtcttccccctggcgccctgctccaggagcacctccgagagcacagcggccctgggctgcctggtcaaggactacttccacgtgatcgactgagcgggctggcaaggcgcata

SEQ ID NO: 296190 - DNA, 57 bp, Homo sapiens
  misc_feature: NA.38.3.A03.2.454.heavy.1.nb
tatgcgccttgccagcccgctcagtcgatcacgtggaagtagtccttgaccaggcag

SEQ ID NO: 296191 - DNA, 380 bp, Homo sapiens
  misc_feature: NA.38.30.C08.1.454.heavy.1.nb
agaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggagcttggtacagccgtggggggtccctgagactctcctgtgcagcctctggattcacctttagcagctatgccatgagctgggtccgccaggctccgagggacgggtctggagtgggtctcacttatcagtaatagtggtggtaccacattcgacgcagactccgtgaagggccgttcaccatctccagagacaattccaagaacacactatacctgacaaatgaa

SEQ ID NO: 296192 - DNA, 174 bp, Homo sapiens
  misc_feature: NA.38.30.C08.2.454.heavy.1.nb
tatgcgccttgccagcccgctcagtcgatcacgtggaagtagtccttgaccaggcagcccagggccgctgtgcccccagaggtgctcttggaggagggtgccagggggaagaccgatgggcccttggtggaggctgaggagacggtgaccagggttccctggccccaggagtca

SEQ ID NO: 296193 - DNA, 181 bp, Homo sapiens
  misc_feature: NA.38.34.D01.1.454.heavy.1.nb
tatgcgccttgccagcccgctcagtcgatcacgtggaagtagtccttgaccaggcagcccagggccgctgtgctctcggaggtgctcctggagcagtgcgccaggggaagaccgatgggcccttggtggaggctgaggagacggtgaccagggttccctggccccagtagtcaaaatgcca

SEQ ID NO: 296194 - DNA, 292 bp, Homo sapiens
  misc_feature: NA.38.35.D02.1.454.heavy.1.nb
gagaggagcccagcactagaagtcggcggagtttccattcggtgatcagcactgaacacagaggactcaccatggagtttgggctgaactgggttttcctcgtagctcttttaagaggtgtccagtgtcagatgcagctggtggagtcgtgggggagtcgtggtccagccgtggggggtccctgagactctcctgtgcagcctctggattcaacttacaaaaatttgggatgcactgggtccgccaggctccaggcaaggggctgggagtgggtggcaactatatcatatga

SEQ ID NO: 296195 - DNA, 280 bp, Homo sapiens
  misc_feature: NA.38.35.D02.2.454.heavy.1.nb
aagactgacggtcctgccacaggtggtgctgggcacggtgggcactcgacacaacatttgcgctcaactgtcttgtccagcctggggggtccctgagactctcctgtgcagcctctggattcaacttcaaaaattatgggatgcactgggtccgccaggctccaggcaaggggctggagtgggtggcaactatatcatatgatggaagttttaaagactatgcggactccgtgaagggccgattcaccatctccagagacaattccaagagcacactcta

SEQ ID NO: 296196 - DNA, 304 bp, Homo sapiens
  misc_feature: NA.38.38.D05.2.454.heavy.1.nb
agccttagccctggattccaaggcctatccacttggtgatcagcactgaccaccgaggattcaccatggaactggggctccgttgggttttccttgttgctattttagaaggtgtccagtgtgaggtgcagctggtggagtcgtgggggaggcctggtcaagccgtggggggtccctgagactctcctgtgaagtctctggattctccttcagtacttatagcatgaattgggtccgccagacctccgaggggaacggggctgggaggtgggtcgcattcatcagtactacgtgggtagtttca

SEQ ID NO: 296197 - DNA, 615 bp, Homo sapiens
  misc_feature: NA.38.4.A04.1.454.heavy.1.nb
gccttagccctggactccaaggcctttccacttggtgatcagcactgagcacagaggactcaccatggaacttggggctgagctgggttttccttgttgctattttagaaggtgtccagtgtgaggtgcagctggtggagtcgtggaggcttggtccagccgggggggtccctgagactctcctgtgcagcctctgcattcacctttagtaactatttaatgagctgggtccgccagcctccagggaaggggctggagtgggtggccagcattaaccaagatggacgtgaaaaatctatgtggactctgtgaagggccgattcgccatctccagagacaacgccaagaactcactgtggctgcacatgaacggcctgagaggcgacgacacggctgtgtacttctgtgcgagacgcccccatgagggctacagtgggagctacgactttgactacgtggggccagggaaccctggtcaccgtctcctcagccctccaccaagggcccatcggtcttccccctggccaccctcctccaagacgcacctctgggggcacagcggccctgggctgcctggtcaaggactacttccacgtgatcgactgagcgggctgg

SEQ ID NO: 296198 - DNA, 233 bp, Homo sapiens
  misc_feature: NA.38.4.A04.2.454.heavy.1.nb
tctcctgtgcagcctctgcattcacctttagcagctatgccatgagctgggtccgccaggctccagggacgggtctggagtgggtctcacttatcagtaatagtggtggtaccacattcgacgcagactccgtgaagggccggttcaccatctccagagacaattccaagaacacactatacctgacaaatgaagaccctgagagccgaggacacggccatatattactgtgt

SEQ ID NO: 296199 - DNA, 353 bp, Homo sapiens
  misc_feature: NA.38.41.D08.1.454.heavy.1.nb
ggtctcaggtattactggtagtggtaataccgcatactacgcagactccgtgacgggccggttcaccgtctccagagacaattccaagaatacggtctatctggaaatgaacagcctgagagccgaggacacggccctctattactgtgcgagagatcagacggagtatagcagcagctctgactactggggccacggaaccctggtcaccgtctcctcagcctccaccaagggcccatcggtcttccccctggcaccctcctccaagagcacctctgggggcacagcggccctgggctgcctggtcaaggctacttccacgtgatcgactgagcgggctggcaaggcgcata

SEQ ID NO: 296200 - DNA, 298 bp, Homo sapiens
  misc_feature: NA.38.5.A05.2.454.heavy.1.nb
gtttccattcagtgatcagcactgaacacagaggactcaccatggagttgggactgagctggattttccttttggctattttaaaaggtgtccagtgtgaagtgcagctggtggagtcgtgggggaggcttggtacagcctggcaggtccctgagactctcctgtgcagcctctggattcagtctttgatgattatggcatgcacgtgggtccgcaagctccgaggggaagggcctgggagtgggtctcgaggttattaggttggaacaggtggtaggataggctagtgcggactcgt

SEQ ID NO: 296201 - DNA, 487 bp, Homo sapiens
  misc_feature: NA.38.53.E09.1.454.heavy.1.nb
agccccagccctgagattcccaggtgtttccattcagtgatcagcactgaacacagaggactcaccatggagttgggactgagctggattttccttttggctattttaaaaggtgtccagtgtgaagtgcagctggtggagtcgtgggggagacttggtagagcctggcaggtccctgagactctcctgtgcagcctctggattcaaatttaatgataatgccatgcactgggtccgacaagctccagggaagggcctggagtgggtctcaagtgttagttggaacagtggtaccatagcctatgcggactctgtgaagggccgattcaccatctccagagacaacgccaagagctccctgtatctgcaaatgaacagtctgagacctgaggacacggccttctatttctgtgcaaaaggccccggtatggcagtagctaagaggttctttgactcctggggccagggacccgggtcaccgtctcct

SEQ ID NO: 296202 - DNA, 279 bp, Homo sapiens
  misc_feature: NA.39.11.A11.2.454.heavy.1.nb
tcaatagttatgtcatcacttgggtgcgacaggcccctggacaagggcttgagtgggtgggagggatcatctctatgtttggaacacccatgtttggtacaccaagttacgcacagaagttccagggcagagtcacgattaccgcggacgaatctacgagcacagcctacatggcgctgagaagtctgagatctgaggacacggccgtctatttctgtgcgagaggacgcgggtatcacttaagtagcgcgggcgactacgtggggccaggggaaccct

SEQ ID NO: 296203 - DNA, 356 bp, Homo sapiens
  misc_feature: NA.39.16.B05.1.454.heavy.1.nb
aggagccttagccctggactccaaggcctttccacttggtgatcagcactgagcacagaggactcaccatggaattggggctgagctgggttttccttgttgctattttagaaggtgtccagtgtgaggtgcagctggtggagtcgtgggggaggcttggtccagcctggggggtccctgagactctcctgtgcagcctctggattcacctttaggaactattggatgagttgggtccgccaggctgcagggaaggggctggagtgggtggccaacgatagaggtagagtggaagagagaaatactatgtggactctgtgaagggccgattcaccatctccagagacaacgccaag

SEQ ID NO: 296204 - DNA, 275 bp, Homo sapiens
  misc_feature: NA.39.2.A02.1.454.heavy.1.nb
tgtgcagcctctggattcaccttcagagacttctggatgcactgggtccgccaaactccagggcaggggctggtgtgggtctcacgtattaattttgatgggagtagcacaagctacgcggactccgtgaagggccgattcaccatctccagagacaacgccaaagaacacgctgtatctgcaaatgaacagtctgagagccgaggacacggctgtgtattactgtgcaagagatgcgccatatagcagctcgcatactattttgactacgtggg

SEQ ID NO: 296205 - DNA, 238 bp, Homo sapiens
  misc_feature: NA.39.25.C03.1.454.heavy.1.nb
accgcattcctcctctaaagaagcccctgggagcacagctcatcaccatggactggacctggaagttcctctttgtggtggcagcagctacaggtgtccagtccctggtgcagctgctgcagtcggggactgaggtgaaggagcctgggtcctcggtgagggtctcctgcaaggcttctggaggcaccttcggcaactatcctatcacctgggtgcgacacggcccctggagaaggac

SEQ ID NO: 296206 - DNA, 222 bp, Homo sapiens
  misc_feature: NA.39.26.C04.1.454.heavy.1.nb
aggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggagcttggtacaggccgggggggtccctgagactctcctgtacagcctctggattcaccttcagcacctat

SEQ ID NO: 296207 - DNA, 339 bp, Homo sapiens
  misc_feature: NA.39.29.C07.1.454.heavy.1.nb
ccaaacccctccttgggagaatcccctagatcacagctcctcaccatggactggacctggagcatccttttcttggtggtagcagcaacaggtgcccactcccaggttcagctggtgcagtctggagctgaggtgaagacgcctggggcctcagtgaaggtctcctgcaaggcttctggttacccattcaccacctttgctctcagctgggtgcgacaggcccctggacaagggcttgagtggatgggttccgtctacaacacaaaccatgcccagaagttccagggcagagtcaccatgaccacagacacatccacggacacagcctacatgaactga

SEQ ID NO: 296208 - DNA, 429 bp, Homo sapiens
  misc_feature: NA.39.34.D01.1.454.heavy.1.nb
gcccagcaaccacatctgtcctctagagaatcccctgagagctccgttcctcaccatggactggacctggaggatcgtcttcttggtggcagcagtcacaggagcccagtcccaggtgaacttggtgcagtctgggtttgaggtgaagaagcctggggcctcagtgaaggtcccctgccaggcttctggatacatcttcagcgcctattatatacactgggtgcgccaggcccctggacaagggcctgagtggatgggatgtatcaaccccgagagtggcgacacaaaatatgcacagagatttcagggcagggtcaccatgactcgggacacgtccatcaaaacagcctacatggaattcagtagactgaagtccaacgacacggccgtgtacttctgtgcgagaggcagagttccactgggataagt

SEQ ID NO: 296209 - DNA, 482 bp, Homo sapiens
  misc_feature: NA.39.37.D04.1.454.heavy.1.nb
gaggagccttagccctggactccaaggcctttccacttggtgatcagcactgagcacagaggactcaccatggaattggggctgagctgggttttccttgttggtattttagaaggtgtccagtgtgcggtgcagttggtggagtcgtgggggaggcttggtccagccgggggggtccctgagactctcctgtgcagcctctggattcccctttacgagttattggctgagctgggtccgccaggctccagggaaggggttggagtgggtggccaacataaagcaagatggaagtcggaaagagtatctggactctgtgaggggccggttcaccatctccagagacaacgccaagaactccgtgcatctgcaaatgaacagtctgagagccgaggacacggctgtttatactgcgcgagagaaggactgggcgtttcgactactggggccagggaaccctggtcaccgtctcctcagcctcc

SEQ ID NO: 296210 - DNA, 376 bp, Homo sapiens
  misc_feature: NA.39.39.D06.2.454.heavy.1.nb
gaagaggaagactgacggtcctgccacaggtggtgctgggcacggcgggcaccaactacaatgcgtccctcaggggtcgagtcaccatatctgcagacaagtccaagaaccacttctccctgaggctgacctctgtgaccgccgcggactcggccatatattattgtgcgagtagtttttgcaggatcgttggggcggtatcgacgtctggggtcaagggatcacggtcatcgtctcctcagcctccaccgaagggcccatcggtccttcccctggcgccctgctccaggagcacctccgagagcacagcggccctgggctgcctggtcaaggactacttccactagtgcgactgagcgggctggcaaggcgcata

SEQ ID NO: 296211 - DNA, 564 bp, Homo sapiens
  misc_feature: NA.39.53.E09.1.454.heavy.1.nb
gaggagccctagccctggactccaaggcctttccacttggtgatcagcactgagcacagaggactcaccatggaattggggctgagcgtggttttcctgttgctattttagaaggtgtccaatgtgaggcgcaactggtggcgtctgggggaggcttggtccagccgtggggggtccctgagactctcctgtacagcctctggattcaggtttagtgacgcctggataaactgggtccgccaggctccagggaaggggctggagtgggtcgccaacattaagaaagatggaagtgagaaaaactatgtggactctgtgaagggccggtttaccatctccagggacaacgccatgcatttagcatatttgcaaataaacagtctgagagccgaggacacggcttcatatcactgtgcgctggggcactatggattctggggccaagggaccacggtcaccgtctcctcagcctccaccaagggcccatcggtcttcccctggcgccctgctccaggagcacctccgagagcacagcggccctgggctgcctggtcaaggactact

SEQ ID NO: 296212 - DNA, 106 bp, Homo sapiens
  misc_feature: NA.39.57.F02.1.454.heavy.1.nb
tatgcgccttgccagcccgctcagtcgcactagtggaagtagtccttgaccaggcagcccagggccgctgtgcccagcacctgaactcctgggggaccgtcagtct

SEQ ID NO: 296213 - DNA, 293 bp, Homo sapiens
  misc_feature: NA.39.71.G05.1.454.heavy.1.nb
gggtatttttcaggtgttttcatttggtgatcaggactgaacagagagaactcaccatggagtttgggctgagcggtctttttcttgtggctattttaaaaggtgtccagtgtgaggtgcagctgttggagtcgtgggggaggcttggtacaggccgggggggtccctgagactctcctgtgcagcctctggattcaccttcagcagctatgccatgacctgggtcccgccaggctccgagggaaggactggagtgggtctcgtctattagtggaagtggtgcttatacaaac

SEQ ID NO: 296214 - DNA, 398 bp, Homo sapiens
  misc_feature: NA.39.81.H04.1.454.heavy.1.nb
acaacccctccttgggagaatcccctagatcacagctcctcaccatggactggacctggagcatccttttcttggtggcagcaacaacaggtgcccactcccaggttcagctggtacagtctggagctgagatgacgaagcctggggcctcagtgaaggtctcctgcaaggcttctggttacacctttaccaactatggtatcagttgggtgcgacaggcccctggacaagggcttgagtggatgggatggatcagcgcttacaatggtcacacaaactatgcacagaacctccagggcagagtcaccatgaccacagacacatccacgagcacggcctacatcggacctgaggagcctgagatctgacgacacggccgtgtattactgtgcgagaga

SEQ ID NO: 296215 - DNA, 378 bp, Homo sapiens
  misc_feature: NA.39.85.H08.1.454.heavy.1.nb
  modified_base (233)..(233): a, c, t, g, unknown or other
  misc_feature (233)..(233): n is a, c, g, or t
gcccagccctgggattttcaggtgttttcatttggtgatcaggactgaacagagagaactcaccatggagtttgggctgagctggcttttcttgtggctattttaaaaggtgtccagtgtgaggtgcagctgctggagtctgggggaggcttggtacagccgggggggtccctgagactctcctgtgaagcctctggattcacctttgacaagtgtgccatgacctgggtccnccaggctccgagggaggggctggagtgggtctcagttattagtggtagtggtagtagcacagattacgcagactccgtgaagggccggttcaccatctccagagacaattaccaacagcacgctgtatttgcacatgaacagcct

SEQ ID NO: 296216 - DNA, 145 bp, Homo sapiens
  misc_feature: NA.39.86.H09.2.454.heavy.1.nb
tcagcggcgccaacggtaagacattgtattcagagaacttccaggacagagtctccctcaccagtgacacatccgcgaacacagtctacatggaaatgaggagcctcacatactaaagacacggctctatattactgcgcgagac

SEQ ID NO: 296217 - DNA, 88 bp, Homo sapiens
  misc_feature: NA.39.86.H09.3.454.heavy.1.nb
agactgacggtcctgccacagcggccctgggctgcctggtcaaggactacttccactagtgcgactgagcgggctggcaaggcgcata

SEQ ID NO: 296218 - DNA, 365 bp, Homo sapiens
  misc_feature: NA.39.87.H10.1.454.heavy.1.nb
cagcaaccacatctgtcctctagagaatcccctgagagctccgttcctcaccatggactggacctggaggatcctcttcttggtggcagcagccacaggagcccactcccaggtgcagctggtgcagtccgggactgaggtgaagaagcctggggcctcagtgaaggtctcctgcaaggcttctggaatcaccctcaccgacgtctatatgcactggttgcgacaggcccctggacaagggcttgagtggatgggatggatcaacggtaacagtggtctcacaaattatgcacagaagtttcgagggcagggtcacatgaccagggacacgtcatcaatacagcctacatggaactgagcaggct

SEQ ID NO: 296219 - DNA, 433 bp, Homo sapiens
  misc_feature: NA.3.23.C01.1.454.heavy.1.nb
gaaggtctcctgcaaggcgtctggatacgacgtcagcaggaggtatatacactgggtgcgacaggcccctggacaaggccttgagtggatgggaataatcaaccctagtgatggtggcacaagctacgcaaaccagttccagggcagagtcaccatgtcaagggacacggccgcgaacacagtctatttggaactgaagaatttgaaatctgacgacacggccgtgtattattgtgcgaggacaatctgtgccggtgactgctacgtcgatttctggggccaggggaaccctgggtcaccgtctcctcagcctccaccaagggcccatccggtccttccccctggccacccctccctcccaacgacgccacctcgtcgggggcacgacgccggccctgggcctgcctggtcaaggactacttccgagtgcgtc

SEQ ID NO: 296220 - DNA, 362 bp, Homo sapiens
  misc_feature: NA.3.35.D02.2.454.heavy.1.nb
gttttcctggttgttattttacaaggtgtccagtgtgaggtgcagctggtgcagtctgggggaggcttggtccagcctggagggtccctgagactctcctgtgtggtctctggattcaccttcagggaccacttcatggactgggtccgccaggctccgagggaaggggctggagtgggttggccgtataagaaacaagctagaagttacaccacagattacgccgcgtctgtgacaggcagattcaccatctcaagagatgattcaagcaactcagtgtctctgcaaatgaacaccctgaagaccgaggacacggccgtctattactgcgctacagattcatattggagctacgactacgt

SEQ ID NO: 296221 - DNA, 367 bp, Homo sapiens
  misc_feature: NA.3.4.A04.1.454.heavy.1.nb
agcccagcactggaagtcgccggtgtttccattcggtgatcatcactgaacacagaggactcaccatggagtttgggctgagctgggttttcctcgttgctcttttaagaggtgtccagtgccaggtgcagctggtggagtcgtgggggagcgtggcccagccgtgggagtcccaggaactctcctgtacagtctctggattcaccttaggttactatgctatgcactgggtccgccgggctccaggcaaggggctgggagtggggtggcagttatatcccatgatggaggcagtaaatcctacgcagactccgtgaagggccgattcaccatctccagagacaattccaagaacacgctgtatctg

SEQ ID NO: 296222 - DNA, 417 bp, Homo sapiens
  misc_feature: NA.3.59.F04.1.454.heavy.1.nb
agagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgaactgggtccgccagtctccgagggaagggctggagtgggtggccaacttgaagccagatggaagtgagaaatactatgtggactctgtgaggggacgattcaccatttccagagacaacgccaagaactcattgtatctgcaaatggacagcctgagacccgagacacggctgtttattctgtg

SEQ ID NO: 296223 - DNA, 59 bp, Homo sapiens
  misc_feature: NA.3.60.F05.1.454.heavy.1.nb
acgtgtttctgttcccgccctcctcgagtgcgtctctgagcgggctggcaaggcgcata

SEQ ID NO: 296224 - DNA, 157 bp, Homo sapiens
  misc_feature: NA.40.12.B01.2.454.heavy.1.nb
gagcatcacccagcaaccacatctgtcctctagagaatcccctgagagctccgttcctcaccatggactggacctggaggatcctcttcttggtggcagcagccgcaggacgcccactcccaggtgcagctggtgcagtcgtgggctgaggtgaaga

SEQ ID NO: 296225 - DNA, 154 bp, Homo sapiens
  misc_feature: NA.40.12.B01.3.454.heavy.1.nb
tatgcgccttgccagcccgctcagtctagcgactggaagtagtccttgaccaggcagcccagggccgctgtgctctcggaggtgctcctggagcagggcgccaggggaagaccgatgggcccttggtggaggctgcggagacggtgaccggggt

SEQ ID NO: 296226 - DNA, 303 bp, Homo sapiens
  misc_feature: NA.40.16.B05.1.454.heavy.1.nb
cacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgcgggcagggactggagtggattgggcgcgtctatcacagtgaaaccagctacactcccctcctcgagagtcgagtcacctatttcactagacacgtccaacaaatcagttgtccctgaggctgagctctgt

SEQ ID NO: 296227 - DNA, 357 bp, Homo sapiens
  misc_feature: NA.40.20.B09.1.454.heavy.1.nb
tccatcagcagtgggtagcacttacatacactatgcagactcagtgaagggccgattcaccatctccagagacaacgccgggaactccctgtatctgcaaatgaagagcctgcgagccgaggacacgggtgtttattattgtactaaaggacaagagggactttgggagtactactacggtatggacgtctggggccaagggaccgccgtcaccgtctcctcagcttccaccaagggcccatcggtcttccccctggcgccctgctccaggagcacctctgggggcacagcggccctgggctgcctggtcaaggactacttccagtcgctagactgagcgggctggcaaggcgcata

SEQ ID NO: 296228 - DNA, 400 bp, Homo sapiens
  misc_feature: NA.40.27.C05.1.454.heavy.1.nb
ccggcccccagggaaggggctggagtggattgcgagcatatattatgatgagagcgccctctacaacccccccctctacaacccctccctcaagagtcgggtcaccatatctatagacacgtccaacagtcaattctccctggacttgacctctgtgaccgccgcagacacggctgtatattcctgtgcgacccacgggaggggatggccccaaatctgcctactttgaccactggggccagggaaccttggtcaccgtctcctcagcctccaccaagggcccatcggtcttccccctggcgccctgctccaggagcacctccgagagcacagcggccctgggctgcctggtcaaggactacttccagtcgctagactgagcgggctggcaaggcgcata

SEQ ID NO: 296229 - DNA, 193 bp, Homo sapiens
  misc_feature: NA.40.28.C06.1.454.heavy.1.nb
ttgggagtgccaccgacgatccatcccagccactcaggcccccggacaaaggcttgagtggctgggatggatcgtcgggtggcactcctaacataagatattcacagaagtttcagttcagagtcacctttagcagcgacacatccgcgacgacagtctacatggagttgagtggcctaagatcgtagaagac

SEQ ID NO: 296230 - DNA, 157 bp, Homo sapiens
  misc_feature: NA.40.28.C06.2.454.heavy.1.nb
tatgcgccttgccagcccgctcagtctagcgactggaagtagtccttgaccaggcagcccagggccgctgtgctctcggaggtgctcctggagcagggcgccagggggaagaccgatgggcccttggtggaggctgaggagacggtgacctccagca

SEQ ID NO: 296231 - DNA, 454 bp, Homo sapiens
  misc_feature: NA.40.33.C11.1.454.heavy.1.nb
cctgggattcccagctgtttctgcttgctgatcaggactgcacacagagaactcaccatggagcttgggctgagctgggttttccttgttgctattttaaaaggtgtccagtgtgaggtgcagttggtggagtccgggggaggcttagttcagcctggggggtccctgagactctcctgtgcagcctctggagtcactctctccgcctactgggtactcgtgggtccgccaagctccagggaaggggctggagtgggtcgcacgtatttataaagatggatccacagcgtacgcggactccgtgaagggccgattcaccatctccagagacaacgccaagaacacagtgtctctgacaaagtggacagtctgagagccgaggacacgggtgtctattattgtacaaaagtggggactaatgaatatggtgtggacgtctggggccaagggacca

SEQ ID NO: 296232 - DNA, 168 bp, Homo sapiens
  misc_feature: NA.40.34.D01.2.454.heavy.1.nb
tatgcgccttgccagcccgctcagtctagcgactggaagtagtccttgaccaggcagcccagggccgctgtgcccccagaggtgctcctggagcagggcgccaggggaagaccgatgggcccttggtggaagctgaagagacggtgaccagggttccctggccccagt

SEQ ID NO: 296233 - DNA, 69 bp, Homo sapiens
  misc_feature: NA.40.39.D06.2.454.heavy.1.nb
ccttgaccagggcagcccagggccgctgtgcccagcacctgaactcctggggggaccgtcagtcttcct

SEQ ID NO: 296234 - DNA, 324 bp, Homo sapiens
  misc_feature: NA.40.43.D10.2.454.heavy.1.nb
  modified_base (283)..(283): a, c, t, g, unknown or other
  misc_feature (283)..(283): n is a, c, g, or t
ccctgggattttcaggtgttttcatttggtgatcaggactgaacagagagaactcaccatggagtttgggctgagctggtctttttcttgtggctattttaaaaggtgtccagtgtgaggtgcagttgttggagtcgtgggggagcttgggcacgagccgtggggggtcccgagactctcctgtgcagcctctggattcgcctttcagaactctgccatgcactgggtccgccagcctccgaggggaaggggctgggagtgggtctcgaggtattcgggggtnagtggtactgacacatactacgcagactctgcgaagggccg

SEQ ID NO: 296235 - DNA, 186 bp, Homo sapiens
  misc_feature: NA.40.58.F03.1.454.heavy.1.nb
ggttggccgtgttaagaccaaacctgagggtggggcaatagactacgctgcacccgtgacaggcagattcgccatctcaagagatgattcagcaggcacggtgtatctggaaatgaacagcctgaaagccgaggacacagccgtgtattattgtaccgcagggctcggctactccgatactgacta

SEQ ID NO: 296236 - DNA, 303 bp, Homo sapiens
  misc_feature: NA.40.65.F10.1.454.heavy.1.nb
aaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgcccccgagggaaggggctggagtggattgggagtatttaccacagtgggagcacctactacaacccgtcctcaaaagtcgaggcaccatatccgtagacacgtccaagaaccaattct

SEQ ID NO: 296237 - DNA, 179 bp, Homo sapiens
  misc_feature: NA.40.66.F11.1.454.heavy.1.nb
tatgcgccttgccagccgctcagtctagcgactggaagtagccttgaccaggcagcccagggccgctgtgcccccagaggtgctcctggagcagggcgccagggggaagaccgatgggcccttggtggaagctgaggagacggtgaccagggttccctggccccagactaataactccc

SEQ ID NO: 296238 - DNA, 372 bp, Homo sapiens
  misc_feature: NA.40.67.G01.2.454.heavy.1.nb
gagagtcatggatctcatgtgcaagaaagtgaagcacctgtggttcttcctcctgctggtggcggctcccagatgggtcctgtccctgatgcaggtgcgggagtcgggcccaggattggtgaaaccttcggggaccctgtccctcaattgctttgtctctggaacttctatcaagggtagcagcttccactggggctggatccgccagcccccaggaaaggggctccaatgcgttggacatgtcaattcttatgggcgctcccactacagtgcggccctccagagtcgagccctcatatccatagacacgtccaagaaccagttttccctgacgctgacgtctgtgaccgccgcagacacggctgtctatta

SEQ ID NO: 296239 - DNA, 267 bp, Homo sapiens
  misc_feature: NA.40.71.G05.1.454.heavy.1.nb
  modified_base (230)..(230): a, c, t, g, unknown or other
  misc_feature (230)..(230): n is a, c, g, or t
accacacccctcctagggagaatcccctagaccacagctcctcaccatggactggacctggagcatccttttcttggtggcagcagcaacaggtgcccactcccaggttcaaatgctgcagtctggaggcgaggtgaagaagcctggggcctcagtgagggtctcctgcgagacttctggttacagctttaccgactatggtatgagctgggtgcgacaggcccccgganaagggcttgagtggatgggatggagcagcacttacaa

SEQ ID NO: 296240 - DNA, 106 bp, Homo sapiens
  misc_feature: NA.40.71.G05.2.454.heavy.1.nb
tatgcgccttgccagcccgctcagtctagcgactggaagtagtccttgaccaggcagcccagggccgctgtgcccagcacctgaactcctgggggaccgtcagtct

SEQ ID NO: 296241 - DNA, 420 bp, Homo sapiens
  misc_feature: NA.40.81.H04.2.454.heavy.1.nb
cgatttagtagtgtagattcgcggggagagcatcacccagcaaccacatctgtcctctagagaatcccctgagagctccgttcctcaccatggactggacctggaggatcctcttcttggtggcagcagccgcaggagcccactcccaggtgcagctggtgcagtctggggctgaggtgaagaagcctggggcctcggtgaaggtctcctgcaagatttctggaaacaccctgagcaactactacatacactggatgcggcaggcccctggacaggggtttgagtggatggggtggatcaacctaccagaggtggcacaaagtatcgacagaactttcagggcagggtcaccatgacctgggacgcgtccatcagcacagtctacatggatctgagcggactggacctctgacgacacgg

SEQ ID NO: 296242 - DNA, 123 bp, Homo sapiens
  misc_feature: NA.40.81.H04.3.454.heavy.1.nb
tccagactgtaccagctgaacctgggagtgggcacctgttgttgctgccaccaagaaaaggaatgctccaggtccagtccatggtgaggagctgtgatctaggggattctcccaaggaggggt

SEQ ID NO: 296243 - DNA, 372 bp, Homo sapiens
  misc_feature: NA.41.2.A02.1.454.heavy.1.nb
caaccacatctgtcctctagagagtcccctgagagctccgttcctcaccatggactggacctggaggatcctcttcttggtggcagcagccacaggagcccactctcaggtgcagctgatgcagtctggggctgaggtgaggaagcctggggcctcagtgaagctctcctgcaagacttctggatacaggttcaacgacttctatatacactgggtgcgacaggcccctggacagggacttgagtggatgggatggatcaaccctaagagtggtgacacagcctctgcacagaggttccagggcagggtcaccatgagtggtgacacggccacgagcacggtccacatggaacttaccagtctgaagtctga

SEQ ID NO: 296244 - DNA, 349 bp, Homo sapiens
  misc_feature: NA.41.23.C01.2.454.heavy.1.nb
cataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctgggggccaggggaccgcggtcaccgtctcctcagcctccaccaagggcccatcggtcttccccctggcaccctcctccaagagcacctctgggggcacagcggccctgggctgcctggtcaaggactacttcctatatactgtctgagcgggctggcaaggcgca

SEQ ID NO: 296245 - DNA, 347 bp, Homo sapiens
  misc_feature: NA.41.35.D02.1.454.heavy.1.nb
acagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacggggggcaactggctcgacccctggggccagggaaccctggtcaccgtctccccagcctccaccaagggcccatcggtcttccccctggcgccctgctccaggagcacctccgagagcacagcggccctgggctgcctggtcaaggactacttccatagtatagactgagcgggctggcaaggcgcata

SEQ ID NO: 296246 - DNA, 302 bp, Homo sapiens
  misc_feature: NA.41.36.D03.1.454.heavy.1.nb
cgagcccagcactggaagtcgccggtgtttccattcggtgatcatcactgaacacagaggactcaccatggactttgggctgagatgggttttcctcgttgctcttttaagaggtggccagtgtcaggtgcagctagtggagtctgggggagagcggcccagcctgggaactccctgagactctcctgtgcagcctctggattcatcttcaggacctatgccatgcacgtggggtcccgccaggcctccgaggccaaggggctgggaggtgggtggcaattatatcagaagatggaattgaa

SEQ ID NO: 296247 - DNA, 256 bp, Homo sapiens
  misc_feature: NA.41.36.D03.2.454.heavy.1.nb
  modified_base (219)..(219): a, c, t, g, unknown or other
  misc_feature (219)..(219): n is a, c, g, or t
aacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggctttctggaggcaccttcttcagctatgcttttatttgggncgacaggcccctggacaaggcttgagtggctgggagg

SEQ ID NO: 296248 - DNA, 539 bp, Homo sapiens
  misc_feature: NA.41.38.D05.1.454.heavy.1.nb
aagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcata

SEQ ID NO: 296249 - DNA, 332 bp, Homo sapiens
  misc_feature: NA.41.57.F02.1.454.heavy.1.nb
aagactgacggtccctgagactctcctgtgcagcctctggattcacgtttagcttggaatggatggcctgggtccgccagcctctagggaagggtctggagtgggtggccaacataaatccagatggaagtcgcaggttttatggggactctgtgaagggccgattcaccatctccagagacaacgccaggaactcactgtctctacaaatgaatagcctgagagccgacgacacggctatttattactgtgcgacaacttcagatgcagctgctaacgagttggggccagggaaccctggtccaccgtctcctcaacctccaccaggccca

SEQ ID NO: 296250 - DNA, 394 bp, Homo sapiens
  misc_feature: NA.41.64.F09.1.454.heavy.1.nb
cacatcccttctctacagaagcctctgagaggaaagttcttcaccatggactggacctggagggtcttctgcttgctggctgtagctccaggtgctcactcccaggtgcagttggtgcagtctggggctgaggtgaagaagcctggggcctcagtgaaaatttcctgccaggcatctggatacaccttcatgacctactatatccactgggtgcgacaggcccctggacgaggacttgagtggatgggacaactcaaccctggtggtggcaggacaacctacgcacggaagttccaggacagagtcaccatgaccagggacacgtccgcgagtacagtctattggaattgaggagagtgagatcgtgacgacacggccatttattattgtgcga

SEQ ID NO: 296251 - DNA, 81 bp, Homo sapiens
  misc_feature: NA.41.73.G07.2.454.heavy.1.nb
cagtttcaccttctcacaatgaggctccctgctcagctccgtggggctgctaatgctctgggtctcgagggtccagtggag

SEQ ID NO: 296252 - DNA, 417 bp, Homo sapiens
  misc_feature: NA.41.78.H01.1.454.heavy.1.nb
gagcccagcactgggactccgaggtgtttccattcggtgatcagcactgaacacagaggactcaccatggagttttggctgagctgcgttttccttgttgctattttaaaaggtgtccactgtgagatgtacctggtggagtctggaggcggcttgatccagccgggggggtccctgagactctcatgtgcagcctctggtttaagtgtcagtagacactacatgagctggttccgccagattccagggaaggcgctggaatgggtctcagttatttataccgctgggaacaccttctactcagactccgtgaggggccgattcatcatctccagagacgtcgccaataatatgttgtatcttgacatgaacaacttgagagccgacgacacggccctgtattattgtgcgagggca

SEQ ID NO: 296253 - DNA, 115 bp, Homo sapiens
  misc_feature: NA.41.80.H03.2.454.heavy.1.nb
tatgcgccttgccagcccgctcagtctatactatgaggagggtgggaacagagtgaccagggggcagccttgggctgacctaggacggtcagcttggtccctccgccaaacaccc

SEQ ID NO: 296254 - DNA, 400 bp, Homo sapiens
  misc_feature: NA.42.2.A02.1.454.heavy.1.nb
gaccaccttcctcctctaaagaagcccctgggagcacagctcatcaccatggactggacctggaggttcctctttgtggtggcagcagctacaggtgtccagtcccaggtgcagctggtgcagtcaggggctgaggtgaagaagcctgggtcctcggtgaaggtctcctgcaaggcttctggaggcaccttcagtagcaatgctgtcacctgggtgcgacaggcccctggacaaggactcgagtggatgggaaatagtctccctagtctcggattaacaaactacgcacagaagtttcagggcagagtcaccattaccgcgacacatccactaacacagtctacattgagttgagtggcctgacatctgaggactcggccgtatattattgtgcgagaga

SEQ ID NO: 296255 - DNA, 357 bp, Homo sapiens
  misc_feature: NA.42.37.D04.1.454.heavy.1.nb
ttctggattttcgttcacgacctactacatgcactgggtgcgacaggcccctggacagggacttgagtggatgggaattatcatccctagttctggccgcaccaactacgcacagaagtttcagggcagagtcaccatggaccggggacacgtccacgaccacggtctacatggacttgagcagcctgagatatgacgacacggccatatattactgtgtgagagaatttggttgggggcttctttgactatagaggccagggtaccctggtcaccgtctcctcagcctccaccaagggcccatccggtcttccccctggccgccctgcctccaggcgcacctccgagagcacgagc

SEQ ID NO: 296256 - DNA, 179 bp, Homo sapiens
  misc_feature: NA.42.38.D05.2.454.heavy.1.nb
tatgcgccttgccagcccgctcagtgacgtatgtggaagtagtccttgaccaggcagcccagggccgctgtgcccccagaggtgctcctggagcagggcgccagggggaagaccgatgggcccttggtggaagctgaggagacggtgaccaggtttccctgtccccaggagtccacgac

SEQ ID NO: 296257 - DNA, 350 bp, Homo sapiens
  misc_feature: NA.42.41.D08.2.454.heavy.1.nb
ggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtgtaaaagtctgggcggtacaggttcgtttgactacgtggggtcagggaccctggtcaccgtctcctcagcctccaccaagggcccatcggtcttccccctggcgccctgctccaggagcacctccgagagcacagcggccctgggctgcctggtcaaggactacttccacatacgtcactgagcgggctggcaaggcgcata

SEQ ID NO: 296258 - DNA, 375 bp, Homo sapiens
  misc_feature: NA.42.42.D09.1.454.heavy.1.nb
tccaacaaccacatcccttctctacagaagcctctgagaggaaagttcttcaccatggactggacctggtgggtcttctgcttcctggctgtagctccaggtgctcactcccaggtgcaactggtgcagtctggggctgaagtgaagaagcctggggcctcagtgaaggtttcctgcaaggcatctggatacaccttcaccaggcaccatatgcactgggtgcgacacggcccccggacaaggacttgagtggatgggactaatcaaccctaatagtggtaggacagactacgcacagaagttccagggcagagtcgccatgacccgggacacgtccacgagcacagtctacatggagttgagcaggctgagata

SEQ ID NO: 296259 - DNA, 408 bp, Homo sapiens
  misc_feature: NA.42.49.E05.1.454.heavy.1.nb
caaaaaccacacccctccttgggagaatcccctagatcacagctcctcaccatggacgggacctggagcatccttttcttggtggcagcagcaacaggtgcccactcccaggttcacctggtgcagtctggagctgagctgcagaagcctggggcctcagtgatggtctcctgcagtgcttctggttacatcttttccacctacggtatgaattggttgagacaggcccccggagaggggcttgagtggatgggatggatcagcccttacggaactaaaacagagtatggagagaagttccagggcagagtcatcatcaccgcggacacatccacgagtacagcctacatggaactgaggagcctcagatctgacgacacggccacttatactgcgcgagagattagt

SEQ ID NO: 296260 - DNA, 371 bp, Homo sapiens
  misc_feature: NA.42.59.F04.1.454.heavy.1.nb
gatccgtcagccccccggaaaggccctggagtggcttgcactcatttattgggatgatgataagcgctacactccatctctgaagagcaggctcaccatcaccaaggacacctccaaagaccaggtggtccttacaatgaccaacatggactctgtggacacagccacatatttctgtgcacacaattcggctaaacttacggggagtgcttttgttgtctggggccaagggacaatcatcaccgtctcttccgcctccaccaagggcccatcggtcttccccctggcgccctgctccaggagcacctccgagagcacagcggccctgggctgcctggtcaaggactacttccacatacgtcactgagcgg

SEQ ID NO: 296261 - DNA, 222 bp, Homo sapiens
  misc_feature: NA.42.66.F11.1.454.heavy.1.nb
gggtctcagctgttattggtgatgggagtaacacaagatacggggactccgtgaagggccgattcagcatctccagagacaacgccaagaacacgttgtatctggaaatgaacaatctgggagccgaggacacggctgtctatttctgtagtaaaaagatctggggcggtacaggtttcgtttgactacgtggggtcagggaaccctggtcaccgtctcctc

SEQ ID NO: 296262 - DNA, 334 bp, Homo sapiens
  misc_feature: NA.42.70.G04.1.454.heavy.1.nb
agcccagcactgggattccgaggtgtttccattcggtgatcagcactgaacacagaggactcaccatggagttttggctgagctgggttttccttgttgctattttaaaaggtgtccagtgtgaggtgcagctggtggagtctggaggaggcttgaagcagcctggggggtccctgagactctcctgtgcagcctctgggttcaccgtcagtagcaactacatgagctgggtccgccaggctccgaggggaaggggccggagtgggtctcagttatttatgggcggtagaaactacatactacgcagactccgtgaagggccgattcaccatct

SEQ ID NO: 296263 - DNA, 403 bp, Homo sapiens
  misc_feature: NA.42.74.G08.1.454.heavy.1.nb
tccctcctcagaagcccccagagcacaactcctaaccatggactggacctggaggatcctctttttggtggcagcagccacaggtggccactcccaggtccactttgtgcagtcgtggggctgaggtgcagaagcccggggcctcagtgacgatttcctgcaaggcttctggatacagtcttcagtagttatgctatacagtgggtgcgccaggcccccggacaaaggcttgagtggctgggatggatcgtcggtggcactcctaacataagatattcacagaagtttcagttcagagtcacctttagcagcgacacatccgcgacgacagtctacatggagttgagtggcctaagatctgaagacacggctgtctattactgtgcgagagatgccttacacg

SEQ ID NO: 296264 - DNA, 187 bp, Homo sapiens
  misc_feature: NA.42.78.H01.1.454.heavy.1.nb
tatgcgccttgccagcccgctcagtgacgtatgtggaagtagtccttgaccaggcagcccagggccgctgtgccccagaggtgctcctggagcagggcgccagggggaagaccgatgggcccttggtggaagctgaggagacggtgaccagggttccctggccccaggagtcaaactcgtccggtag

SEQ ID NO: 296265 - DNA, 336 bp, Homo sapiens
  misc_feature: NA.42.86.H09.2.454.heavy.1.nb
actgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagctcggggagtctctgaagatctcctgtaagggttctggatacagctttgccacctactggatcggctgggtgcgccagatgcccgggaaaggcctggagtggatgggaatcatctatcctctgactctgataccagatacacgcccgtccttccaaggccaggtcatcatctcagtcgaccagtccatcagga

SEQ ID NO: 296266 - DNA, 402 bp, Homo sapiens
  misc_feature: NA.43.15.B04.1.454.heavy.1.nb
gcccagcactgggattccgaggtgtttccattcggtgatcagcactgaacacagaggactcaccatggagttttggctgagctgggttttccttgttcctattttaaaaggtgtccagtgtgaggtgcagctggtggagtctggaggaaccttgatccagccgggggggtccctcagactctcctgtgtagtgtctggactcaccgtcggtgacaacttcctgagctgggtccgccaggctccgagggaaggggctgggagtgggtctcagttatctatgccgatggcagcacacactacgcagactctgtgaagggccgattcaccctctccagacgacctcctaccaagaacacgctgtcccttcaattcgaacacgcctcagagtcgacgacacgggca

SEQ ID NO: 296267 - DNA, 287 bp, Homo sapiens
  misc_feature: NA.43.22.B11.1.454.heavy.1.nb
gccttagccctggactccaaggcctttccacttggtgatcagcactgagcacagaggactcaccatggaattggggctgagctgggttttccttgttgcttattttagaaggtgtccagtgtgaggtgcagctggtggagtcgtgggggagccgtgggtccagccgtggggggtccctgagactctcctgtgcagcctctggactcacctttagtagttattggatgacctgggtccgccaggctccgagggaaggggctggagtgggtggccaacataaaccaaga

SEQ ID NO: 296268 - DNA, 172 bp, Homo sapiens
  misc_feature: NA.43.24.C02.1.454.heavy.1.nb
tatgcgccttgccagcccgctcagtgtgagtagtggaagtagtccttgaccaggcagcccagggccgctgtgctctcggaggtgctcctggagcagggcgccaggggaagaccgatgggcccttggtggaggctgaggagacggtgaccgtggtcccttggccccagacgtc

SEQ ID NO: 296269 - DNA, 175 bp, Homo sapiens
  misc_feature: NA.43.28.C06.1.454.heavy.1.nb
  modified_base (151)..(151): a, c, t, g, unknown or other
  misc_feature (151)..(151): n is a, c, g, or t
gttttcctcgttgctcttttaagaggtgtccagtgtcaggtgcacatggtagagtctgggggaggcgtggtccagccgtggggcgtccctgagactctcctgtggagtctctgggttcaccctcaataaacatggaatgcacgtgggtccnccgaggctccgaggcgaaggggct

SEQ ID NO: 296270 - DNA, 433 bp, Homo sapiens
  misc_feature: NA.43.29.C07.1.454.heavy.1.nb
gctttctgagagtcatggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctgtctatggtgggtccttcagtggttactactggagctggatccgccagtcccagggaagggctgggagtggattgggggaagtcaatcacaggggaagtaccaactacaacccgtccctcaagagtcgagtcaacatagcagtagacacgtccaagaaccagttctccctgaagttgagttctgtgaccgtcgcggacacggctgtgtattattgtgcgagcagtggctggtaccgtggctacgtggggccagggaaccctggtcaccgtct

SEQ ID NO: 296271 - DNA, 397 bp, Homo sapiens
  misc_feature: NA.43.35.D02.1.454.heavy.1.nb
tgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagttcagcctgggggtccctgagactctcctgtgagcctctggattcaccttcagtacctactggatgcactgggtccgccaagttcctgggaaaggctggtgtgggtctcgcgtgtgaatgttgacggcactaatatggactatgcggagtctgtgaagggccgattcaccatctccagagacaacgccaagaacacactgtacttg

SEQ ID NO: 296272 - DNA, 359 bp, Homo sapiens
  misc_feature: NA.43.37.D04.1.454.heavy.1.nb
tgacgatggtcaaacaaagtattcacagcagttccagggcatactctcccttaccagggacacttccgcgaacacaggctacatgtatttgagcagactgacatctgaagacacggctatgtactactgtgcgagaggcggattttgtcggcgtggtgactgctacagtcaaaatcgtcgattgtggttcgacccctggggccagggaaccctgctctccgtctcctcagcttccaccaagggcccatcggtctcccctggcgccctgctccaggagcacctctggggcacagcggccctgggctgcctggtcaaggactacttccactactcacactgagcgggctggcaaggcgcat

SEQ ID NO: 296273 - DNA, 377 bp, Homo sapiens
  misc_feature: NA.43.44.D11.1.454.heavy.1.nb
agctcagcaccatggactggacctggaggttcctctttgtggtggcaacagctacaggtgtccaatcccaggtgcaactgctgcagtctgggactgaggtgaaaaagcctgggtcctcagtgacggtgtcctgcaagtctaccggaggcatcttcagcagccaaactataagttgggtgcgacaggcccctggagaaggacttgaatggatgggggggatcatcccgaggcttggaacaacaaactacgcacagaagtttcagggcagaatttcgattactgcggacgactccacgaccacggcctatttggaggtgagaggcctaacatctgacgacacggccgtctattactgtgcgagagaggcggtggactct

SEQ ID NO: 296274 - DNA, 272 bp, Homo sapiens
  misc_feature: NA.43.46.E02.1.454.heavy.1.nb
gctcgatttagactcatctacagggaaaggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtggctccatcagcagcagtacttacttctggggctggatccgccagcccccagggaacggggctggagtgga

SEQ ID NO: 296275 - DNA, 378 bp, Homo sapiens
  misc_feature: NA.43.5.A05.1.454.heavy.1.nb
caaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcaccatgaccagggacacgtccatcaacacaggctacatggacctgagcagcctcagacctgaccgac

SEQ ID NO: 296276 - DNA, 441 bp, Homo sapiens
  misc_feature: NA.43.57.F02.1.454.heavy.1.nb
cgtggcttttcttgtggctattttaaaaggtgtccagtctgaggagcagctgttggagtctgggggaggcttgatacaggccgggggggtccctgagactctcctgtgtagcctctggattcacctttaacaactatgccatgacctgggtccgccaggctccagggaaggggctggagtgggtctcagtaataagtggaagtgctggtaccacactttatgcagactccgtgatgggccgttcaccatctccagagacaattccaagaacacgctgtgtctgcaaatgaacagcctgagagccgaagacacggccgtatattactgtgcgagaggcgtcggagagtacgatatttgacttggttatttgcgtctactactactacgctttggacgtctggggccaagggaccacggtcaccgtctcctcacgcctccacc

SEQ ID NO: 296277 - DNA, 245 bp, Homo sapiens
  misc_feature: NA.43.60.F05.2.454.heavy.1.nb
gggtggccaatataaggaaagatggagaaaagatacactacatggactctgtggagggccgattcaccatctccagagacaacgccaagagttcgctgtttctccaaatgagtagtctgagagtcgaggacacggctgtgtattattgtgcgagagactcgagcccctcccaaagtgggatctactatgatgcatttgatatttggggccaggggacagtggtcacagtctcttcagcctccacc

SEQ ID NO: 296278 - DNA, 379 bp, Homo sapiens
  misc_feature: NA.43.64.F09.1.454.heavy.1.nb
tcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaatggttactactggagctggatccgccagtccccagggaagggactggaatggattgcggaagtcactcgaaatggaagtcccaactaccaacccgtcctcgtcggtcgagtcacgatagccttagactcgtaccaagacgccgcttctctctgaaactcacctctgtgaccgccgcggacacggtctttctatttctgtgcgcgagaccc

SEQ ID NO: 296279 - DNA, 281 bp, Homo sapiens
  misc_feature: NA.43.66.F11.1.454.heavy.1.nb
gaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttcgtggggctggactccgccacgccccgagggaaggggctggagtggagttgggagtatttaccacagtgggagcacctactacaacccgtccctcaaaagtcgaggcaccatatccg

SEQ ID NO: 296280 - DNA, 588 bp, Homo sapiens
  misc_feature: NA.43.67.G01.1.454.heavy.1.nb
gagccccagccttgggattcccaagtgttttcattcagtgatcaggactgaacacagaggactcaccatggagtttgggctgagctggattttccttgctgctattttaaaaggtgtccagtgtgaggtgcagttggtggagtccgggggggcctggtaccgcctgggggtcccttagactctcctgtgtaacctctggattcaccctcagtaacgtctggatgagctggttccgccaggctccagggaagggctggagtgggttggccgtattaaaccaaagtgagggtgggacagtagactacgttgcacccgtgagaggcagattcgccatctcaagagatgattcagaaggcacgttgtatctgcaaatgaacagcctgacaatcgaggacacagccgtgtattactgttccgcagggctcggtcactccgataatgactattggggccagggaaccctggtcaccgtctcctcagcctccaccaagggcccatcggtcttccccctggcgccctgctccaggacgcacctccgagagcacagcggccctgggctgcctggtcaaggctacttccactactcac

SEQ ID NO: 296281 - DNA, 299 bp, Homo sapiens
  misc_feature: NA.43.71.G05.2.454.heavy.1.nb
tgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtcctacaaaagtcgaggcaccatat

SEQ ID NO: 296282 - DNA, 542 bp, Homo sapiens
  misc_feature: NA.43.79.H02.1.454.heavy.1.nb
gccttagccctggattccaaggcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtgaagggccgattcaccatctccagagacaacgccaagaactcactgtatctgcaaatgaacaccctgagagccgaggacacggctgtgtattattgtgcgagagttgaaccacgatttttggggcggcccaacgaagactattactactacggcatggacgtctggggccaaggcaccacggtcaccgtctcctcagcctccaccaagggcccatcggtcttccccctgcaccctcctccaagagcacctctgggggcacagcggccctgggctgcctggtcaaggactacttccactactcacactgagcgggctggcaaggcgcata

SEQ ID NO: 296283 - DNA, 194 bp, Homo sapiens
  misc_feature: NA.43.85.H08.1.454.heavy.1.nb
aatattatctggactctgtgaagggccgattcaccatctccagagacaacaccaaggactcactgtatctgcagatgaacagcctgagagccgaggacacggctgtgtattactgtgtgagagacagtagtggctattacgtggggccagggaacccaggtcatcgtctcctcacgcctccaccaacgggccca

SEQ ID NO: 296284 - DNA, 304 bp, Homo sapiens
  misc_feature: NA.43.86.H09.2.454.heavy.1.nb
acgagcccagcactggaagtcgccggtgtttccattcggtgatcagcactgaacacagaggactcaccatggagtttgggctgagctgggttttcctcgttgctcttttaagaggtgtccagtgtcaggtgcagctggtggagtcgtgggggagacgtggtccagcctgggaagtccctgacactctcctgtgcagcctctggattcaccttcaataattatggcatgcacgtgggtccgccaggcctccgtggcaaggggctgggagtggggtgcacttatatcatctgataggaagtagaaa

SEQ ID NO: 296285 - DNA, 318 bp, Homo sapiens
  misc_feature: NA.44.1.A01.4.454.heavy.1.nb
catggacctcctgtgcaagaacatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagtagtagttactactggggctggatccgccacgcccccaggggaaggggctgggagtggattgggagtatctattatagtgggagcacctactacaacccgtcctcaagagtcgagtcaccatatcagtagacacgtaccaagaaccag

SEQ ID NO: 296286 - DNA, 301 bp, Homo sapiens
  misc_feature: NA.44.1.A01.5.454.heavy.1.nb
ccctcctcagaagcccccagagcacaactcctcaccatggactggacctggaggatcctctttttggtggcagcagccacaggtgcccactcccaggtccagcttgtgcagtctggggctgaggtgaagaagcctggggcctcagtgaaggtttcctgcaaggcttctggatacaccttcaatatttatgctatgcagtgggtgcgccaggcccccggacaaaggcttgagtggatgggatggatcgaacgctggcaatggtgacacaagatattacacagaagttccagggcagagtcac

SEQ ID NO: 296287 - DNA, 276 bp, Homo sapiens
  misc_feature: NA.44.12.B01.1.454.heavy.1.nb
cgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatggacgggaaaaaacagctggtttctgtattataagtcttaccatctggacgtcgtggggcaaagggaccacggtcaccgtctcctcagctt

SEQ ID NO: 296288 - DNA, 128 bp, Homo sapiens
  misc_feature: NA.44.12.B01.2.454.heavy.1.nb
tatgcgccttgccagcccgctcagacagtatataggaagtagtccttgaccaggcagcccagggccgctgtgccccagaggtgctcttggaggaggggccagggggaagaccgatgggcccttggtgg

SEQ ID NO: 296289 - DNA, 179 bp, Homo sapiens
  misc_feature: NA.44.12.B01.3.454.heavy.1.nb
catctccagagacaattcgaagaacacactatatctggaaatgaatagcctgagagccgaggacacggctgtctactactgtgcgagagatggggctcgtggatacagatatgacatgctctactccaatggtatggacgcctggggccaagggaccacggtcgccgtctcctcagcct

SEQ ID NO: 296290 - DNA, 40 bp, Homo sapiens
  misc_feature: NA.44.19.B08.1.454.heavy.1.nb
agcgctctcgggacgtctccaccatggcctgggctctgct

SEQ ID NO: 296291 - DNA, 331 bp, Homo sapiens
  misc_feature: NA.44.19.B08.4.454.heavy.1.nb
agccttgggattcccaggtgttttcattcagtgatcaggactgaacacagaggactcaccatggagtttgggctgagctggattttccttgctgctattttaaaaggtgtccagtgtgaggtgcagttggtggagtctgggggaggtttggtaaagcctggggagtcccttagactctcctgtgcagcctctggattcactttcagtaacgcctggatgacctgggtccgccaggctccgagggagggctggagtgggttggccgtatagaaccaaagctgacggtgggacagcagactacgctgcaccgtgaaaggcagattcaccatct

SEQ ID NO: 296292 - DNA, 286 bp, Homo sapiens
  misc_feature: NA.44.20.B09.1.454.heavy.1.nb
ccctgggattttcaggtgtcttcatttggtgaccaggaccgaacagagagaagtctccatggagtttgggctgagctgcctttttcttgtggtcttttttaaagggtgtcgtgtgtgaagtgcagttgttggagtcgtgggggggcctgattcggcctgggaggtccctgaccctctcctgtgcggcctctggattcacctttagtgcctatggcatgacctgggtccgccggctccgagggagggactggaggtggtctcgaagtagtcggagctgggtggtcgt

SEQ ID NO: 296293 - DNA, 132 bp, Homo sapiens
  misc_feature: NA.44.20.B09.2.454.heavy.1.nb
actgtccaggagacccagacacggaggctggctgagtcagggcggactgggcccaggtccctgtgtcctgagtcaggagagtgaggagcagcagagcccaggccatggtggagacgtcccgagagcgctgac

SEQ ID NO: 296294 - DNA, 177 bp, Homo sapiens
  misc_feature: NA.44.23.C01.4.454.heavy.1.nb
aacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaactggctc

SEQ ID NO: 296295 - DNA, 164 bp, Homo sapiens
  misc_feature: NA.44.23.C01.6.454.heavy.1.nb
tatagtgggagcacctactacaacccgtccctcaagagtcgagtcaccatatcagtagacacgtccaagaaccagttctccctgaagctgagctctgtgaccgccgcggacacggccgtgtattactgtgcgagagtaggggctagttcgacaccaactacttt

SEQ ID NO: 296296 - DNA, 349 bp, Homo sapiens
  misc_feature: NA.44.23.C01.7.454.heavy.1.nb
cataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctggggcacagcggccctgggctgcctggtcaaggactacttcctatatactgtctgagcgggctggcaaggcgcata

SEQ ID NO: 296297 - DNA, 332 bp, Homo sapiens
  misc_feature: NA.44.23.C01.8.454.heavy.1.nb
tgagagtcaaggacctcctgtgcaagaacatgaagcacctgtggtttttcctcctgctggtggcagctcccagatgggtcctgtcccaggtgcagctgcaggagtcgggcccaggactggtgaggccttcgggaaccctgtctctcatctgcactgtctctggagtttccatcagttctgatcattcttggggctggatccggcagcccccagggaggggaatggagtggattggtgacatccattatactggggcgacgtactactctccgtccctcaagagtcgtctcaccatttcgagggacacgtccatgaaccgcttctccctgaaa

SEQ ID NO: 296298 - DNA, 295 bp, Homo sapiens
  misc_feature: NA.44.25.C03.10.454.heavy.1.nb
gttcggccgggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggattatcgtttggg

SEQ ID NO: 296299 - DNA, 454 bp, Homo sapiens
  misc_feature: NA.44.25.C03.2.454.heavy.1.nb
gtcacaagatttggactcctgtgccccaccatggacactctttgctacacactcctgctgctgaccacccttcctgggtcttgtcccaggtcaccttgaaggagtctggtcctgtgctggtgaaacccacagagaccctcacgctgacctgcaccatctctgggttctctctcaacgatattagaatgggtgtgagctggatccgtcagcccccagggaaggccctggagtggcttgcacacatcttctcgaatgacgaaaaatcctacagtacatctctgaagagcagtttaaccatctccaaggacacctccaaaaggcaggtggtctttagtatgaccaacatggaccctgcggacacaggcacatattactgtgcacgggtaatggacgggaaagaacagctggtttctgtattataagtcttaccatctggacgtctggggcaaaggga

SEQ ID NO: 296300 - DNA, 88 bp, Homo sapiens
  misc_feature: NA.44.25.C03.3.454.heavy.1.nb
agaggtgctcctggagcagggcgccaggggaagaccgatgggcccttggtggaagctgaggagacggtgaccgtgccctccagcagct

SEQ ID NO: 296301 - DNA, 10 bp, Homo sapiens
  misc_feature: NA.44.25.C03.7.454.heavy.1.nb
acgtctactg

SEQ ID NO: 296302 - DNA, 285 bp, Homo sapiens
  misc_feature: NA.44.27.C05.6.454.heavy.1.nb
agaggagcccagccctgggattttcaggtgttttcatttggtgatcaggactgaacagagagaactcaccatggagtttgggctgaggtggctttttcttgtgactattttaaaaggtgtccagtgtgaggtggccctgttggagtctgggggaggattggcacagcctggggggtccctgagactctcctgtgcagcctctggccttcccctttaggagctatgccatgacctgggtccgccgaggcctccgaggggaggggctcggagtgggtctcgacaatt

SEQ ID NO: 296303 - DNA, 168 bp, Homo sapiens
  misc_feature: NA.44.28.C06.2.454.heavy.1.nb
agctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggac

SEQ ID NO: 296304 - DNA, 449 bp, Homo sapiens
  misc_feature: NA.44.31.C09.1.454.heavy.1.nb
gactctcctgtgcagcctctggcttcccctttaggagctatgccatgacctgggtccgccaggctccagggaggggctcgagtgtgggtctcgacaattggcgctagtgcaactgacacatactacggagagtccgtgaagggccgcttcaccatctccagagacaattccggaaacactactttttctggaaatgaacagcctgagagtcgaagacacggccctttatttctgtgcgaaggagggggggactggatccacagtgggtgggtggttcaactcctggggccagggagccctggtcaccgtcgccgcagcctccaccaagggcccatcggtcttccccctggcaccctcctccaagagcacctctgggggcacagcggccctgggctgcctggtcaaggctacttccacgtctactgctgagcgggctggcaaggcgcata

SEQ ID NO: 296305 - DNA, 120 bp, Homo sapiens
  misc_feature: NA.44.34.D01.2.454.heavy.1.nb
ggaagtagtccttgaccaggcagcccagggccgctgtgctctcggaggtgctcctggagcagggcgccagggggaagaccgatgggcccttggtggaggctgaggagacggtgaccgtgg

SEQ ID NO: 296306 - DNA, 351 bp, Homo sapiens
  misc_feature: NA.44.35.D02.1.454.heavy.1.nb
cataatggaagcaccagctataacccgtccctcaagagtcgactcaccatctccgtcgacacgtccaagagacagatgtccctgagtctgacgtctgtgaccgccgcggacgcggctgtgtatttctgtgcgagaggccctggtaccagcgagtggtacctctactactactctctggacgtctggggccaggggaccgcggtcaccgtctcctcagcctccaccaagggcccatcggtcttccccctggcaccctcctccaagagcacctctggggcacagcggccctgggctgcctggtcaaggactacttcctcgatctactgtctgagcgggctggcaaggcgcata

SEQ ID NO: 296307 - DNA, 347 bp, Homo sapiens
  misc_feature: NA.44.35.D02.2.454.heavy.1.nb
acagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcaccctcctccaagagcacctctgggggcacagcggccctgggctgcctggtcaaggctacttcctatctactgtctgagcgggctggcaaggcgcata

SEQ ID NO: 296308 - DNA, 293 bp, Homo sapiens
  misc_feature: NA.44.36.D03.4.454.heavy.1.nb
aacaaccacactcctcctctaaagaagcccctgggagcacagctcatcaccatggactggacctggcggttcctctttgtggtggcagcagctacaggtgtccagtcccaggtgcagctggtgcagtctggggctgaggtgaagaagcctgggtcctcggtgaaggtctcctgcaaggcttctggaggcaccttcttcagctatgtcttttagttgggtgcgacaggcccctggacaagggcttgagtggctgggagggatcatccctatctttggtgcatcgaattacgcac

SEQ ID NO: 296309 - DNA, 290 bp, Homo sapiens
  misc_feature: NA.44.36.D03.5.454.heavy.1.nb
gtgccccaccatggacactctttgctacacactcctgctgctgaccaccccttcctgggtcttgtcccaggtcaccttgaaggagtctggtcctgtgctggtgaaacccacagagaccctcacgctgacctgcaccatctctggttctctctcaacgatattagaatgggtgtgagctggatccgtcagcccccagggaaggccctggagtggcttgcacacatcttctcgaatgacgaaaatcctacagtacatctctgaagagcagttaaccatctccaaggacacct

SEQ ID NO: 296310 - DNA, 338 bp, Homo sapiens
  misc_feature: NA.44.37.D04.4.454.heavy.1.nb
gtccagcccgggaggtccctgagactctcctgtgtagcctctgggttctcattcgatagatttggtttgcactgggtccgccaggctccaggcaaggggccggagtgggtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgaggggacctcaaggaacggttcgggaatcataaactactactatttgatggatgtctggggcagggggacgtcggtcacc

SEQ ID NO: 296311 - DNA, 125 bp, Homo sapiens
  misc_feature: NA.44.37.D04.6.454.heavy.1.nb
tatgcgccttgccagcccgctcagacagtatatagaggagggcgggaacagagtgaccgagggggcagccttgggctgacctaggacggtcagcttggtccctccgccgaacacccgatgatcac

SEQ ID NO: 296312 - DNA, 539 bp, Homo sapiens
  misc_feature: NA.44.38.D05.1.454.heavy.1.nb
gaagactgacggtcctcccaggagttcaggtgctgggcaccttgggcacgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcata

SEQ ID NO: 296313 - DNA, 161 bp, Homo sapiens
  misc_feature: NA.44.38.D05.5.454.heavy.1.nb
  modified_base (85)..(85): a, c, t, g, unknown or other
  misc_feature (85)..(85): n is a, c, g, or t
gaccactatatggactgggtccgccaggctccagggaaggggctggagtggcttggccgcagtaaaaacaagttgccagctttancacagagtacgccgcgtctgtgaaagccagtacttccaccccttctcaagagatgacttcaagaactcattgattc

SEQ ID NO: 296314 - DNA, 131 bp, Homo sapiens
  misc_feature: NA.44.38.D05.6.454.heavy.1.nb
aacgcctggatgacctgggtccgccaggctccgagggaaggggctggagtgggttggccgtattagaaccaaagctggacggtgggacagcagactacgctgcacccgtgaaaggcagattcaccatccta

SEQ ID NO: 296315 - DNA, 100 bp, Homo sapiens
  misc_feature: NA.44.4.A04.1.454.heavy.1.nb
tatgcgccttgccagcccgctcagacagtatatagaggagggtgggaacagagtgaccgagggggcagccttgggctgacctaggacggtcagcttggtc

SEQ ID NO: 296316 - DNA, 363 bp, Homo sapiens
  misc_feature: NA.44.42.D09.1.454.heavy.1.nb
attgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcctccaccaagggcccatcggtcttccccctggcaccctcctccaagagcacctctgggggcacagcggccctgggctgcctggtcaaggctacttccacgtctactgctgagcgggctggcaaggcgcata

SEQ ID NO: 296317 - DNA, 373 bp, Homo sapiens
  misc_feature: NA.44.43.D10.1.454.heavy.1.nb
ctggggcctcagtgaaggtctcctgcaaggcttctggatacaccttcaccaattatgatatcaactgggtgcgacaggccactggacaagggcttgagtggatgggatggatgaaccctaacagtggtaacacaggctatgcacagaagttccagggcagagtcaccatgaccaggaacacctccataaacacagcctacatggagctgagcagcctgagatctgaggacacggccgtgtattactgtgcgagatcccgaaagtatagcagctcgtcggggaggtggttcgacccctggggcccagggaaccctggtcaccgtctcctcagcttccaccaagggcccatccggtcttccccctggccgccctg

SEQ ID NO: 296318 - DNA, 330 bp, Homo sapiens
  misc_feature: NA.44.45.E01.1.454.heavy.1.nb
gtggcagtcatctggtctgatggaagtaaagaatactatggaaactccgtgaagggccgattctccgtctccagagacaattccaagaacaccgtgtatctacaaatgaacaatttgagagccgaggactcggctctctattattgtacgagcccatcgttctactggggccagggagccctggtcaccgtctcctcagcctccaccaagggcccatcggtcttccccctggcgccctgctccaggagcacctccgagagcacagcggccctgggctgcctggtcaaggctacttccatatactgtctgagcgggctggcaaggcgcata

SEQ ID NO: 296319 - DNA, 229 bp, Homo sapiens
  misc_feature: NA.44.46.E02.1.454.heavy.1.nb
gtggcagtcatctccgacgatggaagtgagaagtattactcagactccgtgaagggccgattcaccatctccagagacaattccaagaatatgctgtatttgcaaatgaacagcgtgagagttgacgacacgtctgtttattactgtgcgagggggacctccgaaggaaacggttcggggaatcataaactactactatttgatggatgtcgtggggcagggggacgtc

SEQ ID NO: 296320 - DNA, 79 bp, Homo sapiens
  misc_feature: NA.44.46.E02.2.454.heavy.1.nb
ggtcaccgtctcctcagcctccaccaagggcccatcggtcttccccctggccgccctgctccaggacgcacctccgaga

SEQ ID NO: 296321 - DNA, 185 bp, Homo sapiens
  misc_feature: NA.44.46.E02.4.454.heavy.1.nb
gttggccgtattagaaccaaagctgacggtgggacagcagactacgctgcacccgtgaaaggcagattcaccatctcaagagatgattcaaaagatacggtgtctctgcagatgaacagcctgaacaccgaggacacagccgtctattactgtctgggatggtttcattcgggccagggaaccct

SEQ ID NO: 296322 - DNA, 284 bp, Homo sapiens
  misc_feature: NA.44.46.E02.5.454.heavy.1.nb
gtctcacgtattaacaccgatgggactatcactggttactcagacgccgtgaagggccgattcatcatctccagagacaatgtcgaaaacacggtgtatttacaaatgaacagtctaagagtcgaggacacggctgtctactattgtgtgagaccttatgatttcacttgggggattatcgtttgggcccacactggggccagggaaccttggtcgtcgtctcctcagcttccaccaagggcccatcggtcttccccctggcgccctgctccaggagcacctct

SEQ ID NO: 296323 - DNA, 388 bp, Homo sapiens
  misc_feature: NA.44.55.E11.1.454.heavy.1.nb
aggagcccagcactgggattccgaggtgtttccattcggtgatcagcactgaacacagaggactcaccatggagttttggctgagctgggttctccttgttggacttttaaaaggtgtccagtgtgaggtgcggctgatggagtctggaggaggcttagtccagcctggggggtcccagagactctcctgtgcagcctctgggctcaccgtcagcagcaactacatgagttgggtccgccaggctccgaggggaaggggctgggagtgggtctcgagtcatttatactggtgatttcacatactacgcagactccgtgaagggccgattcaccatctccagggacaattccaggaacacggtttatcttacaaatgaacaacctgaga

SEQ ID NO: 296324 - DNA, 268 bp, Homo sapiens
  misc_feature: NA.44.56.F01.1.454.heavy.1.nb
ggagaggagccccagccgtgagattcccaggagtttccacttggtgatcagcactgagcacagaccaccaaccatggagtttgggctaatcttgattttccttgttagttttttagaaggtgtccagtgcgaggggcgacgtggcggaggtcgggggggggcttggcacgagccagggcggtctctgagactctcctgtgtagtctcaggattcagtcttagtgattatcacttggcctgggtccgtcaggctccagggagggcttgg

SEQ ID NO: 296325 - DNA, 368 bp, Homo sapiens
  misc_feature: NA.44.60.F05.1.454.heavy.1.nb
tctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagccggtgcgggagttcggggagttgcatactactactacggtatggacgtctggggccaagggaccacggtcaccgtctcctcagcttccaccaagggcccatcggtcttccccctggcgccctgctccaggagcacctctgggggcacagcggccctgggctgcctggtcaaggctacttcctatatactgtctgagcgggctggcaaggcgcat

SEQ ID NO: 296326 - DNA, 164 bp, Homo sapiens
  misc_feature: NA.44.61.F06.1.454.heavy.1.nb
tatgcgccttgccagcccgctcagcagtagacgtggaagtagtccttgaccagacagcccagggccgctgtgcccccagaggtgctcctggagcagggcgccagggggaagaccgatgggcccttggtggaggctgaggagacggtgaccaggttccctggccc

SEQ ID NO: 296327 - DNA, 364 bp, Homo sapiens
  misc_feature: NA.44.70.G04.2.454.heavy.1.nb
attgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagagacgggggggcaactggctcgacccctggggccagggaaccctggtcaccgtctcctcagcttccaccaagggcccatcggtcttccccctggcgccctgctccaggagcacctctgggggcacagcggccctgggctgcctggtcaaggactacttccacgtctactgctgagcgggctggcaaggcgcata

SEQ ID NO: 296328 - DNA, 200 bp, Homo sapiens
  misc_feature: NA.44.70.G04.3.454.heavy.1.nb
gttggccgtattagaaccaaagctgacggtgggacagcagactacgctgcacccgtgaaaggcagattcaccatctcaagagatgattcaaaaagatacggtgtctctgcagatgaacagcctgaacaccgaggacacagccgtctattactgtctgggatggtttcattcgggccagggaccctggtcaccgtctcctc

SEQ ID NO: 296329 - DNA, 135 bp, Homo sapiens
  misc_feature: NA.44.70.G04.4.454.heavy.1.nb
gtctcacgtattaacaccgatgggactatcactggttactcagacgccgtgaagggccgattcatcatctccagagacaatgtacgaaaacacggtgtaatttacaaatgaacagtactaagagtcgagacacgg

SEQ ID NO: 296330 - DNA, 343 bp, Homo sapiens
  misc_feature: NA.44.72.G06.1.454.heavy.1.nb
ggtggccatcatgaagaaagatggaactgagacacactatgtggactctgtgaagggccgattcaccatctccagagacaacgccaagaactcactgtatctgcaaatgaacagtctgagagtcgaggacacggctgtgtattattgtgcgggaggcgctgggtggctcattgactactggggtcagggaaccctggtcaccgtctcctcagcctccaccaagggcccatcggtcttccccctggcgccctgctccaggagcacctccgagagcacagcggccctgggctgcctggtcaaggctacttccacgtctactgctgagcgggctggcaaggcgcat

SEQ ID NO: 296331 - DNA, 78 bp, Homo sapiens
  misc_feature: NA.44.73.G07.2.454.heavy.1.nb
tatgcgccttgccagcccgctcagacagtatatagaggaggtgggaacagagtgaccaggggcagccttgggctgacc

SEQ ID NO: 296332 - DNA, 358 bp, Homo sapiens
  misc_feature: NA.44.73.G07.5.454.heavy.1.nb
ctcatcaccatggactggacctggaggttcctctttgtggtggcagcaactacaggtgtccagtcccaggtgcgtctggtgcaatctggggctgaaatgaagaagcctgggtcctcggtgaaggtctcctgcacggcttctggaggcatcttcagaaactatcttatcacctgggtgcgacaggcccctggacaagggcttgagtggatgggtgggctcgtccccaattttggacaagcaaactacgcacagaaattccagggcagactcacgattaccgcggacgaatccacgagtgcagcctatatggagctgcgcaacctgagatctgaggacacggccctatatttctgcgcga

SEQ ID NO: 296333 - DNA, 301 bp, Homo sapiens
  misc_feature: NA.44.74.G08.2.454.heavy.1.nb
attcccaggtgttttcattcagtgatcaggactgaacacagaggactcaccatggagtttgggctgagctggattttccttgctgctattttaaaaggtgtccagtgtgaggtgcagttggtggagtcgtgggggaggtttggtaaagccgtggggagtcccttagactctcctgtgcagcctctggattcactttcagtaacgcctggatgacctgggtccccaggctccgagggagggctggagtgggtgcgtattagaaccaagctgacggtgggacagcagactacgctgcaccgtg

SEQ ID NO: 296334 - DNA, 359 bp, Homo sapiens
  misc_feature: NA.44.79.H02.1.454.heavy.1.nb
gtggccaacgtgaggcaagatggagttagtaaatactatgcggacagtttgaagggccgattcaccatctccagagacaacgccaagaactctctgtatctgcaaatgaccagcctgagagtcgaggacacggctgtgtattactgtgcgaccatatcagcgcctggagtccgttctgagtacttccaagattggggccagggcaccctggtcaccgtctcctcagcctccaccaagggcccatcggtcttccccctggcgccctgctccaggagcacctccgagagcacagcggccctgggctgcctggtcaaggactacttcctatatactgtctgagcgggctggcaaggcgcata

SEQ ID NO: 296335 - DNA, 365 bp, Homo sapiens
  misc_feature: NA.44.80.H03.1.454.heavy.1.nb
gattgggcgcatctataacagtggcagcaccaactacaaccccgccctcaagagtcgagtcaccatgtcactagacaggtccaagaaccagttctccctgaaattgacttctgtgaccgccgcggacacggccgtatattattgtgcgagagattcctatcgatacagtagaggacgggggggcaactggctcggacccctggggccagggaaccctggtcaccgtctcctcagcttccaccaaggcccatcggtcttcccctggcgccctgctccaggagcacctctgggggcacagcggccctgggctgcctggtcaaggactacttcctatatactgtctgagcgggctggcaaggcgcata

SEQ ID NO: 296336 - DNA, 415 bp, Homo sapiens
  misc_feature: NA.44.84.H07.1.454.heavy.1.nb
gggattcccagctgtttctgcttgctgatcaggactgcacacagagaactcaccatggagtttgggctgagctgggttttccttgttgctattttaaaaggtgtccagtgtgaggtgcaggtgatggaatttgggggacgcctagttcggccggggggcccctaagactctcctgtctcgtctctgaacccacctttagcagctactggatgcactgggtccgccaagctccaggaaagggcctgatgtgggtctcacgtattaacaccgatgggactatcactggttactcagacgccgtgaagggccgattcatcatctccagagacaatgtacgaaaacacggtgtaatttacaaatgaacagtactaagagtcgaggacacggctgtctactattgtgtgagtaccttatg

SEQ ID NO: 296337 - DNA, 304 bp, Homo sapiens
  misc_feature: NA.44.85.H08.2.454.heavy.1.nb
ggagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcgtctggattcaccttcagtacctatggcatgcactgggtccgccaggcctccgaggcaaggggctggagtgggtgcacttatatggtatgatggaataataaatactat

SEQ ID NO: 296338 - DNA, 298 bp, Homo sapiens
  misc_feature: NA.44.9.A09.1.454.heavy.1.nb
gattcttcctcttaagaagcccctgggagcacagctcatcaccatggactggacctggaggttcctctttgtggtggcagcagctacaggtgtccactcccaggtccagctggtgcaatctgggcctgaggtgaagaggcctgggtcctcggtgagggtctcctgtaaggtctccggaagcagtgtgttcgtcagacatacactcacctgggtccggcaggcctctggaactgggcctgagtgggtggacaatcaaccgcacgccggaacaacagaggtcgcacatcagtttcagggc

SEQ ID NO: 296339 - DNA, 77 bp, Homo sapiens
  misc_feature: NA.45.11.A11.2.454.heavy.1.nb
ctgggaggccagagtagcaggaggaagagaagctgcgctggggcttccatggttccgtctgggtcctaactgagcag

SEQ ID NO: 296340 - DNA, 317 bp, Homo sapiens
  misc_feature: NA.45.14.B03.1.454.heavy.1.nb
cctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggacc

SEQ ID NO: 296341 - DNA, 272 bp, Homo sapiens
  misc_feature: NA.45.15.B04.2.454.heavy.1.nb
actgcccagctgggatctcagggcttcattttctgtcctccaccatcatggggtcaaccgccatcatcgccctcctcctggctgttctccaaggagtctgtgccgaggtgcagctggtgcagtctggagcagaggtgagaaagcccgggcagtctctgatactctcctgtaaggattctggatacaactttaacgaccactggatcgcctgggtgcgccagactcggcccggggaaaggcctaggaaatcggtgggcatcatctatcctggt

SEQ ID NO: 296342 - DNA, 137 bp, Homo sapiens
  misc_feature: NA.45.18.B07.1.454.heavy.1.nb
aacagaggcagacacgtaggatggagactgggtcatctggaggtcacatctggtatctgggagccagagcagcaggagtcccacggagctgagccagggaccctcatgtccatgctgtgtcctgactgagagagact

SEQ ID NO: 296343 - DNA, 305 bp, Homo sapiens
  misc_feature: NA.45.19.B08.2.454.heavy.1.nb
cagattcctcctccaaagaagcccctgggagcacagctcatcaccatggactggacctggaggttcctctttgtggtggcagcaggtgcaggtgtccagtcccaggcccagctggggcaatctggggctgaggtgaagaagcctgggtcctcggtgaaggtctcctgcaaggcttctggaggcaccttcagcaactatggagtcagctgggtgcgccaggcccctggacaagggccagagtggttggggaggatcatccctctctatgggataccaaattacgcacagcaatttcagggcagagt

SEQ ID NO: 296344 - DNA, 106 bp, Homo sapiens
  misc_feature: NA.45.26.C04.1.454.heavy.1.nb
tatgcgccttgccagcccgctcagacgcgatcgaggaagtagtccttgaccaggcagcccagggccgctgtgcccagcacctgaactcctgggggaccgtcagtct

SEQ ID NO: 296345 - DNA, 429 bp, Homo sapiens
  misc_feature: NA.45.34.D01.1.454.heavy.1.nb
agaggagccttagccctggactccaaggcctttccacttggtgaccagcactgagcacagaggactcaccatggaattggggctgagctgggctttccttgttgctattttagaaggtgtccaatgtgagatgaaagtggtggagtcgtgggggagacttggtccatccgggggggtccctgagactctcctgtacagcctctggactcaccttgagcaattattggatgacctgggtccgccaggctccagggaagggctggagtgggtggccaacataaagcaagatgggagtcgaaagaactatgtggactctgtgaagggtcggttcaccatctccagagacaatgaccaagattcagtctttttgaaatggacagtctgagatccgaagatacggcagtatattactgcgcgagagatgatagt

SEQ ID NO: 296346 - DNA, 150 bp, Homo sapiens
  misc_feature: NA.45.36.D03.1.454.heavy.1.nb
ggagacgagcccagcactggaagtcgccggtgtttcctttcggtgatcatcactgaacacagaggactcaccatggactttgggctgacctgggttttcctcgttgctcttttaagaggtgtccagtgtcaggtgcaggtggtggaggtc

SEQ ID NO: 296347 - DNA, 384 bp, Homo sapiens
  misc_feature: NA.45.36.D03.2.454.heavy.1.nb
ggggggaggcgttgtccagcctgggaggtccctgagactctcctgtgcagcctctggattctccctcagtaactttggtttccactgggtccgccaggttccaggcaaggggctggagtgggtggccctcatttccgaagatggaagtgagaaggcctactcagactccgtgaagggccgcttcaccatctccagagacaattccaagaatgtcctctttttgcaaatgaatagcctgagagttgaggacacgtctgtctatttctgtgccagggggacatctatgagtctggttcgtagtgtaatcaactactactacctcatggacgtctggggcaaagggacctcggtcaccgtctccgcagcttccaccaagggcccatc

SEQ ID NO: 296348 - DNA, 358 bp, Homo sapiens
  misc_feature: NA.45.37.D04.2.454.heavy.1.nb
acccagcaaccacatctgtcctctagagaatcccctgagagctccgttcctcaccatggactggacctggaggatcctcttcttggtggcagcagccacaagagcccactcccaggtgcagctggtgcagtctggggctgaggtgaggaagcctggggcctcagtgaaggtctcctgcaaggcttctggctacaccttcaccggcgactatctccactgggtgcgacaggcccctggacaagggcttgagtggatgggatggatcaaccctaacaatggtggcacaaactatgcacagaagtttcagggcagggtcaccatgaccagggacacgtccatcagcacagcctacatggag

SEQ ID NO: 296349 - DNA, 105 bp, Homo sapiens
  misc_feature: NA.45.37.D04.3.454.heavy.1.nb
tatgcgccttgccagcccgctcagacgcgatcgaggaagtagtccttgaccaggcagcccagggccgctgtgcccagcacctgaactcctgggggaccgtcagtc

SEQ ID NO: 296350 - DNA, 373 bp, Homo sapiens
  misc_feature: NA.45.38.D05.4.454.heavy.1.nb
tgagagtcacggacctcctgtgcaggaacatgaagcacctgtggttcctcctcctgctggtggcggctcccggatgcgtcctgtcccagctgcacctgcaggagtcgggcccaggactggtgaagccttcggagaccctgtccctcacttgcagtgtctctggtgactccatcagtagtagtcataaattttggggctgggtccgccagcccccagggaaggggctggagtggattgggactgtctactctagtgggaccacctattacagcccgtccctcaagactcgactggtgatctcaataaacacgtaccaagaaccaattctccctgaggctgaactctgtgaccgcgcggacacggccaaatatta

SEQ ID NO: 296351 - DNA, 108 bp, Homo sapiens
  misc_feature: NA.45.38.D05.7.454.heavy.1.nb
tatgcgccttgccagcccgctcagacgcgatcgaggaagtagtccttgaccaggcagcccagggccgctgtgcccagcacctgaactcctgggggaccgtcagtcttc

SEQ ID NO: 296352 - DNA, 345 bp, Homo sapiens
  misc_feature: NA.45.39.D06.1.454.heavy.1.nb
gagcccagcactagaagtcggcggtgtttccattcggtgatcagcactgaacacagaggactcaccatggagtttgggctgagctgggttttcctcgttgctcttttaagaggtgtccagtgtcaggtggaagtggtgcagtccgggggagcgtggtccagcctgggagtccctgacactctcctgtgaagcgcctggactcaccttcagtggctatggccttcactgggtccgccaggttccaggcaaggggctggagtggttggctgatatatggtatgatggagagactaaacactttgcagactccgtgaggggccattcaccatcgccagagacaattcc

SEQ ID NO: 296353 - DNA, 358 bp, Homo sapiens
  misc_feature: NA.45.42.D09.1.454.heavy.1.nb
gtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggccgccctgctccaggagcacctccgagacgcacagcggccctgggctgcctggtcaaggctacttcctcgatcgcgtctgagcgggctggcaaggcgcat

SEQ ID NO: 296354 - DNA, 357 bp, Homo sapiens
  misc_feature: NA.45.5.A05.1.454.heavy.1.nb
gccccagccccagaattcccaggagtttccactcggtgatcagcactgaacacagaggactcaccatggagtttgggctgagctgggttttccttgctattattataaaaggtgtcctgtgtcaggtacagatggcggagtctgggggaagaacggtcaaccctggcgggtccctgaggctctcctgtttaggttctggattcgtcttcagcgactactacctgagttgggtccggctggctccagggagagtcgtgggagtggatttggcgtacatcagtcattctgattcgaccgtctactacgcagactctgtggaggccattcaccatttccgagggacgacgccgcgaactc

SEQ ID NO: 296355 - DNA, 617 bp, Homo sapiens
  misc_feature: NA.45.53.E09.1.454.heavy.1.nb
accacatccctcctcagaagcccccagagcacaactcctcaccatggactggacctggaggatcctctttttggtggcagcagccacaggtgtccactcccaggtccagcatgtgcagtctggggctgaggcgaagaagcctggggcctcagtgaaggtttcctgcaaggcttctggatacactttcgctgcccatgccattcattgggtgcgccaggcccccggacaagggcttgagtggatgggatggatcaacgctggcactggttacacagaatattcacagaaattccaggacagagtcaccatttctagggacatattcgcgaacacagcctacatggacctgagcagtttgagatctgacgacacggctgtctattactgtgcgagagacgggggggaggatattgcactaatgattatactgtgtgccatgggttgagctcctggggccagggaaccctggtcaccgtctcctcagcctccaccaagggcccatcggtcttccccctggcgccctgctccaggagcacctccgagagcacagcggccctgggctgcctggtcaaggactacttcctcgatcgcgtctgagcgggctggcaaggcgcata

SEQ ID NO: 296356 - DNA, 39 bp, Homo sapiens
  misc_feature: NA.45.58.F03.1.454.heavy.1.nb
gctggggcctccatggttccgtctgggtcctaactgagc

SEQ ID NO: 296357 - DNA, 357 bp, Homo sapiens
  misc_feature: NA.45.60.F05.4.454.heavy.1.nb
gtgggtctcattagaagcaaagcttctggggggacaacagactacgccgcgtctgtgaaaggcagattcaccatctcaagagatgattccaaaagtgtcgcccatctgcaaatgaacagcctgaaaaccgaggacacagccatgtattactgtactagaggggtaggtcgctgtccggtaactcccactactggggccagggaaccctggtcaccgtctcctcagcctccaccaagggcccatcggtcttccccctggcgccctgctccaggagcacctccgagagcacagcggccctgggctgcctggtcaaggctacttcctcgatcgcgtctgagcgggctggcaaggcgcata

SEQ ID NO: 296358 - DNA, 323 bp, Homo sapiens
  misc_feature: NA.45.63.F08.1.454.heavy.1.nb
gccctggattccaaggcatttccacttggtgatcagcactgaacacagaggactcaccatggagttggggctgtgctgggttttccttgttgctattttagaaggtgtccagtgtgaggtgcagctggtggagtcgtgggggaggcttggtacagccgtggggggtccctggagactctcctgtgcagcctctggacttccccttcaatagctatagcatgaactgggtccgccaggctccgaggggaaggggctggcgtgggttcatacattagtactagtagtagtaccatatactacgcagactctgtgaagggccattc

SEQ ID NO: 296359 - DNA, 555 bp, Homo sapiens
  misc_feature: NA.45.67.G01.1.454.heavy.1.nb
accgtgggcatgggggaggtgtgtcacaagatttgggctctgggcaccgtgggcacgggggaggcgtggtccagccgggggggtctctgagactctcctgcgctgcctctggattcaccttcagtgcttatgctctccactgggtccgccgaggggccaggcaagggtctggagtgggtgggagccgtctcaaaggatggagataaaacatatttcgcagactccgtgtggcgccgattcaccatctccagaaacaatcccgggaacaccctacatctccacatgaaatccctgagaccggaggacacggctgtttatttctgtgccagaggtcgaaggatggcgtggggcgaactcaatccctccgaatactactactacatggacgcctggggcaaagggacctcggtcgccgtctcctcagcttccaccaagggcccatcggtcttccccctggcgccctgctccaggagcacctctgggcacagcggccctgggctgcctggtcaaggactacttcctcgatcgcgtctgagcgggctggcaaggcgcata

SEQ ID NO: 296360 - DNA, 226 bp, Homo sapiens
  misc_feature: NA.45.69.G03.1.454.heavy.1.nb
aaccacacccctcctcgggagaatcccctagatcacagctcctcaccatggactggacctggagcatccttttcttggtggcagcagcaacaggtgcccactcccaggtccagctggtgcagtctggagctgaggtgaagaagcctggggcctcagtgagggtctcctgcgcgacttcaggtctcgcctttacgagtcatggtttctgctgggtgcgacaggcccc

SEQ ID NO: 296361 - DNA, 318 bp, Homo sapiens
  misc_feature: NA.45.73.G07.1.454.heavy.1.nb
cgccccagccccagaattcgcaggagtttccattcggtgatcagcactgaacacagaggactcaccatggattttgggctgagctgggttttccttgttgctattataaaaggtgtccacggtcaggcgcggctggtggagtcgtgggggggacttggtcaagcctggagagtccctgagactctcctgtgcagcctctggattcagtttcagcgactcctacataaactggatccgccaggttccgagggggggcctcggagtggctgtcatacatcagtcacaccagtgcgaccatatactatcttgactctgtga

SEQ ID NO: 296362 - DNA, 241 bp, Homo sapiens
  misc_feature: NA.45.74.G08.1.454.heavy.1.nb
agcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggcggtcgctgagactctcctgtataggttctggattcaccttcaagagtcatggactgcacgtgggtccgccaggcccca

SEQ ID NO: 296363 - DNA, 557 bp, Homo sapiens
  misc_feature: NA.45.75.G09.1.454.heavy.1.nb
gcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccaggccgggggggtccctcagactctcgtgtgcagcctctggattcaccgtcagtggcagcttcctgagctgggtccgccaggctccagggaagggcctggagtgggtctcagttaatttttagacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaaattctaacaactactacggtatggacgtctggggccaagggaccaccgtcaccgtctcctcagcctccaccaagggcccatcggtcttccccctggccaccctcctccaagagcacctct

SEQ ID NO: 296364 - DNA, 577 bp, Homo sapiens
  misc_feature: NA.45.78.H01.1.454.heavy.1.nb
cacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggatggatcaaccctaacaatggtggcacaaactatgcacagaagtttcagggcagggtcaccatgaccagggacacgtccatcagcacagcctacatggagctgagcaggctgagatctgacgacacggccgtgtattactgtgcgagaggcaggaattacgattttggagtggttattcggacggtatggacgtctggggccaagggaccacggtcaccgtctcctcagcctccaccaacgggcccatccggtccttccccctggccaccctcctccaacgacgccacctcgtcgggggccacgacgccggccctggg

SEQ ID NO: 296365 - DNA, 384 bp, Homo sapiens
  misc_feature: NA.45.79.H02.6.454.heavy.1.nb
ggcagcccccagggaagggactggagtggattgggtatatctattacagtgggagcaccaactacaacccctccctcaagagtcgagtcaccatatcagtagacacgtccaagaaccagttctccctgaagctgagctctgtgaccgctgcggacacggccgtgtattactgtgcgagagatcctaatacgtattactttgatagtaggggagtttttgatatctggggccaagggacaatggtcaccgtctcttcagcctccaccaagggcccatcggtcttccccctggcaccctcctccaagagcacctctggggcacagcggccctgggctgcctggtcaaggctacttcctcgatcgcgtctgagcgggctggcaaggc

SEQ ID NO: 296366 - DNA, 431 bp, Homo sapiens
  misc_feature: NA.45.87.H10.7.454.heavy.1.nb
taaacaaccagattcctcctctaaagaagcccctgggagcacagctcatcaccatggactggacctggaggttcctctttgtggtggcagcagctacaggtgtccagtcccaggtccagctggtgcaatcgtggggctgaggtgaagaagcctgggtcctcggtgaaggtctcctgcaaggcttctggaggcagcttcagcaactttcctatcagctgggtgcgacaggcccctggacaagggcctgagtggatgggaagagtcatgccaagacttgatacagcagactacgctcagaaattccaggaccgagtcaccattattgcggacacatccacgaccacagcctacatggagctgagaagcctgagatttgacgacacggccatttattctgtgcgagagtcggccgtgcgggctacttcgactac

SEQ ID NO: 296367 - DNA, 106 bp, Homo sapiens; identical to SEQ ID NO: 296344
  misc_feature: NA.45.87.H10.8.454.heavy.1.nb

SEQ ID NO: 296368 - DNA, 104 bp, Homo sapiens
  misc_feature: NA.46.14.B03.1.454.heavy.1.nb
tatgcgccttgccagcccgctcagactagcagtagaggagggctgggaacagagtgaccgaggggcagccttgggctgacctaggacggtcagtttggtccctc

SEQ ID NO: 296369 - DNA, 472 bp, Homo sapiens
  misc_feature: NA.46.67.G01.1.454.heavy.1.nb
  modified_base (312)..(312): a, c, t, g, unknown or other
  misc_feature (312)..(312): n is a, c, g, or t
ctgtgcaagaacatgaagcacctgtggtttgtcctcctgctggtggcagctcccagatgggtcctgtccctggtgcaactgcaggagtcgggcccacgactggtgaggccttcggagaccctgtccctcacctgcgctgtctctggtgcctccatcagtagtggtttcttctggggctgggtccggcagctcccgagggaaggggctggaatacattggaagtgtctctcatagtggaggttcctattacagtccgtctctcaagagtcgagtcaccatatctctggacacgtccagcaatcagttttcccngaagatgagttctgtgaccgccgctgacacgggctttattactgtgcgagagacggctattatgtatttttggagttggttatttcgactaccctagatcggacggggctcgacccgtggggccagggaatacgtggtcaccgtctccttagcctccacc

SEQ ID NO: 296370 - DNA, 57 bp, Homo sapiens
  misc_feature: NA.46.67.G01.4.454.heavy.1.nb
tcggtcaggacacgagcatggacagtgagggtcccgcgtccagctcctggggctccg

SEQ ID NO: 296371 - DNA, 103 bp, Homo sapiens
  misc_feature: NA.46.89.I01.2.454.heavy.1.nb
tatgcgccttgccagcccgctcagacgagtgcgtgaggagggtgggaacagagtgaccgaggggcagccttgggctgacctaggacggtcagcttggtccctc

SEQ ID NO: 296372 - DNA, 289 bp, Homo sapiens
  misc_feature: NA.47.12.B01.1.454.heavy.1.nb
  modified_base (239)..(239): a, c, t, g, unknown or other
  misc_feature (239)..(239): n is a, c, g, or t
  modified_base (254)..(254): a, c, t, g, unknown or other
  misc_feature (254)..(254): n is a, c, g, or t
ggagccccagccttgggattcccaagagtttgtattcagtgatcaggactgaacacacaggactcaccatggagttggggctgagctgggttttccttgttgctatattagaaggtgtccagtgtgaggtgcagctggtggagtcggggggaggcctggtacagcctggggggtccctggagactctcctgtgcagcctctggattcatcttcagtgactacgacatgcactgggtccnccaagttgcaggganaacctctggaatgggtctccgttattgctactggt

SEQ ID NO: 296373 - DNA, 100 bp, Homo sapiens
  misc_feature: NA.47.2.A02.2.454.heavy.1.nb
tcatcacatttctccagtggtctctgggaggccagagtagcaggaggaagagaagctgcgctggggcttccatggttccgtctgggtcctaactgagcac

SEQ ID NO: 296374 - DNA, 364 bp, Homo sapiens
  misc_feature: NA.47.23.C01.4.454.heavy.1.nb
atcacatccctcctcagaagcccccagagcacaactccttaccatggactggacctggaggatcgtctttttggtggcagcagccacaggtgcccactcccaggtccaacttgtgcagtctggggctgaggtgaagaagcctggggcctcagtgaaggtttcctgtcaggcttctggatacagcttcactagtcatgctatacattgggtgcgccaggccccccggacagagacctgagtggatgggatggatcagcattggcaatggtaacataaaacactcacagaagttccagggcagggtcaccattaccagagacatctccgcgaccacagcctacatggaactgagcagcctgacttc

SEQ ID NO: 296375 - DNA, 178 bp, Homo sapiens
  misc_feature: NA.47.23.C01.5.454.heavy.1.nb
tatgcgccttgccagcccgctcagagctcacgtaggaagtagtccttgaccaggcagcccagggccgctgtgcccccagaggtgctcttggaggagggtgccagggggaagaccgatgggcccttggtggaggctgaggagacggtgaccagggttccctggccccagtagtcaaggt

SEQ ID NO: 296376 - DNA, 364 bp, Homo sapiens
  misc_feature: NA.47.24.C02.1.454.heavy.1.nb
gattggctatgttcattccagtgggagcaccgactataacctctccctcaagggtcgagtcaccatcttggcagacacgtccaagcaccaattctccctgaagctgacttctatgaccgctgcggacgcggccgtctattattgtgcgagaggggcacctcggtccgcttattactaccactcctacttggacgtctggggcaaagggaccgcggtcaccgtctcctcagcctccaccaagggcccatcggtcttcccctggccgccctgctccaggacgcacctccgagagcacagcggccctgggctgcctggtcaaggactacttcctacgtgagctctgagcgggctggcaaggcgcata

SEQ ID NO: 296377 - DNA, 106 bp, Homo sapiens
  misc_feature: NA.47.37.D04.1.454.heavy.1.nb
tatgcgccttgccagcccgctcagagctcacgtaggaagtagtccttgaccaggcagcccagggccgctgtgcccagcacctgaactcctgggggaccgtcagtct

SEQ ID NO: 296378 - DNA, 399 bp, Homo sapiens
  misc_feature: NA.47.38.D05.1.454.heavy.1.nb
tgctggagggcacggtcaccacgctgcttgagtggatgggacggatcagccctaacagtggtggcacaaactatgcacagaggtttcagggcagggtcaccatgaccagggacacgtccatcagtacagcctacatggagctgagcagtctgagacctgacgacacggccgtgtattattgtgcgttagttacggacgattacgacgttttgattggtcattacccggacgtgtggggcaaagggaccacggtcaccgtctcctcagcctccaccaagggcccatcggtcttccccctggcaccctcctccaagagcacctctggggcacagcggccctgggctgcctggtcaaggactacttcctacgtgagctctgagcgggctggcaaggcgcata

SEQ ID NO: 296379 - DNA, 241 bp, Homo sapiens
  misc_feature: NA.47.38.D05.3.454.heavy.1.nb
cccagcaaccacatctgtcctctagagaatcccctgagagctccgttcctcaccatggactggacctggaggatcctcttcttggtggcagcagccacaggagtccactcccagttgcaactggtgcagtctggggctgaggtgaagaagccgtggggcctcagtgaaggtctcctgcaaggcttctggatacagcttcaccgactactatttgcactgggtgcgacgggcccctggacaa

SEQ ID NO: 296380 - DNA, 373 bp, Homo sapiens
  misc_feature: NA.47.45.E01.1.454.heavy.1.nb
gtttcatacattagtagtgacactagtgttagtcctggtagtacaatttactacgcagactctgtgaagggccgattcaccatctccagagacgatgccaggacctcactgtatctgcaaatgaacagcctgagagacgaagacacggctgtgtattactgtgcgagagaacgtggatactacaatggttactaccactactacggtatggacgtctggggccaagggaccacggtcaccgtctcctcagcctccaccaagggcccatcggtcttccccctggcaccctcctccaagacgcacctctgggggcacagcggccctggctgcctggtcaaggctacttcctacgtgagctctgagcgggctgggc

SEQ ID NO: 296381 - DNA, 630 bp, Homo sapiens
  misc_feature: NA.47.46.E02.6.454.heavy.1.nb
agaggagcccagccctgggattttcaggtgttttcatttggtgatcaggactgaaccgagagaactcaccatggagtttgggctgagctggctctttcttgtggcttttttaaaaggtgtccagtgtgaggtgcaactgttggagtcgtgggggagacttagtacacccgtggggggtccctgagactctcctgtgcagcctctggactcacctttagcaactctgtcatgggctgggtccgccaggcgtccgggggaaggggctgggagtgggtctcaagtattgatgagaatggtggaagcacattctacgtggactccgtgaagggccggttcaccatctccagagacaatttcaggagcacgctgtatctacaaatgaacagcctgagagccgaggacacggccgtatatttctgtgcgaaagtctatagcagtgccccctagcgcacttcttgacttctggggccagggaatcctggtcaccgtctccacagcctccaccaagggcccatcggtccttcccccgtggcgccctgctccaggacgcacctccgagagcacagcggccctgggctgcctggtcaaggctacttcctacgtgagctctgagcgggctggcaaggcgca

SEQ ID NO: 296382 - DNA, 354 bp, Homo sapiens
  misc_feature: NA.47.48.E04.2.454.heavy.1.nb
gagaggagccttagccctggactccaaggcctttccacttggtgatcagcactgagcacagaggactcaccatggaattggggctgagctgggttttccttgttgctattttagaaggtgtccagtgtgaggtgcaattggtgcaatctgggggaggcttggtccagcctggggggtccctcagactctcctgtgcagcctctggattcacctttagttcctcttggatgaattgggtccgccagactccgagggaaggggctggagtgggttggcaacataaatccagatggaagtcaagaaaacctatgtggactctctggaagggccgattcaccatcctcagagacaacg

SEQ ID NO: 296383 - DNA, 260 bp, Homo sapiens
  misc_feature: NA.47.52.E08.2.454.heavy.1.nb
taacaaccacattcctcctctaaagaagcccctgggagcacagctcatcaccatggactggacctggaggttcctctttgtggtggcagcagctacaggtgtccagtctcaggtgcagctggtgcagtctggggctgaggtgaaggagccgtgggtcctcggtgaaggtctcctgcagggcttcgtggaggcaccttcggcacctacactatcggctgggtgcgacagtcccctggacaagggcttgagtggagtgggcg

SEQ ID NO: 296384 - DNA, 391 bp, Homo sapiens
  misc_feature: NA.47.53.E09.2.454.heavy.1.nb
gtgccccaccatggacacactttgctccacgctcctgctgctgaccatcccttcatgggtcttgtcccagatcaccttgaaggagtctggtccgacgctggtgaaacccacacagaccctcacgctgacctgcagcttctctggattttcactcagtagtactggagaggctgtgggctgggtccgtcagcccccaggaaaggccctggagtggcttgcactcatttattgggatgatgtgaagtactacagtccatatttcaagaggctcactatcaccaaggacacttaccaaaaaccagtggtcctgacaatgaccaacgtgaagcctgcggacacggccacatattattgtgcacaccgacgctataccgccagctgggaaatcgac

SEQ ID NO: 296385 - DNA, 232 bp, Homo sapiens
  misc_feature: NA.47.55.E11.2.454.heavy.1.nb
taaggggctggtgtgggtctcacgtatcaatcctgatggcagtgttataaattatgcggactccgtgaggggccattcagcatctccagagacaacggcaagagtatactgtatctggaaatgaacaatctgagagtcgacgatacggctgtctatcattgtgttttcgatgccttcggtccgcgggtacttcgtggggccagggaaccctggtcagcgtctcctcagcctc

SEQ ID NO: 296386 - DNA, 72 bp, Homo sapiens
  misc_feature: NA.47.55.E11.5.454.heavy.1.nb
aggaagactgacggtccccccaggagttcaggtgctgaggaagagatggaggtggacgtgtcagcacccggc

SEQ ID NO: 296387 - DNA, 288 bp, Homo sapiens
  misc_feature: NA.47.56.F01.1.454.heavy.1.nb
agccctgggattcccagctgtttctgcttgctgatcaggactgcacacagagaactcaccatggagtttgggctgagctgggttttccttgttgctattttaaaaggtgtccagtgtgaggtgcaactggtggagtccgggggaggcttaattcagcctggggggtccctgagactctcctgtgcagcctctggattcaccttcagtagttactggatgcactgggtccgccaagctccgagggaagggactggtgtgggtctcacgtattaatcctgatggaagtcg

SEQ ID NO: 296388 - DNA, 92 bp, Homo sapiens
  misc_feature: NA.47.59.F04.1.454.heavy.1.nb
ctgctcagttaggacccagagggaaccatggaagccccagctcagcttctcttcctcctgctactctggctccagataccaccggagaagtt

SEQ ID NO: 296389 - DNA, 342 bp, Homo sapiens
  misc_feature: NA.47.60.F05.1.454.heavy.1.nb
tggctatctgtattacggtgggagttcaaacttcaacccctccctcaagagtcgagtcaccatttcaggagacacgtccaagaatcaggtctccttgaacctgaggcagacgaccccagcggacacggccgtctattattgtgcgagaggtcttcttgatgacgatgccctggacgactggggccagggagtccttgtcaccgtctcctcagcctccaccaagggcccatcggtcttccccctggccaccctcctccaagagcacctctggggcacagcggccctgggctgcctggtcaaggactacttcctacgtgagctctgagcgggctggcaaggcgc

SEQ ID NO: 296390 - DNA, 320 bp, Homo sapiens
  misc_feature: NA.47.64.F09.9.454.heavy.1.nb
atggatctcatgtgcaagaaaatgaagcacctgtggttcttcctcctgctggtggcggctccagatgggtcctgtcccagctgcaactgcaggagtcgggcccaggactggtgaagccttcggagaccctgtccctcacttgcattgtctctggtgctccatcacctagttttaatattggtgggctggatccgccagcccccagggaaggggctggaatggattgggagtatattttataatggggacactctttacaacccatccctcaagagtcgagtttccatatccgcagacacgtccgagaatcacttctccct

SEQ ID NO: 296391 - DNA, 302 bp, Homo sapiens
  misc_feature: NA.47.70.G04.7.454.heavy.1.nb
gtggcatttatatggtacgatggaagtaattattactatgcagactccgtgaggggccgattcaccatctccagagacaattccaagaacacggtgtatctgacaaatgaatagcctgagagccgaggacacggctgtgtattactgtgtgagagatggtaattggaactccgtcgactatcactactacatggacgtctggggcaaaggggaccacggtcaccgtctcctcagcctccaccaaggcccatcggtccttcccctggccaccctcctccaagacgcacctctcgggggcacag

SEQ ID NO: 296392 - DNA, 607 bp, Homo sapiens
  misc_feature: NA.47.77.G11.1.454.heavy.1.nb
gagaggagcccagccctgggattttcaggtgttttcatttggtgatcaggactgaacagagagaactcaccatggagtttgggctgacctggctttttcttgtggctattttaaaagtgtccagtgtgaggtgcagctggtggagtctgggggaggcttagtacagcctgggggtccctgagactctcctgcgcagcctctggattctcctttagtagttatgccatgacttgggtccgccaggctccgagggaaggggctgggagtgggtctcaggcattggtggtagtggtgccaggacacattacgtaaagtccctgcagggccgattctttatctccagagacaattccaggaacatactgattctgcagttgaccagactgagagtcgaggacacggccgtatattattgtgttaaatgggatggtggctacgactcttggggccgggaacctggtcaccgtctcttcagcttccaccaagggcccatcggtcttccccctggcgccctgctccaggagcacctctggggcacagcggccctgggctgcctggtcaaggactacttcctacgtgagctctgagcgggctggcaaggcgcata

SEQ ID NO: 296393 - DNA, 353 bp, Homo sapiens
  misc_feature: NA.47.78.H01.4.454.heavy.1.nb
agccccagccttgggattcccaagtgttttcattcagtgatcaggactgaacacagaggactcaccatggagtttgggctgagctggattttcctcggtgctcttttaaaaggtgtccagtgtggggtgcacctgatggagtcgtgggggaggcctcataaagccgggggggtcccttaaactctcctgcgcagcgtctggatttcctttcagtcaagtctggataagctgggtccgccaggctccagggatgggcctggagtgggttggccgtgtcaagagcagaactgatggtgcgacatctgaatacgctgcacccgtgaaaggcagattcaccatctccagagatgatt

SEQ ID NO: 296394 - DNA, 223 bp, Homo sapiens
  misc_feature: NA.47.83.H06.2.454.heavy.1.nb
  modified_base (219)..(219): a, c, t, g, unknown or other
  misc_feature (219)..(219): n is a, c, g, or t
accacattcctcctctgaagaagcccctgggagcacagctcatcaccatggactggacctggaggttcctctttgtggtggcagcagctacaggtgtccagtccctggtgcagctggagcagtcgtggggctgaggtgaagaagccgtgggtcctcggtgaaggtctccgtgcgacggcccctgcagacaccttcagcacctataccttcagctgggtncgac

SEQ ID NO: 296395 - DNA, 122 bp, Homo sapiens
  misc_feature: NA.47.85.H08.3.454.heavy.1.nb
  modified_base (88)..(88): a, c, t, g, unknown or other
  misc_feature (88)..(88): n is a, c, g, or t
tcttcagtgactacgacatgcactgggtccgccaagttgcaggagaacctctggaatgggtctccgttattgctactggtggtgccanagactatgcaggctccggtagggacgggaccgta

SEQ ID NO: 296396 - DNA, 359 bp, Homo sapiens
  misc_feature: NA.47.87.H10.1.454.heavy.1.nb
agtggctgggaaggacatactacaggtccgactggaaaagtgattatgcagaatctatgcagagccgcataaccatcactgcagacacatccaggaaccagttctccctacaactgaactctgtgactcccgaggacacggctatatattactgtgtaagagtccgtcacctgggactagggttttacctccgtggggccagggaaccctggtctccgtctcctcagcctccaccaagggcccatcggtcttcccctggcgccctgctccaggagcacctccgagagcacagcggccctgggctgcctggtcaaggactacttcctacgtgagctctgagcgggctggcaaggcgcata

SEQ ID NO: 296397 - DNA, 101 bp, Homo sapiens
  misc_feature: NA.48.12.B01.2.454.heavy.1.nb
catcactatttgtccagtggaatctgggagccagagtagcaggaaggaagagaagctgcgctggggcttccatggttccgtctgggtcctaactgagcagt

SEQ ID NO: 296398 - DNA, 100 bp, Homo sapiens
  misc_feature: NA.48.12.B01.3.454.heavy.1.nb
tcgatttagtagtgtagattccgcgggcacgaccggtgctcgatttagctctacgctcgagggcacgaccggtgctcgatttagtagcatactggttggg

SEQ ID NO: 296399 - DNA, 79 bp, Homo sapiens
  misc_feature: NA.48.14.B03.2.454.heavy.1.nb
tatgcgccttgccagcccgctcagatacctaaaaacccccaaacccaatacgtgagctctaaatcgagcaccggtcgtg

SEQ ID NO: 296400 - DNA, 49 bp, Homo sapiens
  misc_feature: NA.48.14.B03.3.454.heavy.1.nb
tcgatttagtgtgagtagttccgcgggcacgaccggtgctcgatttagt

SEQ ID NO: 296401 - DNA, 234 bp, Homo sapiens
  misc_feature: NA.48.24.C02.1.454.heavy.1.nb
aggagcccagccctgggattctcaggtgttttcatttggtgatcaggactgaacagagagaactcaccatggagtttgggctgagcgtgtcttttctggtggctattttaaaaggtgtcagtgtgaggtgcacctgttggagtctgggggaggcttggtacagccgtggggggtccctgagactctcctgtgcagcctctggattcacctttagcagctatgccatgagctggg

SEQ ID NO: 296402 - DNA, 458 bp, Homo sapiens
  misc_feature: NA.48.34.D01.1.454.heavy.1.nb
agactgacggtcctgccacaggaggtgtggtccagcctgggaagtccctgacactgtcctgcgcagcctctggattcaccttcaccacctttcgtatgcactttgtccgccaggctccaggcaaggggctggagtgggtggctgttgtgtcaaatgatggacatgctgaatatgcagactccgtgaggggccgattcgccttctccagagacaattccaagagcacggttcatctgcaaatgagcgccctgagacctgacgacacggctgtctattactgtgcgagagggcgtccgagtttaacacgccgtcgggagggatattactttgacaactggggccagggaaccctggtcaccgtctcctcagcctccaccaagggcccatcggtcttcccctggcgccctgctccaggagcacctccgagagcacagcggccctgggctgcctggtcaagg

SEQ ID NO: 296403 - DNA, 375 bp, Homo sapiens
  misc_feature: NA.48.4.A04.1.454.heavy.1.nb
atggacctcctgcacaagaacatgagacacctgtggttcttcctcctcctggtggcagttcccagatgggtcctgtctcaggtgcagttacagcagtggggcgcaggactgttgaagccttcggagaccctgtccctcacctgcgctgtggctggtgagtccttcagtgcttatcactggacctggatccgccagtccccagcgaagggcctggagtggattggggaaatcaatcatggtggatacaccaactacaacccgtccctcaagagccgagtcaccatcttagtggacacggcgaagaaccagttctccctagaaactgaccgctgtcgaccgccgcggacacggctgtgtattactgtgcgagacgaa

SEQ ID NO: 296404 - DNA, 111 bp, Homo sapiens
  misc_feature: NA.48.41.D08.1.454.heavy.1.nb
ccatctccagagacaacgccaagcactcactgtatctccaaatgaacagcctgagagccgacgacacggctgtgtattactgtgcgagacttgggagagagtgggacctac

SEQ ID NO: 296405 - DNA, 585 bp, Homo sapiens
  misc_feature: NA.48.59.F04.1.454.heavy.1.nb
gagagtcatggatctcatgtgcaagaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccagcccccagggaaggggctggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatgtggggccaagggacaatggtcaccgtctcttcagcctccaccaagggcccatcggtcttccccctggcaccctcctccaagagccacctctcgggggcacagcggccctgggctgcctggtcaaggactacttcctatgtatactctgagcgggctggcaaggcgcata

SEQ ID NO: 296406 - DNA, 296 bp, Homo sapiens
  misc_feature: NA.48.65.F10.2.454.heavy.1.nb
atggacctcctgcacaagaacatgaaacacctgtggttcttcctcctcctggtggcagctcccagatgggtcctgtcccaggtgcagctacagcagtggggcgcaggactgttgaagccttcggagaccctgtccctcacctgcgctttctatggtgggtccttcagtggttactactggagctggatccgccagcccccagggaagggctggagtggattggggaaatcaatcatagtggaagcaccaactacaacccgtcctcaggagtcgagtcaccatatcagtagacacgt

SEQ ID NO: 296407 - DNA, 59 bp, Homo sapiens
  misc_feature: NA.48.66.F11.1.454.heavy.1.nb
gacgtgtttctgttcccacctcctctatgtatactctgagcgggctggcaaggcgcata

SEQ ID NO: 296408 - DNA, 454 bp, Homo sapiens
  misc_feature: NA.48.73.G07.1.454.heavy.1.nb
tttagtcacgcgagaaagggaaagggggctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcactgtctctggtgctccatcagcagcagtacttacttctggggctggatccgccacgcccccgagggaaggggctgggagtggattgggagtatttaccacagtgggagcacctactacaacccgtccctcaaaagtcgaggcaccatatccgtagacacgtccaagaaccaattctccctgaagctgagctctgtgaccgccgcagacacggctgtctattactgtgcgaggccccgagcgcagtggctttttgatgcctttgatatg

SEQ ID NO: 296409 - DNA, 124 bp, Homo sapiens
  misc_feature: NA.48.73.G07.4.454.heavy.1.nb
tatgcgccttgccagcccgctcagagtatacatatcagatggcgggaagatgaagacagatggtgcagccacagttcgtttgacttccaccttggtcccaaacccaactatcgtgtgctaaatc

SEQ ID NO: 296410 - DNA, 376 bp, Homo sapiens
  misc_feature: NA.48.79.H02.1.454.heavy.1.nb
acaaccacattcctcctctaaagaagcccctgggagcacagctcatcaccatggactggacctggaggttcctctttgtggtggcagcagctacaggtgtccagtcccaggtgcagctggtgcagtctggggctgaggtgaagaagcctgggtcctcggtgaaggtctcctgcaaggcttcgtggaggcaccttcagcagctatgctatcagctgggtgcgacgacggcccctggacaagggcttggagtggatgggaggatcatccctatctttggtatagcaaactacgcacagaagttccagggcagagtcacgattaccgcggacaaatccacgagcacagcctacatggagctgagcagcctgagatctga

SEQ ID NO: 296411 - DNA, 406 bp, Homo sapiens
  misc_feature: NA.48.9.A09.1.454.heavy.1.nb
gtggttctcggggctgccctttggctttctgagagtcatggatcacatgtgcaagaaaatgaagcacctgtggttcttcctcctgctggtggcggctcccagatgggtcctgtcccaggtgcagctgcaggagtcgggcccaggactggtgaagccttcggagaccctgtcccctcacgtgcactgtctctggtgactccatcaacaatagtcattactactggggctggatccgccagtccccagggagggctggagtggattggaattatctattatagcgggagcacctactataatccgtccctcaagagtcgagtcaccatatccgtagacacatccaagaaccagttctccctgaggctgagccctgtcgaccgccgcagacacggctgtctattactgt

SEQ ID NO: 296412 - DNA, 345 bp, Homo sapiens
  misc_feature: NA.48.9.A09.2.454.heavy.1.nb
accacatctgtcctctagagaatcccctgagagctccgttcctcaccatggactggacctggaggatcctcttcttggtggcagcagccgcaggagcccactgccaggtgcacgtggggcagtctggggctgaagtgaagaggcctggggcctcagtgaaggtctcctgcaaggcctctggttagaccttcaccgccgactccagactctggcttccaccaagggcccatcggtcttccccctggcgccctgctccaggagcacctctgggggcacagcggccctgggctgcctggtcaaggactacttcctatgtatactctgagcgggctggcaaggcgcata

SEQ ID NO: 296413 - DNA, 38 bp, Homo sapiens
  misc_feature: NA.49.15.B04.1.454.heavy.1.nb
tcgagctctctcgcgggcacgaccggtgctcgatttag

SEQ ID NO: 296414 - DNA, 327 bp, Homo sapiens
  misc_feature: NA.49.26.C04.2.454.heavy.1.nb
gctgagctgggttttccttgttgctattttaaaaggtgtccagtgtgaagtgcagttggtggaatcgtgggggagtcgtggtagagccgtggggggtccctgagactctcctgtgcagcctctggattcatctttgatgattatgccatgcactggatccgtcaagctccggggaaggtctggagtgggtctctcttattaattgggatggtgtatcacctactatgcagactctgtgaagggtcgattcaccatctccagagacaacagcagaaactccctgtactctgacaaatgaacagtctcagaggtgaggacaccgccttc

SEQ ID NO: 296415 - DNA, 109 bp, Homo sapiens
  misc_feature: NA.49.33.C11.2.454.heavy.1.nb
tatgcgccttgccagcccgctcagagtcgagagaggaagtagtccttgaccaggcagcccagggccgctgtgcccagcacctgaactcctgggggaccgtcagtcttcc

SEQ ID NO: 296416 - DNA, 106 bp, Homo sapiens
  misc_feature: NA.49.34.D01.1.454.heavy.1.nb
tatgcgccttgccagcccgctcagagtcgagagaggaagtagtccttgaccaggcagcccagggccgctgtgcccagcacctgaactcctgggggaccgtcagtct

SEQ ID NO: 296417 - DNA, 372 bp, Homo sapiens
  misc_feature: NA.49.35.D02.2.454.heavy.1.nb
taacaaccagattcctcctctaaagaagcccctgggagcacagctcatcaccatggactggacctggaggttcctctttgtggtggcagcagctacaggtgcccagtcccgggtccagctggtgcaatctggggctgaggtgagaaagcctgggtcgtcggtgaaggtctcctgcaaggcttctggagacaccttcaacaactttgctgtcagctgggtgcgacaggcccctggacaaggccttgagtgggtgggaaggatcgacccctatccttaatatagcaaactatgcacagacattccacgacagagtcacccttatcgcgacaaatccacgaacacagcctacatggaactgcgcagcctaggatc

SEQ ID NO: 296418 - DNA, 106 bp, Homo sapiens; identical to SEQ ID NO: 296416
  misc_feature: NA.49.35.D02.3.454.heavy.1.nb

SEQ ID NO: 296419 - DNA, 291 bp, Homo sapiens
  misc_feature: NA.49.38.D05.1.454.heavy.1.nb
cagcactggaagtcgccggtgtttccattcggtgatcatcactgaacacagaggactcaccatggagtttgggctgagctgggttttcctcgttgctcttttaagaggtgtccagtgtcatgtgcagttgatacagtcgtgggggagcgtggtccagcctgggaggtccctgagactctcctgtgcagcctctggattcgtctctagtgtctaccctatgcactgggtccgccaggctccaggcaaggggctgggaatggggtggctacttatctcatctgatggaagtct

SEQ ID NO: 296420 - DNA, 329 bp, Homo sapiens
  misc_feature: NA.49.42.D09.1.454.heavy.1.nb
gagaggagccttagccctggattccaaggcctatccacttggtgatcagcactgagcaccgaggattcaccatggaactggggctccgctgggttttccttgttgctattttagaaggtgtcccttgtcaagtgcagctggtggagtcgtgggggaaaggtggtcgaaggccgggggggtccctgagactctcctgtgcagcctctggattcaccttccgttcctataccatgaactggatccgccaggctccgagggaggcgactggagtgggtctcatctattagtggtagaggtgattactacaactacgcagactcactggaggg

SEQ ID NO: 296421 - DNA, 398 bp, Homo sapiens
  misc_feature: NA.49.5.A05.1.454.heavy.1.nb
cagcactggaagtcgccggtgtttccattcggtgatcatcactgaacacagaggactcaccatggagtttgggctgagctgggttttcctcgttgctcttttaagaggtgtccagtgtcaggtgcagctggtggagtcggggggaggcgtggtccagcctgggacgtccctgagactctcctgtgcagcctctggatttacattcagtagttatgctatgcactggtttcgccagggtccaggcaaggggctgggagtgggtggcagttatatcgtatgataggaaacgaaaatactacgcagactccgtgaagggccgattcaccatctcccgacacaattccaagaacacattgtttctactgctgaacagcctgagaagtgacgacacggctgta

SEQ ID NO: 296422 - DNA, 221 bp, Homo sapiens
  misc_feature: NA.49.53.E09.3.454.heavy.1.nb
taacaaccagattcctcctctaaagaagcccctgggagcacagctcatcaccatggactggacctggaggttcctctttgtggtggcagcagctacaggtgcccagtcccgggtccagctggtgcaatctgggctgaggtgagaaagcctgggtcgtcggtgaggtctcctgcaaggcttcgtggacgacaccttacaactaactttgctgtcagctgggt

SEQ ID NO: 296423 - DNA, 108 bp, Homo sapiens
  misc_feature: NA.49.53.E09.4.454.heavy.1.nb
tatgcgccttgccagcccgctcagagtcgagagaggaagtagtccttgaccaggcagcccagggccgctgtgcccagcacctgaactcctgggggaccgtcagtcttc

SEQ ID NO: 296424 - DNA, 295 bp, Homo sapiens
  misc_feature: NA.49.6.A06.2.454.heavy.1.nb
  modified_base (270)..(270): a, c, t, g, unknown or other
  misc_feature (270)..(270): n is a, c, g, or t
gtggctattttaaaaggtgtccagtgtgaggtgcagctggtggactcgtgggggaggtcgttggtacagccgtggggggtccctgagactctcctgtgcagcctctggattcacctttagctagtttgccatgggctgggtccgccaggctccgagggaaggggctggagtgggtctcaactattagcggtattggtactaccacatactacgcagactccgtgaagggccgcttcaccatctccagagacaattccaaagaacatggtntttctgacaaatgagcagcctgaga

SEQ ID NO: 296425 - DNA, 35 bp, Homo sapiens
  misc_feature: NA.49.73.G07.1.454.heavy.1.nb
gctctacgctcagggcacgaccggtgctcgattta

SEQ ID NO: 296426 - DNA, 52 bp, Homo sapiens
  misc_feature: NA.49.82.H05.8.454.heavy.1.nb
tatgcgccttgccagcccgctcagagtcgagagagagagctcgactaaatcg

SEQ ID NO: 296427 - DNA, 106 bp, Homo sapiens; identical to SEQ ID NO: 296416
  misc_feature: NA.49.87.H10.1.454.heavy.1.nb

SEQ ID NO: 296428 - DNA, 126 bp, Homo sapiens
  misc_feature: NA.4.11.A11.1.454.heavy.1.nb
tcagtacgtttgatatcaattgggtgcgacaggcccctggacaagggcttgagtggatgggaaggatccacccctaccctgcctatggacaaacaatgcacagaagttccagggcagactcacaat

SEQ ID NO: 296429 - DNA, 420 bp, Homo sapiens
  misc_feature: NA.4.18.B07.1.454.heavy.1.nb
accacatctgtcctctagagaatcccctgagagctccgttcctcaccatggactggacctggaggatcctcttcttggtggcagcagcctcaggagcccactcccaggtacagttggtgcagtctggggctgaggtgaagaagcctggggcctcagtgaaggtctcctgcaaggcttctggatacaccttcaccggctactatatccactgggtgcgacaggcccctggacaagggcttgagtggatgggacggatcaaccctaacaccggtggcacaaacaacgcacagaagtttcagggcagggtcaccatgaccagggacacgtccttcagcacagcctactggaggtgagcaggctgagatctgacgacacggccgtgtattactgtgcgagagaggaagacttggagtcggatac

SEQ ID NO: 296430 - DNA, 337 bp, Homo sapiens
  misc_feature: NA.4.27.C05.1.454.heavy.1.nb
agcccagcactgggattccgaggtgtttccattcggtgatcagcactgaacagagaggactcaccatggagttttggctgagctgggttttccttgttgctactttaagaggagtccactgtggggtacagctgctggagtctggaggaggcatgatccagccgtggggggtccctgagactctcctgtgcagcctctgggttcaccgtcacttacagccacatgagttgggtccgccaggctccgagggaaggggctgggagtgggtctcgaggttctcataacgatggtactacatcgtactcagactccgtgaagggccgattcaccatcctcc

SEQ ID NO: 296431 - DNA, 343 bp, Homo sapiens
  misc_feature: NA.4.29.C07.1.454.heavy.1.nb
gagtccagccctgggattttcaggtgtcttcatttggtgatcaggactgaacagagagaactcaccatggagtttgggctgaactggctttttcttgtggctattttaaaagctgtccagtgtgaggtgcagctgttggagtcgtgggggaggcttggtccaggcggggggggtccctgagactctcctgttctgcctctggattcacctttatgaattttgccatgagctgggtccgccagactccacggaaggggctggagtgggtctcaagtcttagtgctagtggtggtcacacatactacgcagactccgtgaagggccggttcaccatctccagaga

SEQ ID NO: 296432 - DNA, 103 bp, Homo sapiens
  misc_feature: NA.4.34.D01.3.454.heavy.1.nb
tatgcgccttgccagcccgctcagagcactgtaggaggagggcgggaacagagtgaccgagggggcagccttgggctgacttaggacggtcagtttggtccct

SEQ ID NO: 296433 - DNA, 606 bp, Homo sapiens
  misc_feature: NA.4.38.D05.1.454.heavy.1.nb
ctcactgcccagctgggatctcagggcttcattttctgtcctccaccatcatggggtcaaccgccatcctcgccctcctcctggctgttctccaaggagtctgtgccgaggtgcagctggtgcagtctggagcagaggtgaaaaagcccggggagtctctgaagatctcctgtaagggttctggatacatctttaggacctactggatcggctgggtgcgccaggtgcccgggaaaggcctggaatggatggggatcatctatcctgatgactctgataccagatacagtccgtccttcgaaggccgcgtcaccttctcagccgacaagtccatcagcaccgcctacctgcagtggagcagcctgaaggcctcggacagcgccatatattactgtgacgaaaaccagtagcagctcaccccgtaaggactttgactactggggccagggaaccctggtcactgtctcctcagcctccaccaagggcccatcggtcttccccctggccaccctcctccaagagcacctctgggggcacagcggccctgggctgcctggtcaaggactacttccctacagtgctctgagcgggctggcaaggcgcata

SEQ ID NO: 296434 - DNA, 334 bp, Homo sapiens
  misc_feature: NA.4.60.F05.1.454.heavy.1.nb
aggagcccagccctgggtattttcaggttgttttcatttggtgatcaggactgaacagagagaactcaccatggagtttgggctgagctggtcgttttctggtggctatttaaaggtgtccagtgtgaggtgcagctgctggagtcgtgggggagcttggtacagccgtggggggtccctgagactctcctgtgcagcctctggattcacgtttagcaccaatgccctgagttgggtccgccaggctccgagggaaggggctggagtgggtcgcaggcatcagtggtagtggaaatgatttaagacagactacgcagactctgtgagggccgac

SEQ ID NO: 296435 - DNA, 321 bp, Homo sapiens
  misc_feature: NA.4.72.G06.1.454.heavy.1.nb
cagtacgtttgatatcaattgggtgcgacaggcccctggacaagggcttgagtggatgggaaggatcacccctaccctgcctatggcaaacaatgcacagaagttccagggcagactcacaattaccgcggacaagtccaagcgcacagcgtacatggaactgaggagcctgagatctgaagacacggccgtttattactgtgcgagacagtccgggggctcggatattgaactaatggaaaaagttccgggtccgctaaacaacaggttcgagtcctggggccagggaaccctggtcaccgtctcctcagcctccaccaa

SEQ ID NO: 296436 - DNA, 380 bp, Homo sapiens
  misc_feature: NA.4.78.H01.1.454.heavy.1.nb
gtcaggcagtccccatcgagaggccttgagtggctgggacggacttatttccggtccaagtggatttttgattatgccgcatctctgagaggtcgaataagcatcaacccagacacaaccaagaaccagttttcgctgcagttgaagtctgtgacccccagagacacggctctctatttctgtgtgagagcctcctcttccgcgtatgactactggggccagggaaccctggtcaccgtctcctcagcctccaccaagggcccatccggtcttccccctggccgccctgctccaggacgcacctccgagagcacagcggccctgggctgcctggtcaaggctacttccctacagtgctctgagcgggctggcaaggcgca

SEQ ID NO: 296437 - DNA, 175 bp, Homo sapiens
  misc_feature: NA.51.11.A11.1.454.heavy.1.nb
tatgcgccttgccagcccgctcagagtgctacgaggaagtagtccttgaccaggcagcccagggccgctgtgcccccagaggtgctcttggaggagggtgccagggggaagaccgatgggcccttggtggaggctgaggagacggtgaccgtggaactcaggcgccctgaccagc

SEQ ID NO: 296438 - DNA, 377 bp, Homo sapiens
  misc_feature: NA.51.12.B01.1.454.heavy.1.nb
cagcaaccacatctgtcctctagagaaccccctgagagccccgctcctcaccatggactggacctggaggatcctcttcttggtggcagcagccacaagagcccactcccaggtgcaggtggtgcagtctggggctgaggtgaagaagcccggggcctcagtgaaggtctcctgcaagacctctggctacaccttcagtggcaacaacgtccactgggtgcgccaggcccctggacaagggcttgagtggatgggatggtttagtctgagaactggtgccgcaaattatgcacaggagtttcggggcagggtcatcatgaccgggacacgtccatcgccacaacttacatggaactgaccagtctgacattgacgac

SEQ ID NO: 296439 - DNA, 106 bp, Homo sapiens
  misc_feature: NA.51.21.B10.1.454.heavy.1.nb
ggcgtgtgtcagctcataggaggcctcagagcctgtgcagagagtgaggagggggagaagtagagggatccaggccatggtgagacacccagagttctgcctcctg

SEQ ID NO: 296440 - DNA, 378 bp, Homo sapiens
  misc_feature: NA.51.36.D03.1.454.heavy.1.nb
tgagagtcgtggatctcatgtgcaagaaaatgaagcacctgtggttcttcctcctcctggtggcggctcccagatgggtcctgtcccagttgcacctgcaggagtcgggcccaggacttgtgaagccttcggagacactgtccctcacctgctctgtctctggcggctccatcagtagtagatattactactggggctggatccggcacggccccccgggaagggctggattggattggcagtatcagttatactgggacctaccttcttcaagtcgtcgctcaagagtcgagtcaccatgaccgcggacacgtccaaggaccagttctccctgaacgctgacctctgtcgaccgccgcagacacggctttgtatttc

SEQ ID NO: 296441 - DNA, 424 bp, Homo sapiens
  misc_feature: NA.51.5.A05.1.454.heavy.1.nb
catggacctcctgcacaagaacatgaaacacctgtggttcttcctcctcctggtggcagctcccagatgggtcctgtcccaggtgcagctacggcagtggggcgcaggactgttgaagccctcggagaccctgtccctcagctgcgctgtatatcgtgggtccttcagtggttactactggagctggatccgccagtccccagggaagggctggagtggatagggcgaatcaatcatagtggagacaccgactacaacccgtccctcatgagtcgagtcaccatgtcagtggactcgtccaagacctccaccaagggcccatcggtcttccccctggccaccctcctccaacgagcacctctggggcacagcggccctgggctgcctggtcaaggactacttcctcgtagcactctgagcgggc

SEQ ID NO: 296442 - DNA, 50 bp, Homo sapiens
  misc_feature: NA.51.68.G02.1.454.heavy.1.nb
tatgcgccttgccagcccgctcagagtgctacgagaggagggtgggaaag

SEQ ID NO: 296443 - DNA, 93 bp, Homo sapiens
  misc_feature: NA.51.86.H09.1.454.heavy.1.nb
tcacaagatttgggctctgggcacagcggccctgggctgcctggtcaaggactacttcctcgtagcactctgagcgggctggcaaggcgcata

SEQ ID NO: 296444 - DNA, 126 bp, Homo sapiens
  misc_feature: NA.52.14.B03.3.454.heavy.1.nb
tatgcgccttgccagcccgctcagcgatcgtataggaagtagtccttgaccaggcagcccagggccgctgtgcccccagaggtgctcttggaggagggtgccagggggaagaccgatgggcccttg

SEQ ID NO: 296445 - DNA, 323 bp, Homo sapiens
  misc_feature: NA.52.39.D06.1.454.heavy.1.nb
tctgagagtcatggacctcctgtgcaagaacatgaagcacctgtggttcttcctcctgctggtggcggctcccagatgggtcctgtcccagctgcagctgcaggagtcgggcccaggactggtgaagccttcggagaccctgcccctcacctgcattgtgtctggtgctccatcagcagtggtacttttactacagttggagtcgccagcccccagggaagggactagagtggattgggagtgttcatcataatgggaggaccttctacagcccgtcctcaagagccgagtcaccatatcaatgacacgtccaggaaccacct

SEQ ID NO: 296446 - DNA, 379 bp, Homo sapiens
  misc_feature: NA.52.53.E09.1.454.heavy.1.nb
gtaaagcgggggggtatctgagactctcctgttcagtctctggattcaccttaaataactatggcatgagctgggtccgccaggctccagggaaggggctggagtgggtctcatttatcagtggtactggtggtagcacatactacgcagactccgtgaagggccgttcaccatctccaaaagacaattccaagaacacgctgtatttacaaatgaacagcctgagagccgaggacacggccgtatattactgtgtgaaagatctccacgtctcgcccccttggactggttatttcgactcctggggccagggaaccctagtagccgtctcctcagcctccaccaaggcccatcggtcttccccctggcaccctcctcc

SEQ ID NO: 296447 - DNA, 404 bp, Homo sapiens
  misc_feature: NA.52.67.G01.1.454.heavy.1.nb
accacatccctcctcagaagcccccagagcacaacgcctcaccatggactggacctggaggatcctctttttggtggcagcagccacaggtggccactcccaggtccagcttgtgcagtctggggctgaggtgaagaagcctggggcctcgagtgaaggtttcctgcaaggcctctggatacaccttcagtgacaatactttgcattgggtgcgccaggcccccggacaagggcttgtttggatgggatggatcaacgctggcaatggtaacacaaaatattcacagaagttccagggcagagtcacatcaccagggacacatccgcgagcacagcctacatggagttgagcagcctgagaaatgaagacacggctagtatattactgtgcgagagggaaatgg

SEQ ID NO: 296448 - DNA, 282 bp, Homo sapiens
  misc_feature: NA.52.74.G08.1.454.heavy.1.nb
atggacctcccgcgcaagaacatgaagcacctgtggtttttcctcctgctggtgacagctcccagaggggtcctgtcccaggtgcagctccaggagtcgggccccggactaatgaagccctcggagaccctctcactcacctgcaatgtctctggatattcaattgggagtggttattattgggcctggatccggcacgcccccgggaagggctggagtggatcggcagcatccatcatagtggagacaataatcacaatccgtccctcagaggacgagtca

SEQ ID NO: 296449 - DNA, 353 bp, Homo sapiens
  misc_feature: NA.52.77.G11.1.454.heavy.1.nb
  modified_base (237)..(237): a, c, t, g, unknown or other
  misc_feature (237)..(237): n is a, c, g, or t
gagcccagcactagaagtcggcggtgtttccattcggtgatcagcactgaacacagaggactcaccatggagtttgggctgagctgggttttcctcgttgctcttttaagaggtgtccagtgtcaggtgcagctggtggagtcgtgggggagcgtggtccagcctgggaggtccctgagactctcctgtgcagcctctggattcaccttcagtgtctatgacatgcacgtgggtccnccaggctccaggcaaggggctggagtgggtggcagttatatcatatgatggaagtaagatatactatgcagactcgtgaggccgattcacattccagagacaactccaagacacgc

SEQ ID NO: 296450 - DNA, 336 bp, Homo sapiens
  misc_feature: NA.52.78.H01.2.454.heavy.1.nb
ttggtccagcctggggggtccctgacactctcctgtgtagcctctggattcacctttaacagttattggatgacttgggtccgccaggctccagggaaggggctggagtgggtggccagcgtgaagcatgatggaggtgaggaagactatgcggactctgtgaagggccgattcaccacttccagagacaacatcaagaactcaatgtatctccaaatgagcagcctgacatccgaggacacggccgtgtattactgtgcgagagttctttgggatgttgtcgttgcaccagctgccctaccggctgctacttcgatctctggggccgtggcaccc

SEQ ID NO: 296451 - DNA, 472 bp, Homo sapiens
  misc_feature: NA.52.81.H04.1.454.heavy.1.nb
  modified_base (412)..(412): a, c, t, g, unknown or other
  misc_feature (412)..(412): n is a, c, g, or t
agaggagcccagccctgggattttcaggtgttttcatttggtgatcaggactgaacagagagaactcaccatggagtttgggctgagcgtggtcttttctgtggctattttaaaaggtgtccagtgtgaggtgcagctgctgcaggtcggggggagcttggtacagccgtggggggtccctgagactctcctgtgcagcctctggattcacctttcgcgtctatgacatgagctgggtccgccaggctccaggaatggggctgggagtgggtctcgaggtattaatagtggtggaagtacatattacgcagactccgtgaagggccgcttcaccatctccagagacaattccaagaacacactgtatctgcaaatgaacagcctgagagccgaggacacggccacctattcngtacgaaagaatacacacagctggacgaggagccaaacggcgactacttctttgactact

SEQ ID NO: 296452 - DNA, 376 bp, Homo sapiens
  misc_feature: NA.53.33.C11.1.454.heavy.1.nb
gttttcctcgttgctcttttaagaggtgtccagtgtcacgtgcagctggtgcagtcgtgggggaggcgtggtccagcctgggaggtccctgaaactctcctgtgcagcctctggattcgtctcaagtgtctaccctttgcactgggtccgccaggctccaggcaaggggctggagtgggtggcacttatctcatctgatggaagagatgcctattacgcagactccgtgaagggccgattcaccatctccagagacaattccaagaacacactgtatctgcaaatggacagcctgagagctagaagacacggctgtgtattactgtgcgagtgagatgtcttactatgatgcagtggtttggtaccgttcgacccg

SEQ ID NO: 296453 - DNA, 378 bp, Homo sapiens
  misc_feature: NA.53.73.G07.1.454.heavy.1.nb
ctacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggaggtgagcagcctgagatcgtagaggaca

SEQ ID NO: 296454 - DNA, 106 bp, Homo sapiens
  misc_feature: NA.53.9.A09.1.454.heavy.1.nb
atttacgctctacgctcaggcacgaccggtgctcgatttagctctacgctcaggcacgaccggtgctcgatttagcagacgtctgagcgggctggcaaggcgcata

SEQ ID NO: 296455 - DNA, 351 bp, Homo sapiens
  misc_feature: NA.5.20.B09.1.454.heavy.1.nb
  modified_base (274)..(274): a, c, t, g, unknown or other
  misc_feature (274)..(274): n is a, c, g, or t
ggggaggcttggtacagcctggcaggtccctgagactctcctgtgcagcctctggattcacctttgatgattatgccatgcactgggtccggcaagctccagggaagggcctggagtgggtctcaggtattacttggaatagtggtgacataggctatgcggactcgtgaagggccgcttcaccatctccagagacaacgccaagaactccctgtatctacaaatgaacagtctgagagttgaggacacggccttctattactgtgacaaaagntcgggacgaagtggtggtggctgcaatcgactacgtgggcctgggaaccctggtcaccgtctcctcacgcctccacc

SEQ ID NO: 296456 - DNA, 624 bp, Homo sapiens
  misc_feature: NA.5.23.C01.1.454.heavy.1.nb
gtgctcgatttagtacacgtgattagggattggggatactttctgagactcatggacctcctgcacaagaacatgaaacacctgtggttcctcctcctcctggtggcagctcccagatgggccctgtctcaggtgcagctgcaggagtcgggcccaggactggtgaagccttcggggaccctgtccctcacctgcgatgtttctcgtggctccatcagcactattaattggtggacctgggtccgccagcccccaggaaagaggctggagtggattggggagatctatcataccgggagcaccaactacaatccgtccctcaagagtcgagtcaccatatctatagacacgtcgaacaaccagttctccctgaaggtgacctctgtgaccgccgcggacacggccgtctattactgtgcgcggatttcagagggacaggactactatatcgacgtctggggcagagggaccacggtcatcgtctcctcagcctccaccaagggcccatcggtcttccccctggcaccctcctccaagacgcacctctgggggcacagcggccctgggctgcctggtcaaggactacttcccgtgtctgatctgagcgggctggcaaggcgcata

SEQ ID NO: 296457 - DNA, 91 bp, Homo sapiens
  misc_feature: NA.5.25.C03.1.454.heavy.1.nb
tatgcgccttgccagcccgctcagatagagtactggaagtagtccttgaccaggcagcccagggccgctgtggcaggaccgtcagtcttcc

SEQ ID NO: 296458 - DNA, 417 bp, Homo sapiens
  misc_feature: NA.5.27.C05.1.454.heavy.1.nb
gagcccagcactgggattccgaggtgtttccattcagtgatctgcactgaacacagaggactcgccatggagtttgggctgagctgggttttccttgttgcttattttaaaaggtgtccagtgtgaggtgcagttggtggagtcgtgggggaaccttggtccagccgtggggggtccctgagactctcctgtgtagcctctgcgttcaccgtcagtagcaattacatgagctgggtccgccaggctccgaggtaaggggctggagtgggtctcagttatttatagcgatggaaccgcacacttcgcagactccgcgaggggcagattcaccatctccagagacaattccaagaacaccctttatcttcagatgaacagcctgagagccgaggactcggctgtctattactgtgcgag

SEQ ID NO: 296459 - DNA, 277 bp, Homo sapiens
  misc_feature: NA.5.41.D08.1.454.heavy.1.nb
taacaaccagattcctcctctaaagaagcccctgggagcacagctcatcaccatggactggacctggaggttcctctttgtggtggcagcagctacaggtgtccagtcccaggtgcagctggtgcagtctggggctgccgtgaagagcctgggtcctcggtgacactctcctgcaaggcgtctggacgccaccttcaccaactatgcttcaactgggtgcgacgggccctgggcagggacttgagtggcgtggggcgatcgactcccgtacgttgat

SEQ ID NO: 296460 - DNA, 107 bp, Homo sapiens
  misc_feature: NA.5.55.E11.1.454.heavy.1.nb
tatgcgccttgccagcccgctcagatcagacacgggaagtagtccttgaccaggcagcccagggccgctgtgcccagcacctgaactcctgggggaccgtcagtctt

SEQ ID NO: 296461 - DNA, 357 bp, Homo sapiens
  misc_feature: NA.5.57.F02.2.454.heavy.1.nb
agactgacggtccccccaggagtccagagtgcgtcgcaagtattggcagtgtgaaatttgacaccttatatgcagactctgtgaggggccgcttcaccgtgtccagagacaactccaagaacgccgtctatttgcagatggacagcctgagagtcgacgacacgggcatctattattgtacggcgccgagcaatactctcttactttctggagtcagggagtcccggtcactgtctcctcagcctccaccaagggcccatcggtcttccccctggccaccctcctccaagacgcacctctggggcacagcgccctgggctgcctggtcaaggactacttcccgtgtctgatctgagc

SEQ ID NO: 296462 - DNA, 397 bp, Homo sapiens
  misc_feature: NA.5.64.F09.1.454.heavy.1.nb
cagattcctcctctaaagaagcccctgggagcacagctcatcaccatggactggacctggaggttcctctttgtggtggcagcagctacaggtgtccagtcccaggtgcaactggtgcagtctggggctgaggtgaagacgcctgggtcctcggtgaaggtctcctgcaaggcgtcgtgggggcaccgttcggcaagtttgccattacttgggtgcgacaggcccctggacaagggcttgagtggatgggagggatcgtccctgtctttggagcagcaaactacgcacatgatttccaggggagagtcacgattacggcggacgaatctacggccacagcctatctggagctgaacaacgtgagacctgaagacacggccgtttactactgcgcgag

SEQ ID NO: 296463 - DNA, 357 bp, Homo sapiens
  misc_feature: NA.5.70.G04.1.454.heavy.1.nb
tctcaggtattacttggaatagtggtgacataggctatgcggactctgtgaagggccgcttcaccatctccagagacaacgccaagaactccctgtatctacaaatgaacagtctgagagttgaggacacggccttctattactgtgcaaaaagatcgggacgaagtggtggtggctgcaatcgactactggggcctgggaaccctggtcaccgtctcctcagcctccaccaagggcccatcggtcttccccctggccaccctcctccaagagcacctctgggggcacagcggccctgggctgcctggtcaaggactacttcccgtgtctgatctgagcgggctggcaaggcgcata

SEQ ID NO: 296464 - DNA, 410 bp, Homo sapiens
  misc_feature: NA.5.73.G07.1.454.heavy.1.nb
cagccctgggattttcaggtgttttcatttggtgatcaggactgaacagagagaactcaccatggagtttgggctgagctggtctttttctgtggcttattttaaaaggtgtccattgtgaggtgcagttgttggagtcgtgggggaggcttagtacagccgtgggggtccctgagactctcctgtgcagcctctggattcacctttgacaactatgccatgagctgggtccgccaggctccgagggaaggggctgggagtgggtctcagttattcgtggtagtggtggtgccacatactacgcagactccgtaaagggccggttcgccatctccagagacaattccaaagaacacggtgtatctgcagatgaacagcctgagagccgaggacacggtccgtttatactg

SEQ ID NO: 296465 - DNA, 495 bp, Homo sapiens
  misc_feature: NA.5.86.H09.1.454.heavy.1.nb
atttagtgctatagacttgggtttgggatctacgttgcaggtgtaggtctgggtccctgagactctcctgtgcagcctctggattcacctttactgtattttggcatgacgtgggtccgccaggctccagggaaggggctggactggctctacaaatattaatggaaaaggcaatatacaagactacacagactccgtgaagggccggttcaccacctcgagagacaactccagggacacggtgtacctacacatgaacagcctgagagccgaggacacggccgtatattattgtgtgaggggaaactgggggcaagtttgaccgctggggccagggaaccctggtcaccgtctcctcagcctccaccaagggcccatcggtcttccccctggccgccctgcctccaggacgcacctccgagacgcacagcggccctgggcctgcctggtcaaggactactcccgtgtctgatcgtgagcgggctggcaaggcgc

SEQ ID NO: 296466 - DNA, 297 bp, Homo sapiens
  misc_feature: NA.6.43.D10.1.454.heavy.1.nb
atggacctcctgtgcaagaacatgaagcacctgtggtttttcctcctgctggtggcagctcccagatgggtcctgtcccaggtgcagctgcaggagtcgggcccaggactggtgaagcctttggagaccctgtccctctcctgcgttgtctctggttactctctcagagatggttattagttggggctggattcggcacggcccccgggaagggactggagtggattgcttttagttatcatactgggagcacccactaccaacccgtccctcaggagtcgagtcatcatatcagta

SEQ ID NO: 296467 - DNA, 383 bp, Homo sapiens
  misc_feature: NA.6.75.G09.1.454.heavy.1.nb
tagccctggactccaaggccttccacagaggactcaccatggaattggggctgagctgggttttccttgttgctattttagaaggtgtccaatgtgaggtgcaactggtggagtcgtggggggggcttagtccagcctggggactccctaagactctcctgtgcagcctctggattcatctttggcaagtcttggatgggctgggtccgccagattccgagggggccgctggagtgggtggccaacatcaacgacgatgcaaaggagacctactatttggactctgtgaggggccgttcaccatctccagagacaacgccgacaactcactgtctctgctgatgagcagtctgagagccgacgacacggctatctattactgt

SEQ ID NO: 296468 - DNA, 64 bp, Homo sapiens
  misc_feature: NA.7.5.A05.2.454.heavy.1.nb
gaggcaggcggctccttcggggaccgtcgtccacccaagtcggtccctgggtctctgctattcc

SEQ ID NO: 296469 - DNA, 366 bp, Homo sapiens
  misc_feature: NA.7.76.G10.1.454.heavy.1.nb
gtagtggttgtgcagagcctcatgcatcacggagcatgagaagacgttcccctgctgccacctgctcttgtccacggtgagcttgctgtagaggaagaaggagccggcgtggtccagcctgggaggtccctgagactctcctgtgcagcctctggattcaccttcacttcctatgatttccactgggtccgccagactccagacaaggggctggagtgggtggcagtcatatcaattgatggagccaataaaattttatgcggactccgtgaacggtcgattcaccatctccagagacaattccaggaacacactgttctgcaaatgaacagcctgagaattgaggactcgggtatatactactgt

SEQ ID NO: 296470 - DNA, 429 bp, Homo sapiens
  misc_feature: NA.7.78.H01.1.454.heavy.1.nb
accacacccctcctaagaagaagcccctagaccacagctccacaccatggactggacctggaggatcctcttcttggtggcagtagcaacaggtgcccactcccaggtgcagctggtacagtctgggtctgaattgaggaagcctggggcgtcagtgagcgttgcctgcaagccttctggatacatcttcactacttattctgtcaattgggtccgacaggcccctggacaaggccttgactacatgggatggatcaacaccgacactgggaaccccacctatgcccaggccttcacagggcggtttgtcttctccatggatacctctgtcgggacggcttatctgcagataaccaaccttcaacctgacgacactgccgttttattttgtacgagagtcgtcgtctgtcaggtgaattgactactggg

SEQ ID NO: 296471 - DNA, 368 bp, Homo sapiens
  misc_feature: NA.7.85.H08.1.454.heavy.1.nb
gtgccttagccctggattccaaggcatttccacttggtgatcagcactgaacacagaggactcaccatggagttggggctgtgctgggttttccttgttgctattttagaaggtgtccaatgtgaggtgcagctggtggagtctgggggaggcttggttcagcctggggggtccctgagactctcctgtgcagcctctggatttaccttcagtacttatggcatgaactgggtccgccaggctccagggaagggctgcagtgggtttcacacattaatactggaagtaggaccataacttacacagactctgtgaagggccgattcaccacctccagagacgacgccaagaactcactgtctctgcaa

SEQ ID NO: 296472 - DNA, 59 bp, Homo sapiens
  misc_feature: NA.8.10.A10.1.454.heavy.1.nb
aaaacccaaggacaccctcatgatctcccggacccctgaggtcacatgcgtggtggtgg

SEQ ID NO: 296473 - DNA, 113 bp, Homo sapiens
  misc_feature: NA.8.10.A10.2.454.heavy.1.nb
ggggggaagaggaagactgacggtccccccaggagttcaggcccctggacaagggcttgagtggattggatggatcagcgcttacaatggtaagacatacacaaactatgcac

SEQ ID NO: 296474 - DNA, 263 bp, Homo sapiens
  misc_feature: NA.8.19.B08.2.454.heavy.1.nb
cactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggcgtggtccagcctgggaggtccctgagactctcctgtgcaggctctggattcaccttcagtaactacggcgtgcactgggtccgccaggctccaggcaagggcttggagtggctggca

SEQ ID NO: 296475 - DNA, 151 bp, Homo sapiens
  misc_feature: NA.8.21.B10.1.454.heavy.1.nb
gtgatggtgacgctgtctcccaccagaagcagacagagaggagggaggactgggtcaactggatgtcacaactggcacctcggagccagagagcaggagccccaggagctgagcggggaccctcatgtccatgctgtgtcctgactgagac

SEQ ID NO: 296476 - DNA, 400 bp, Homo sapiens
  misc_feature: NA.8.25.C03.1.454.heavy.1.nb
gattcccaggagtttccacttggtgatcagcactgaacacagaccaccaaccatggagtttgggcttacctgggttttccttgttgctattttaaaaggtgtccagtgtgaggtgcagctggtggactcgtgggggaggcttggtacagccagggcggtccctgagactctcctgtacagggactggattcatctttggtgactatgctgtgacctgggtccgccaggctccagggaaggggctggagtgggtaagtctcattagaagtaaagcttatgggtgggacaacagattacgccgcgtctgtgaaaggcagattcaccatctcaagagatgattaccaaaagcatcgcctttctacaaatggacagcctagaaaaccgaggacacaggcgtgta

SEQ ID NO: 296477 - DNA, 108 bp, Homo sapiens
  misc_feature: NA.8.26.C04.2.454.heavy.1.nb
tatgcgccttgccagcccgctcagctcgcgtgtcggaagtagtccttgaccaggcagcccagggccgctgtgcccagcacctgaactcctgggggaccgtcagtcttc

SEQ ID NO: 296478 - DNA, 335 bp, Homo sapiens
  misc_feature: NA.8.27.C05.1.454.heavy.1.nb
agcccagcactagaagtcggcggtgtttccattcggtgatcagcagtgaactcagaggactcaccatggagtttgggctgacctgggctttcctcgtggctcttttaggaggtgtccagtgtcaagtgaagttggtggagtctgggggaggcgtggtccaggccgggggggtccctgagactctcctgtgaaggctctggattcgacttcgaaatggctggcatgcactgggtccgccaggctccaagcaaggggctgggagtgggtggcggtcatttctatgatgaagaaaatgagtatatgcaagcacgtgaagggccattcagcctctccag

SEQ ID NO: 296479 - DNA, 437 bp, Homo sapiens
  misc_feature: NA.8.33.C11.8.454.heavy.1.nb
gaggagcccagcactagaagtcggcggtgtttccattcggtgatcagcactgaacacagaggactcaccatggagtttgggctgaactgggttttcctcgttgctcttttaagaggtgtccagtgtcaagtgcaactggtggagtctgggggaggcgtagtccagcctgggaggtcacagagactctcctgtgcagcctctgggttcaccttcagtagctacggcatgcactgggtccgccaaactccaggcaagggattggagtgggtggcagttgtttcatctgagggcagtgttcaatggtatgctgacgccgtgaagggccgattcaccatctccagagacaactccaggaacacaatgtattggacctgaacagcctaagtcctgaggacacgggtgtatactactgtaacgaaggagggggaaccaggcgg

SEQ ID NO: 296480 - DNA, 319 bp, Homo sapiens
  misc_feature: NA.8.34.D01.2.454.heavy.1.nb
  modified_base (233)..(233): a, c, t, g, unknown or other
  misc_feature (233)..(233): n is a, c, g, or t
cagcactagaagtcggcggtgtttccattcggtgatcagcactgaacacagaggactcaccatggagtttgggctgaactgggttttcctcgttgctcttttaagaggtgtccagtgtcaagtgcaactggtggagtcgtgggggaggcgtggtccagcctgggaggtcacagagactctcgtgtgcagcctctgggttcaccttcagtaactacggcatgcacgtgggtccnccaagctccaggcaagggattggagtgggtgcagttgtttcatctgagggcagtgttcaatggtatgcagactccgtgaacgggcc

SEQ ID NO: 296481 - DNA, 342 bp, Homo sapiens
  misc_feature: NA.8.37.D04.1.454.heavy.1.nb
tgctggagggcacggtcaccacgctgctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtggactacaatcacggagcttttgaattttggggcc

SEQ ID NO: 296482 - DNA, 281 bp, Homo sapiens
  misc_feature: NA.8.38.D05.2.454.heavy.1.nb
gcccagcactagaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcactgggtccgccaggctccgaggcaaggggcttgggagtggctggcagttgttcatc

SEQ ID NO: 296483 - DNA, 354 bp, Homo sapiens
  misc_feature: NA.8.39.D06.2.454.heavy.1.nb
gaagaggaagactgacggtccccccaggagttcaggtgctcactcccaggtgcagctggtgcagtctggggctgagatgaagagtcctggggcctcagtgaagatttcctgcaaggcgtccggatacaggttcaccgccgtctatattaattggctgcgacaggcccctggacaagggcctgagtggatggggagaatcaacccgagtggaggtggtgcagagtacgcccagaggtttcagggcagagtctccatgaccagtgacacgtccgcgagcactgtctatatggagatgaggagcctgagacttgacgacacggccgtatattactgtgcgagaatcgaagaaggtgg

SEQ ID NO: 296484 - DNA, 594 bp, Homo sapiens
  misc_feature: NA.8.42.D09.1.454.heavy.1.nb
agcccagcactgggattccgaggtgtgtccattcggtgatcagcactgaacacagaggactcaccatggagttctggctgggctgggttttccttgttgctaatttcaaaaggtgtccagtgtgaggtgcagctggtggagaagtgggagggggcttgatccgaggccggggggtccctgagactctcctgtgcagcctctggcttcaccatcagtagagactacatgagcgtgggcccgcaggctccgagggaagggctggagtgggtctcagttatttatcgcgatggtggcacacactacgcagactccgtgaagggcagattcaccgtctccagagacaattccaagaacatggtgtatcttcaaatgaacagactaacagccgaggacacggccgtatattactgtgcgagacatgactacggtgagccctggggccagggaaccctggtcaccgtctcctcagcctccaccaagggcccatcggtccttccccctggccgccctgctccaggagcacctccgagacgcacagccggccctgggctgcctggtcaaggctacttccgacacgcgagctgagcgggctgg

SEQ ID NO: 296485 - DNA, 284 bp, Homo sapiens
  misc_feature: NA.8.59.F04.1.454.heavy.1.nb
cccagcaaccacatctgtcctctagagaatcccctgagagctccgttcctcaccatggactggacctggaggatcctcttcttggtggcagcagccgcgggagtccactcccaggtgcaactggtgcagtctggggctgaagtgcgcgagccgtggggcctcagtcagagtctcctgcaaggcttctggatacgccttcggcgaccactatatacactggatgcgccacggcccctggacaagggcttgagtggatggcctggatctacccgaatagtggtggc

SEQ ID NO: 296486 - DNA, 348 bp, Homo sapiens
  misc_feature: NA.8.66.F11.1.454.heavy.1.nb
  modified_base (291)..(291): a, c, t, g, unknown or other
  misc_feature (291)..(291): n is a, c, g, or t
cttagccctggactccaaggccttccacagaggactcaccatggaattggggctgagctgggtttccttgttgctattttagaaggtgtccagtgtgaggtgcagctggtggagtcgtggggggggcttagtccagcctggggactccctaagactctcctgtgcagcctctggattcacctttggcaagtcttggatgggctgggtccgccaggctccgaggggggcgctgggagtgggtggccaacatcaacggacgatgacaaaggagacctactatttggactctgngagggccattcacatctccagagacaacgccaacactcactgtctctcgctgatgag

SEQ ID NO: 296487 - DNA, 137 bp, Homo sapiens
  misc_feature: NA.8.67.G01.2.454.heavy.1.nb
  modified_base (133)..(133): a, c, t, g, unknown or other
  misc_feature (133)..(133): n is a, c, g, or t
tgctcagttaggacccagacggaaccatggaagccccagcgcagcttctcttcctcctgctactctggctcccagagatcattggagaagtggtgatgacacagtctccggtcaccctgtcttgtttttccgngggg

SEQ ID NO: 296488 - DNA, 258 bp, Homo sapiens
  misc_feature: NA.8.82.H05.1.454.heavy.1.nb
cacccctccttgggagaatcccctagatcacagctcctcaccatggactggacctggagtctcctcttcttggtggcagcagcaacaggtggccactcccaggttcagttgctgcaatctggaactgaggcgaagaagcccggggctcagtgaaggtctcctgcaaggcgtcggttacagtttcacaacgtatggtattagttgggtgcgacaggcccctggacaagggcttgagtggatggggtggatcagcgcctt

SEQ ID NO: 296489 - DNA, 240 bp, Homo sapiens
  misc_feature: NA.8.82.H05.2.454.heavy.1.nb
cgcgggagtccactcccaggtgcaactggtgcagtctggggctgaagtgcgcgagcctggggcctcagtcagagtctcctgcaaggcttctggatacgccttcggcgaccactatatacactggatgcgccaggcccctggacaagggcttgagtggatggcctggatctacccgaatagtggtggcacaaattatgcacgggtagtttcgagggcagggtcacgtgaccagggacacgt

SEQ ID NO: 296490 - DNA, 336 bp, Homo sapiens
  misc_feature: NA.9.14.B03.1.454.heavy.1.nb
ctagtggtgataccatatactacgcagactctgtgaagggccgattcaccatctccagggacaacgccaagaactcactgactttgcaaatgaacaccctgcgagccgaggacacggccgtatattactgtgcgagaataacccgttcgcctggttattaccttgacacttggggccagggaaccctggtcaccgtctcctcagcctccaccaagggcccatcggtcttcccctggcgccctgctccaggagcacctccgagagcacagcggccctgggctgcctggtcaaggactacttccagacgtatcactgagcgggctggcaaggcgcata

SEQ ID NO: 296491 - DNA, 106 bp, Homo sapiens
  misc_feature: NA.9.28.C06.2.454.heavy.1.nb
tatgcgccttgccagcccgctcagtgatacgtctggaagtagtccttgaccaggcagcccagggccgctgtgcccagcacctgaactcctgggggaccgtcagtct

SEQ ID NO: 296492 - DNA, 387 bp, Homo sapiens
  misc_feature: NA.9.33.C11.1.454.heavy.1.nb
agaagtcggcggtgtttccattcggtgatcagcactgaacacagaggactcaccatggagtttgggctgagctgggttttcctcgttgctcttttaagaggtgtccagtgtcaagtgcaactggtggagtcgtggggggggctggtccagcctgggaggtccctgagactctcctgtgcaggctctggattcaccttcagtaactacggcgtgcacgtgggtccgccaggctccaggcaagggcttgggagtggctggcagttgttcatctgaaggagtgttcaatactatacagactccgtgaagggccgattcaccatctccagagacaattccaagaacacgatgtatctgcaaatggacagacctaaagagttgaggacacgg

SEQ ID NO: 296493 - DNA, 647 bp, Homo sapiens
  misc_feature: NA.9.34.D01.1.454.heavy.1.nb
aggagcccagccctgggattgtcaggtgttttcatttggtgatcaggactggacagagagaactcaccatggagtttgggctgacctggtctttttctcgtggcttagttttaaaaggtgtccagtgtgaggttcaactgttggagtcgtgggggaggcttggtccagcctggggagtccctgcgactctcctgtgtggcctctggattcacctttgagacctatgccttgacctgggtccgccaggctccgagggggagggactggagtgggtcgcaggcatcgctggtggcggtcatgacacattctacgcaaactccgtgaggggccgcttcatcatctccagagacaattcccagaacatactgtctctgcaactcaataacctgagaggcgaggacacggccatttatttctgtgcgaaggaggcatatgggaagtacgattttcgatccctccgcagtcgacactttgattacgtggggccgggaaccctggtcgccgtctcctcagcctccaccaagggcccatcggtcttccccctggccaccctcctccaagagcacctcgtggggcacagcggccctgggctgcctggtcaaggactacttccagacgtatcactgagcgggctggcaaggcgcata

SEQ ID NO: 296494 - DNA, 49 bp, Homo sapiens
  misc_feature: NA.9.34.D01.3.454.heavy.1.nb
ggtccagcctggggagtccctgcgactctcctgtgtggcctctggattc

SEQ ID NO: 296495 - DNA, 186 bp, Homo sapiens
  misc_feature: NA.9.37.D04.2.454.heavy.1.nb
gtggttctcggggctgccctttggctttggagatggttttctcgatgggggctgggagggcttttgttggagaccttgcacttgtactccttgccattcagccagccctggtacagccggggggtccctgacactctcctgtacagcctctggattcacctttaacacctatgcattgagctgggt

SEQ ID NO: 296496 - DNA, 590 bp, Homo sapiens
  misc_feature: NA.9.53.E09.1.454.heavy.1.nb
ctttctgagactcatggacctcctgcacaagaacatgaaacacctgtggttcttcctcctgctggtggcagctcccagatgggtcgtgtcccaggtgcagctgcaggagtcgggcccaggactggtgaagccttcggagaccctgtccctctcctgcactgtctctggtgctccatcagtacttactactggacctggatccggcagcccgccgggaagggactggagtgggttgggcgtatttttagcagtggggacaccaactacagcccctccctcaagagtcgagtcaccatgtcagtagacacgtccaagaaccagatctccctgaagctgacctctgtgaccgccgcggacacggccgtgtattactgtgcgagagttcccaaatatagcaacagctggtacattccttttgatatgtggggccaagggacaatggtcaccgtctcttcagcctccaccaagggcccatcggtcttccccctggcgccctgctccaggagcacctccgagagcacagcggccctgggctgcctggtcaaggactacttccagacgtatcactgagcgggctggcaaggcgcata

SEQ ID NO: 296497 - DNA, 412 bp, Homo sapiens
  misc_feature: NA.9.70.G04.1.454.heavy.1.nb
gcttcactagtcctggacctcctgtgcaagaacatgaaacatctgtggttcatcctcctcctggtggcagctcccagatgggtcctgtcccaggtgcggctgcaggagtcgggcccaggactagtgaagccttcacaggccctgtccctcacctgcactgtctctggtgactccatcagaggtggtcgttcctactggacctggatccggcagtccgccggcaagggctggagtatattggacgaatctatgccagtgggaccgccatctacaacccgtccctcaagagtcgagtcagcatgtcagtcgacacgtcccagaaccagttctccctgacagtgagttatatgaccgccgcagacacggccgtgtattactgtgcgagagaggccgttatttaggaccagctgtt

SEQ ID NO: 296498 - DNA, 333 bp, Homo sapiens
  misc_feature: NA.9.78.H01.2.454.heavy.1.nb
gagaagagccccagccccagaattcccaggagtttccattcggtgatcagcactgaacacagaggactcaccatggagtttgggctgagctgggttttccttgttgctattataaaaggtgtccagtgtcaggtgaagctggtggagtctgggggagcttggtcaagcctggagggtccctgagactctcctgtgcagcctctggattcgcctctggattgacgttcagtgactactacatgacctgggtccgccaggctccgagggagggctgggagtgggtttcatacatttatctagtggtgataccatatactacgcagactctgtgaa

SEQ ID NO: 296499 - DNA, 149 bp, Homo sapiens
  misc_feature: NA.9.80.H03.1.454.heavy.1.nb
ggtcgcacgtattaatgaagacgggactactataaattacgcggactccgtgaagggccgattcaccatctccagagacgacgccaagaacacgctgtatctgcaaatgaacagtctgagagtcgaggacacggctgtatattactgcg

SEQ ID NO: 296500 - DNA, 494 bp, Homo sapiens
  misc_feature: NA.10.1.A01.1.454.light.1.nb
tcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggtttcggcggagggaccaagctgaccgtcctaggtcagcccaaggctgccccctcggtcactctgttcccaccctcctccactactatgctgagcgggctggcaaggcgcata

SEQ ID NO: 296501 - DNA, 218 bp, Homo sapiens
  misc_feature: NA.10.10.A10.1.454.light.1.nb
ctggctccaagtctggcacctcagccaccctggccatcactgggctccaggctgaggatgaggctgattattactgtcagtcctatgacagtaggctgagtctttgggtgttcggcggagggaccaagctgaccgtcctaagtcagcccaaggctgcccctggtcactctgttcccacctcctccactactatgctgagcgggctggcaaggcgcata

SEQ ID NO: 296502 - DNA, 333 bp, Homo sapiens
  misc_feature: NA.10.12.B01.1.454.light.1.nb
ctagctgtgctgtgggtccaggaggcagaactctgggtgtctcaccatggcctggatccctctacttctccccctcctcactctctgcacagggtccgaggcctcctatgagctgacacagccaccctcggtgtcagtgtccccaggacagacggccaggatcacctgctctggagatgctttgccgaagcaatatgcttactggtaccatcagaagccaggccaggcccctgtggaacttgtatataaggacactgagaggcccccagggatccctgagcgattctctggctccagctcagggacaacagtgacgttgaccatcagcggagc

SEQ ID NO: 296503 - DNA, 342 bp, Homo sapiens
  misc_feature: NA.10.17.B06.1.454.light.1.nb
taggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactg

SEQ ID NO: 296504 - DNA, 364 bp, Homo sapiens
  misc_feature: NA.10.2.A02.1.454.light.1.nb
taggacccagacggaaccatggaagccccagcgcagcttctcttcctcctgctactctggctcccagataccactggagaagtagtgatgacgcagtctccagccaccctgtctgtgtctccaggggaaacagccaccctctcctgcagggccagtcagagtgttggcagcaggttagcctggtaccagcagaaacgtggccaggctcccaggctcctcgtatatggtgcatccaccagggccactggtatctcaggcaggttccgtggcagtgggtctgggacagagttcactgtcaccatcagcagcctgcagtctgaagtatttgctagtttattactgtcagcagtataatagctggccc

SEQ ID NO: 296505 - DNA, 359 bp, Homo sapiens
  misc_feature: NA.10.20.B09.1.454.light.1.nb
taggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcagggccactggtgtcccagccaggttcagtggcagtgggtctggaacagagttcactctcaccatcagcggcctgcagtctgaagtatttgctagtttattactgtcagcagtataatgactt

SEQ ID NO: 296506 - DNA, 332 bp, Homo sapiens
  misc_feature: NA.10.21.B10.1.454.light.1.nb
gggggaggaactgctcagttaggacccagagggaaccatggaagccccagctcagcttctcttcctcctgctactctggctcccagacaccaccggagaaattgtgttgacacagtctccagccacgctgtctttgtctccgaggggaaaagccaccctctcctgcagggccagtcagagtgttcgcacttcgtagggtgtatcaacataaatccggccaggctcccaggctcctcatctttgatgctttcaacacgggcccctggccgtcccaggcaggttcagtggcagtgggtctgggacagacttcactctcaccatcagcagcctag

SEQ ID NO: 296507 - DNA, 243 bp, Homo sapiens
  misc_feature: NA.10.21.B10.2.454.light.1.nb
agagggggcacttctccctctaacactctcccctgttgaagctctttgtgacagacttcactctcaccatcagcagcctagagcctgaagattttgcagtttattactgtcagcagcgtgccactttcggcggaggtgccactttcggcgagggaccaaaatagaggtcaaacgaactgtggctgcaccatctgtcttcatcttccgccatctgacactactatgctgagcgggctggcaagg

SEQ ID NO: 296508 - DNA, 358 bp, Homo sapiens
  misc_feature: NA.10.25.C03.1.454.light.1.nb
tggggaggaactgctcagttaggacccagacggaaccatggaagccccagcgcagcttctcttcctcctgctactcaggctcccagaaaccactggagaaatcgtgatgacgcagtctccagccaccctgtctgcgtctccagggcaaacagccaccctctcctgctgggccagtccgagtgttggcagccgcttagcctggtaccagcaaaaacctggccagcctcccaggctcctcgtctatggtgcatccacaagggccactggtatcccagccaggttcagtggcagtgggtctgggacagagttcgctctcaccatcagcagtctgcagtctgaagtattttgctagtttatt

SEQ ID NO: 296509 - DNA, 356 bp, Homo sapiens
  misc_feature: NA.10.26.C04.1.454.light.1.nb
taggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctagaagatattgcagtttattactgtcagcagtatg

SEQ ID NO: 296510 - DNA, 500 bp, Homo sapiens
  misc_feature: NA.10.27.C05.1.454.light.1.nb
agaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtcactctgttcccaccctcctccactactatgctgagcgggctggcaaggcgcata

SEQ ID NO: 296511 - DNA, 405 bp, Homo sapiens
  misc_feature: NA.10.28.C06.1.454.light.1.nb
tcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaacgcccccaaactgatgatttatgatgtcagtaatcgaccctcaggggtttctgatcgcttcttgcctcaagtctggcaacacggcctccctgaccatctctgggctccagactgaggacgaggctgattattactgcagctcacatacaagcgcagcggttgggtgttcgggcgggggaccacg

SEQ ID NO: 296512 - DNA, 354 bp, Homo sapiens
  misc_feature: NA.10.28.C06.2.454.light.1.nb
gtggggagtctgcaccatggcttggaccccactcctcttcctcaccctcctcctccactgcacagggtctctctcccagcttgtgctgactcaatcgccctctgcctctgcctcccgtgggagcctcggtcaagctcatctgcactctgagcagtgggcacagcaactacgccatcgcatggcatcagcagcagccagagaagggccctcggtacttgatgaaggttaacagtgatggcagccacaccgaaggggacggatccctgatcgttttcagggtccagctcgtgggctgagcgctacctcaccatctccagcctccagtctgaggatgaggctgactattactgtcag

SEQ ID NO: 296513 - DNA, 316 bp, Homo sapiens
  misc_feature: NA.10.28.C06.3.454.light.1.nb
ggaggcggcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgtgcttataactatgtctcctggtaccagcaccacccaggcaaagcccccaaatccttgtttttgaggtcagtaagcggccctcaggagtccctgatcggttctctgcctccaagtctggcaacacggcctcctgaccgtctc

SEQ ID NO: 296514 - DNA, 232 bp, Homo sapiens
  misc_feature: NA.10.28.C06.4.454.light.1.nb
cgtccgggtctcctggacagtcagtcaccatctcctgcactggaaccagcagtgactttgtgcttataactatgtctcctggtaccagcaccacccaggcaaagcccccaaactccttgtttttgaggtcagtaagcggccctcaggagtccctgatcggttctctgcctccaagtctgcaacacggccctcctgaccgtctcgtcgggctccgaggctgaggatgaggtct

SEQ ID NO: 296515 - DNA, 394 bp, Homo sapiens
  misc_feature: NA.10.29.C07.1.454.light.1.nb
caggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggc

SEQ ID NO: 296516 - DNA, 342 bp, Homo sapiens
  misc_feature: NA.10.3.A03.1.454.light.1.nb
cgctcagctcctgggactcctgctgctctggctcccaggtgccaaatgtgacatccagatggcccagtctccttccaccctgtctgcttctgtgggggacagagtcatcatcacttgccgggccagtcagacgtttaataattggttggcctggtatcagaagaaaccagggaaacgccccgaaactcctgatccatactgcctccactttggcaagtgggtcccatcaaggttcagcggcagtggagctgggacagagttcactctcagtatcagcagcctgcagcctgatgattttgctaacctattattgtcaacaatatgacacttatccattctctt

SEQ ID NO: 296517 - DNA, 87 bp, Homo sapiens
  misc_feature: NA.10.30.C08.1.454.light.1.nb
gaaatcaaacgaactgtggctgcaccatctgtcttcatcttcccgccatctgacactactatgctgagcgggctggcaaggcgcata

SEQ ID NO: 296518 - DNA, 301 bp, Homo sapiens
  misc_feature: NA.10.33.C11.1.454.light.1.nb
cccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcagtcaggacatttacaagtctttaaattggtatcagcagaaaccagggaaggcccctaaactcctgatctacgatgcatcgaacttggaaacaggggtcccatcaaggttcagtggaggtggatcgtgggacagtattttactc

SEQ ID NO: 296519 - DNA, 85 bp, Homo sapiens
  misc_feature: NA.10.33.C11.2.454.light.1.nb
gttcaaacgaactgtggctgcaccatctgtcttcatcttcccgccatctgacactactatgctgagcgggctggcaaggcgcata

SEQ ID NO: 296520 - DNA, 257 bp, Homo sapiens
  misc_feature: NA.10.35.D02.2.454.light.1.nb
  modified_base (136)..(136): a, c, t, g, unknown or other
  misc_feature (136)..(136): n is a, c, g, or t
cagttaggacccagagggaaccatggaaaccccagcgcagcttctcttcctcctgctactctggctcccagaaaccaccggagaagttgtgttgacgcagtctccaggcaccctgtctttgtctccgaggggaaangccaccctctcctgcagggccagtcactatgttagtgacaactacttagcctggttgcagcacaaacctggccaggctccaggctcctcatctatgctgcatccatcagggccactggcat

SEQ ID NO: 296521 - DNA, 373 bp, Homo sapiens
  misc_feature: NA.10.37.D04.1.454.light.1.nb
tgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggacgtcccagccaggttcagcggcggtgggtctgggacagacttcactctcaccatcagcagcctgcagtctgaggaccttggagtttattactgtcagcagtatcataactggcctc

SEQ ID NO: 296522 - DNA, 112 bp, Homo sapiens
  misc_feature: NA.10.38.D05.1.454.light.1.nb
tctcaggaggcagcgctctcaggacgtcaccaccatggcctgggctctgctcctcctcaccctcctcactcagggcacagggtcctgggcccagtctgccctgactcagcct

SEQ ID NO: 296523 - DNA, 384 bp, Homo sapiens
  misc_feature: NA.10.38.D05.2.454.light.1.nb
ccctccgcgtccgggtctcctggacagtcagtcaccatctcctgcactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgcccctggtcactctgttcccaccctcctccactactatgctgagcgggctggcaaggcgcata

SEQ ID NO: 296524 - DNA, 151 bp, Homo sapiens
  misc_feature: NA.10.38.D05.3.454.light.1.nb
gcctccgtgtctgggtctcctggacagtcggtcaccatctcctgcactggaccagcactgatgttgggcattataaccttgtctcctggtatcaacaacgcccagacaaacgcccccacactcttgatttatgaagtcagtaagcggccct

SEQ ID NO: 296525 - DNA, 386 bp, Homo sapiens
  misc_feature: NA.10.39.D06.1.454.light.1.nb
ctaaggaagcagcactggtggtgcctcagccatggcctggaccgttctcctcctcggcctcctctctcactgcacagactctgtgacctcctatgcgctgactcagccaccctcggtgtcagtggccccaggacagacggccacgctgacctgtgggggatacacaattggaagtaatcgtgtgcactggtaccagcagaggccaggccaggcccctgtggttgtcgtctataatgataacgaccggccctcagggatccctgagcgattctctggctccaattcgggcaacacggccaccctcatcatcaccagggtcgaggccgggatgaggccgactactactgtcaggtgtgggatttcactactgatcatgtggggtcttc

SEQ ID NO: 296526 - DNA, 332 bp, Homo sapiens
  misc_feature: NA.10.39.D06.2.454.light.1.nb
tgaagaacccagcattgcagcagctccatcatggcctgggctcctctgctcctcaccctcctcagtctcctcacagggttgactcagccaccttctgcatcagcctccctgggagcctcggtcacactcacctgcaccctgaacagcgactacatcttgggctcaggcctcaatcggtgcctgaccaccaacaacatctacgaagagggtgagagtgtccctcactgtggggcagacaatggcagtgggagcaatttcgtgagagtgttcggcggagggaccaacgtgaccgtccttcctaggtcagcccaaggctcgcccctggtcactct

SEQ ID NO: 296527 - DNA, 383 bp, Homo sapiens
  misc_feature: NA.10.4.A04.1.454.light.1.nb
gcagcatcggaggtgcctcagccatggcatggatccctctcttcctcggcgtccttgcttactgcacagcatccgtggcctcctctgacctgactcagccaccctcactgtccgtgtcgccaggagagacagccaccattacatgctctggagaagcgttgagcgataaatttgtttcgtggtataaacagaagtcaggccagtcgcctgtgttggtcatctatcaaaatattaagcggccctcaggggtccctgagcgaatctctggcgccaagtctgggaccacaggcacgctgaccatcagtgtgacccaggctgtggatgaggcagactattactgtcaggcgtgggacagtagcgctgtgattttcggcggagggacc

SEQ ID NO: 296528 - DNA, 386 bp, Homo sapiens
  misc_feature: NA.10.40.D07.1.454.light.1.nb
gagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagcccaaggctcgccccctggtcactctcgttcccaccctcctccactactatcgctga

SEQ ID NO: 296529 - DNA, 322 bp, Homo sapiens
  misc_feature: NA.10.43.D10.1.454.light.1.nb
  modified_base (138)..(138): a, c, t, g, unknown or other
  misc_feature (138)..(138): n is a, c, g, or t
taggacccagagggaaccatggaagccccagctcagcttctcttcctcctgctactctggctcccagtttcagataccaccggagagattgtgttgacacagtctccagccaccctgtctttgtctccgaggggaaanagccaccctctcctgcagggccagtcagagtgttggcgcctgcgtagcctggtaccaacagaaacctggccaggctcccaggcccctcatctatggtgcatccaacagggccactggcatcccagccaggttcagtggcaggtgggtctgggacagacttcactctcaccatcatcagcctgga

SEQ ID NO: 296530 - DNA, 216 bp, Homo sapiens
  misc_feature: NA.10.49.E05.1.454.light.1.nb
actgctcagttaggacccagagggaaccatggaagccccagctcagcttctcttcctcctgctactctggctcccagatgccaccggagcagttgtattgacacagtctccagccaccctgtctttgtctccgaggggaaagccaccctctcctgcagggccagtcagagcgttagcaactacttagcctggtaccaacagaaacctggccaggct

SEQ ID NO: 296531 - DNA, 253 bp, Homo sapiens
  misc_feature: NA.10.52.E08.1.454.light.1.nb
tcagttaggacccagagggaaccatggaaaccccagcgcagcttctcttcctcctgctactctggctcccaggtaccaccggagaaattgtgttgacacagtctccaggcaccctgtctttgtctccgaggggaaagagccaccctctcctgcagggccagtcagagtgttaaacaacaactacttagcctggtaccagcagaacctggccaggctcccaggctcctcatctatgatgcatccagcagggcca

SEQ ID NO: 296532 - DNA, 369 bp, Homo sapiens
  misc_feature: NA.10.53.E09.2.454.light.1.nb
acaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccgggtccctgaccgattcagtggcagcgggtctgggacagatttcactctcaccatcagcagcctgcaggctgaagatgcggcagtttatactgtcagcacta

SEQ ID NO: 296533 - DNA, 288 bp, Homo sapiens
  misc_feature: NA.10.59.F04.2.454.light.1.nb
caggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaacgcccccaaattcatgatttatgatgtcagtgcgcggccctcgggggtccctgatcgcttctctgctc

SEQ ID NO: 296534 - DNA, 306 bp, Homo sapiens
  misc_feature: NA.10.63.F08.1.454.light.1.nb
taggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaac

SEQ ID NO: 296535 - DNA, 370 bp, Homo sapiens
  misc_feature: NA.10.64.F09.1.454.light.1.nb
caggacccagagggaaccatggaagccccagctcagcgtctcttcctcctgctactctggctcccagatataaccgccggagaaattgtgttgacacagtctccagccaccctgtctttgtctccaggggaaagagccaccctctcctgcagggccagtcagagtgttagcactaacttagtctggtaccaacagaaacctggccaggctcccaggctcctcatctatgatgcatccacgagggccactggcatcccagccaggttcagtggcagtgggtctgggacagacttcactctcaccatcaccggcctacgaccctgaagtattttgctagtttattactgtcagcagcgtagcagctcggccc

SEQ ID NO: 296536 - DNA, 342 bp, Homo sapiens
  misc_feature: NA.10.65.F10.1.454.light.1.nb
aggacacagcatggacatgagggtccccgctcagctcctgggctcctgctactctggctccgaggtgccagatgtgacatccagatgacccagtctccaccgtccctgtctgcatttgtggagacagagtcaccatctcttgccggacaagtcagaacattgacacctatttgaattggtatcaacaaaaactggggaaagcccctacactcctgatcaatgcagcgtccagtttacagagtgggtcccctcaaggttcagtggcagtggatctgggacagactttactctcaccatcagcgatctgcagcctgacgtatttgcgtacttactactgtcaac

SEQ ID NO: 296537 - DNA, 348 bp, Homo sapiens
  misc_feature: NA.10.68.G02.1.454.light.1.nb
caggaggcagagctctgggaatctcaccatggcctggacccctctcctgctccccctcctcactttctgcacagtctctgaggcctcgtatgaactgacacagccaccctcggtgtcagtgtccccaggacagactgccaggatcagctgctctggagatgcattgccaaacaaaatatgcttattggtacgagacaaaagccaggccaggcccctgtcttgttgatatatgaggacaccaagcgaccctccggaatttctgagagattctccggctccagctcgagggacagtggcctccttgactatcagtggggcccagggggtcgagtgaggctgactactact

SEQ ID NO: 296538 - DNA, 347 bp, Homo sapiens
  misc_feature: NA.10.70.G04.1.454.light.1.nb
ctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacagtcggggcaggttatgatgtacactggtaccagcaacttcccggaacacgcccccacgctcctcatctatggtgacaccaaccggccctcgacggggtccctgagcgattctctgggtccaagtctggcacctcggcctccctggccatcactgggctccaggctgaggatgaggctgattattactgccagtcccat

SEQ ID NO: 296539 - DNA, 407 bp, Homo sapiens
  misc_feature: NA.10.71.G05.1.454.light.1.nb
tggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagtattttgctagtttattactgtcagcagcgtgcctacgtttcggcggaggtgccgtacgtttcggg

SEQ ID NO: 296540 - DNA, 250 bp, Homo sapiens
  misc_feature: NA.10.71.G05.3.454.light.1.nb
gagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgccatctgacactactatgctgagcgggctggcaaggcgcata

SEQ ID NO: 296541 - DNA, 181 bp, Homo sapiens
  misc_feature: NA.10.71.G05.4.454.light.1.nb
  modified_base (157)..(157): a, c, t, g, unknown or other
  misc_feature (157)..(157): n is a, c, g, or t
gtatctgcaaatgaccagcctgagagccgaggacacgggtgtttattactgtgggagaaatcctagtggcatcacctggtattgtgacttccggggccagggaaccgtggtcaccgtctcttcggcctccaccagggccatcggtcttcccctggcnccctgctccaggagcacctccgag

SEQ ID NO: 296542 - DNA, 389 bp, Homo sapiens
  misc_feature: NA.10.72.G06.1.454.light.1.nb
caggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccagggcactctcgtgat

SEQ ID NO: 296543 - DNA, 359 bp, Homo sapiens
  misc_feature: NA.10.73.G07.1.454.light.1.nb
aggacacagcatggacatgagggtccccgctcagctcctggggctcctgctactctggctccgaggtgccagatgtgacatccaaatgacccagtctccatcctccctgtctgcatctttaggcgacagagtcaccattacttgccgggcaagtcagagcattaccaactctttaaattggtttcaacagaggccagggaaagcccctaagctcctggtctatggtgcatccactgtgcaaactggggtcccatccaggttcagtggcagtggatttgggacagatttcactctcaccatcaacatctgcagcctgatgatttcgctaacttactactgtacaacagagttacacgacg

SEQ ID NO: 296544 - DNA, 364 bp, Homo sapiens
  misc_feature: NA.10.75.G09.1.454.light.1.nb
cagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtcttcttggtaccaacagagcccagacaaagcccccaaaattatcatttctgctgtcagtaatcggccctcagggtttctagtcgcttctctggctccaagtctggcaacacggcctccctgaccatctctgggctccaggctgaggacgaggctgattattattgcagctcatatacaa

SEQ ID NO: 296545 - DNA, 398 bp, Homo sapiens
  misc_feature: NA.10.76.G10.1.454.light.1.nb
tactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctcgttcccaccctcctccactactatgctgagcggctggc

SEQ ID NO: 296546 - DNA, 157 bp, Homo sapiens
  misc_feature: NA.10.76.G10.3.454.light.1.nb
aagcgcctccaacattggcacgaattatgtatcctggtaccagcacttccccgggacagcccccaaactcctcatctatgaagattttacgcgaccctcagggattcctggccgattctctggctccaagtcaggcacctctgccacctggacatca

SEQ ID NO: 296547 - DNA, 144 bp, Homo sapiens
  misc_feature: NA.10.76.G10.4.454.light.1.nb
gggtctcctggacagtcagtcaccatctcctgcactggaaccagcagtgactttgttgcttataactatgtctcctggtaccagcaccacccaggcaaacgcccccaaactccttgttttgaggtcagtaagcggccctcagga

SEQ ID NO: 296548 - DNA, 322 bp, Homo sapiens
  misc_feature: NA.10.77.G11.2.454.light.1.nb
gctcagttaggacccagagggaaccatggaagccccagctcagcttctcttcctcctgctactctggctcccagattccaccggagaagttgtgttgacacagtctccagccaccctgtctttgtctccaggggaaaagccaccctctcctgcagggccagtcagagtcttaggagctccttagcctggtatcaacagaaacctggccaggctcccaggctcctcatctatgatgcatccaacagggccactggcatcccagccaggttcagtggcaggtggtctgggacagacttcactctcaccatcagcagactagacg

SEQ ID NO: 296549 - DNA, 336 bp, Homo sapiens
  misc_feature: NA.10.79.H02.2.454.light.1.nb
ctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtattt

SEQ ID NO: 296550 - DNA, 99 bp, Homo sapiens
  misc_feature: NA.10.80.H03.2.454.light.1.nb
ggataacctggtgggggagacagcattgaaagtgaagctgtccactggtaccagcagaggccaggccaggcccctgtactggtcctctatgatgatagt

SEQ ID NO: 296551 - DNA, 99 bp, Homo sapiens
  misc_feature: NA.10.80.H03.3.454.light.1.nb
cgctgacctgtgggggatacacaattggaagtaatcgtgtgcactggtaccagcagaggccaggccaggcccctgtggttgtcgtctataatgataacg

SEQ ID NO: 296552 - DNA, 102 bp, Homo sapiens
  misc_feature: NA.10.82.H05.1.454.light.1.nb
gggaccaagctgaccgtcctaagtcagcccaaggctgccccctcggtcactctgttcccaccctcctccactactatgctgagcgggctggcaaggcgcata

SEQ ID NO: 296553 - DNA, 32 bp, Homo sapiens
  misc_feature: NA.10.85.H08.1.454.light.1.nb
acagaggactcaccatggaattggggctgagc

SEQ ID NO: 296554 - DNA, 479 bp, Homo sapiens
  misc_feature: NA.10.86.H09.1.454.light.1.nb
acaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgcccctcggtcactctgttcccaccctcctccactactatgctgagcgggctggcaaggcgcata

SEQ ID NO: 296555 - DNA, 216 bp, Homo sapiens
  misc_feature: NA.10.86.H09.2.454.light.1.nb
ggggagtctgcaccatggcttggaccccactcctcttcctcaccctcctcctccactgcacagggtctctctcccagcttgtgctgactcaatcgccctctgcctctgcctccctgggagcctcggtcaagctcatctgcactctgagcagtgggcacagcaactacgccatcgcatggcatcagcagcagccagagaagggccctcggtacttga

SEQ ID NO: 296556 - DNA, 355 bp, Homo sapiens
  misc_feature: NA.10.88.H11.1.454.light.1.nb
actgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggacgcctgaagatattgctagtttattattgtc

SEQ ID NO: 296557 - DNA, 302 bp, Homo sapiens
  misc_feature: NA.10.9.A09.1.454.light.1.nb
taggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactct

SEQ ID NO: 296558 - DNA, 144 bp, Homo sapiens
  misc_feature: NA.11.1.A01.2.454.light.1.nb
agatggtgttgcagacccaggtcttcatttctctgttgctctggatctctggtgccaacggggacatcgtgatgacccagtctccagacttcctatttgtatctctgggcgagagggccaccatcaactgcaaggcaagccaga

SEQ ID NO: 296559 - DNA, 325 bp, Homo sapiens
  misc_feature: NA.11.10.A10.1.454.light.1.nb
taggacccagacggaaccatggaagccccagcgcagcttctcttcctcctgctactctggctcccagatagcactggagaaatagtgatgacgcagtctccagccaccctgtctgtgtctccaggggaaaagccaccctctcctgcagggccagtcagagtgttaggagcaacttagcctggtaccagcagaaacctggccaggctccaggctcctcatctatggtgcatccaccagggccactggtttcccagccaggttcagtggcagtgggtctgagacagagttcactctcaccatcaacggcctgcagtctgaagtattt

SEQ ID NO: 296560 - DNA, 358 bp, Homo sapiens
  misc_feature: NA.11.11.A11.1.454.light.1.nb
gtagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctacctaaactgctcatctcctgggcatcctacccgggcacccggagtccctgaccgattcagtggcagcgggtctgggacagacttcactctcaccatcagcaacctgcaggctgaagatgtggctagtttatactgtcagcagtattgtgaagctccg

SEQ ID NO: 296561 - DNA, 251 bp, Homo sapiens
  misc_feature: NA.11.21.B10.1.454.light.1.nb
tgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacgacggg

SEQ ID NO: 296562 - DNA, 359 bp, Homo sapiens
  misc_feature: NA.11.25.C03.6.454.light.1.nb
  modified_base (291)..(291): a, c, t, g, unknown or other
  misc_feature (291)..(291): n is a, c, g, or t
caggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacncagccactctgaccatcagcggacccaggctatggatgaggctgactattattgtcaggcgtgggaca

SEQ ID NO: 296563 - DNA, 382 bp, Homo sapiens
  misc_feature: NA.11.3.A03.1.454.light.1.nb
gtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgagatgaggctgattatactgtcagtcctttgactattaaactggatgtgtattcggcggagggacccagtaaccgtctaggtcagcccaaggctcgcccctcggtcactctcgttcccaccctcctcgtatctctcgctga

SEQ ID NO: 296564 - DNA, 340 bp, Homo sapiens
  misc_feature: NA.11.31.C09.1.454.light.1.nb
agatggtgttgcagacccaggtcttcatttctctgttgctctggatctctggtgccaacggggacatcgtgatgacccagtctccagacttcctatttgtatctctgggcgagagggccaccatcaactgcaaggcaagccagattatttatacagctccgacagtaagaactacttatcttggttccaacagaaaccaggacagcctcctaaattactcatttatccacatctatgcgggcctccggggtccccgaccgattcagtggcagcgggtctgggacagatttcactctcacaatcagcagcctgcagactgaagatggtgggtcgtttatta

SEQ ID NO: 296565 - DNA, 215 bp, Homo sapiens
  misc_feature: NA.11.31.C09.2.454.light.1.nb
  modified_base (181)..(181): a, c, t, g, unknown or other
  misc_feature (181)..(181): n is a, c, g, or t
gcctgtgtctctgggcgagagggccaccatcgagtgcaagtccagcgagactcttttatatagtgtcaacgataaggactatttagcttggtatcagacaaaaaccaggacagccctacctaaactgctcatctcctgggcatcctaccgggcacccggagtccctgaccgattcagtgcngcgggtctgggacagacttcactctcaccatcag

SEQ ID NO: 296566 - DNA, 222 bp, Homo sapiens
  misc_feature: NA.11.4.A04.1.454.light.1.nb
ctggctccaattctgggaacacggccaccctgaccatcagcagggtcgaggccggggatgacgccgactattactgtcaggtgtgggataacagtcgtgatcatgtggtgttcggcggagggaccaagctgaccgtcctaagtcagcccaaggctcgccccctcggtcactctgttcccaccctcctcgtatctctcgctgagcgggctggcaaggcgcata

SEQ ID NO: 296567 - DNA, 376 bp, Homo sapiens
  misc_feature: NA.11.57.F02.1.454.light.1.nb
tgctcagttaggacccagacggaaccatggaagccccagcgcagcttctcttcctcctgctactctggctcccagggaccacgggagacatagtgctgacgcagtctccagccaccctgtctgtgtctccaggggacagagccaccctctcctgcagggccagtcagactattagttacaccttagcctggtaccagcaaaaacctggccaggctccccggctcctcatctatggtgcatccaccagggccgctggtcgtcccacccaggttcagtggcggtgggtctgggacagtgttcactctcaccatcagcagcctgcagtctgaagattttgctagtttattactgtcagcagtatagtaagtggccgctc

SEQ ID NO: 296568 - DNA, 354 bp, Homo sapiens
  misc_feature: NA.11.57.F02.2.454.light.1.nb
actgctcagttaggacccagagggaaccatggaagccccagctcagcttctcttcctcctgctactctggctcccagataccaccggagaaattgtgttgacacagtctccggccaccctgtctgcgtctcctaggggaaacagtcaccctctcctgcagggccagtcaaaatattaacaactacttagcctggttccaacagaaacctggccaggctcccaggctcctcatctatgatgcatttaggagggccactggcatcccaccaggttcagtggcagtgggtctgggacagacttcattctcaccatccgcagcctagacgcctagaagtattttgctagtttattact

SEQ ID NO: 296569 - DNA, 346 bp, Homo sapiens
  misc_feature: NA.11.58.F03.1.454.light.1.nb
ctgagaacacttagccttcatgagtgtccccaccatggcctggatgatgcttctcctcggactccttgcttatgggtcaggagtggattctcaggctttggtgacccaggagccatcgttctcagtgtcccctggaggacactcacactcacttgtggcttgagatacgggtcagtctctgttaattactaccccagttggtaccgacagaccccaggccagcctccacgcacgctcatttataacacaaagactcgctcttctgggtccctaatcgcttctctggctccatccttgggaacaaagctcgccctcaccatcgacggggcccaggcagatgatgaat

SEQ ID NO: 296570 - DNA, 286 bp, Homo sapiens
  misc_feature: NA.11.60.F05.1.454.light.1.nb
tgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcacatctgtctcatc

SEQ ID NO: 296571 - DNA, 123 bp, Homo sapiens
  misc_feature: NA.11.66.F11.1.454.light.1.nb
acaatcggccctactacggtatggacgtctggggccaagggaccacggtcaccgtctcctcagcctccaccaagggcccatcggtcttcccctggcaccctcctccaagagcacctctggggg

SEQ ID NO: 296572 - DNA, 303 bp, Homo sapiens
  misc_feature: NA.11.67.G01.2.454.light.1.nb
gaagacaggactcaggacaatctccagcatggccagcttccctctcctcctcaccctcctcactcactgtgcagggtcctgggcccagtctgttctgactcagccaccctcagcgtctgggacccccggagagaatcaccatctcttgtactggaagcagctccaatatcggaagtaacgatgtcaattggtatcaacatctccccggtacggcccccaaactcctcatctataggaatagccagcggccctcgacggggtccctggccgattctctggctcgaagtctggcacctcagcctc

SEQ ID NO: 296573 - DNA, 227 bp, Homo sapiens
  misc_feature: NA.11.7.A07.1.454.light.1.nb
gagcgattctctggctccaactctgggaacacagccactctgaccatcagcgggacccaggctatggatgaggctgactattactgtcaggcgtgggacagcttcactgatgtggtattcggcggagggaccaagctgaccgtcctaggtcagcccaaggctgccccctggtcactctgttcccaccctcctcgtatctctcgctgagcgggctggcaaggcgcata

SEQ ID NO: 296574 - DNA, 375 bp, Homo sapiens
  misc_feature: NA.11.71.G05.1.454.light.1.nb
  modified_base (140)..(140): a, c, t, g, unknown or other
  misc_feature (140)..(140): n is a, c, g, or t
tgctcagttaggacccagagggaaccatggaagccccagctcagcttctcttcctcctgctactctggctcccagatagcaccggagaaattgtgttgacacagtctccagccaccctgtctttgtctccgaggggaaanagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggatttgctagtttattactgtcagcagcgtatcgactggatcacc

SEQ ID NO: 296575 - DNA, 363 bp, Homo sapiens
  misc_feature: NA.11.73.G07.1.454.light.1.nb
caaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccacgaggttcagtggaagtggatctgggacagactttactctcaccatcagcagcctgcagcctgaagatattgcaacatattactgtacaacagtatgatcgtctc

SEQ ID NO: 296576 - DNA, 203 bp, Homo sapiens
  misc_feature: NA.11.74.G08.1.454.light.1.nb
agcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacattggtgttataactatgtctcctggtaccaacaacacc

SEQ ID NO: 296577 - DNA, 221 bp, Homo sapiens
  misc_feature: NA.11.75.G09.1.454.light.1.nb
tctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctggtcactctgttcccgccctcctcgtatctctcgctgagcgggctggcaaggcgcata

SEQ ID NO: 296578 - DNA, 386 bp, Homo sapiens
  misc_feature: NA.11.76.G10.1.454.light.1.nb
caggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttatgggcatctactcgggattccggggtccctgaccgattccgtggcagtggatctgggacaaatttcactctcaccatcaatagcctgcaggctgaagatgtggcagcttattattgtcagcaatattatacttctcttcgatctacttt

SEQ ID NO: 296579 - DNA, 294 bp, Homo sapiens
  misc_feature: NA.11.80.H03.1.454.light.1.nb
tcttgtgcagggccagtcagagtgttcttgccaagtacttggcctggtaccagcacaaacctggccaggctcccaggctcctcattcatggtgcatccaatagggccactggcatcccagccagattcactggcggtgggtctgggacagacttcactctcaccatcaacagactgcaggctgaagattttgcaagtttatttctgtcagttattatggtgtctcgaccggggtacgttcggccagggggagcgaagggtggaaatcaaacgaactgtggctgcacatctgtct

SEQ ID NO: 296580 - DNA, 420 bp, Homo sapiens
  misc_feature: NA.11.86.H09.1.454.light.1.nb
gctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacacctgaatggtccttgtgtggtttcggcggagggaccaagc

SEQ ID NO: 296581 - DNA, 375 bp, Homo sapiens
  misc_feature: NA.12.1.A01.1.454.light.1.nb
gagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgctaacttattactgtcaacagacgtaacacgtta

SEQ ID NO: 296582 - DNA, 310 bp, Homo sapiens
  misc_feature: NA.12.1.A01.2.454.light.1.nb
acagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctg

SEQ ID NO: 296583 - DNA, 217 bp, Homo sapiens
  misc_feature: NA.12.1.A01.3.454.light.1.nb
gcaggcacacaacagaggcagttccagatttcactctcaccatcagcagtctgcaacctgaagattctgcaacttattactgtcaacagagtaacagttaccctcccactttcggcggagggaccaaggtggagatcaaacgactgtggctgcaccatctgtcttcatcttcccgccatctgatacgtcgtatctgagcgggctggcaaggcgcata

SEQ ID NO: 296584 - DNA, 348 bp, Homo sapiens
  misc_feature: NA.12.10.A10.1.454.light.1.nb
cagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaaagcccctaacgtcctgatctatggtgcatccactttgcatagtggggtcccatcaaggttcagcggcagtggatctgggacagaattcactctcacaatcacagcctgcagcctagaagtattttgctaacttattactgta

SEQ ID NO: 296585 - DNA, 382 bp, Homo sapiens
  misc_feature: NA.12.11.A11.2.454.light.1.nb
agcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggcaaaaaacggccctcggggatttctaatcgcttctctggctccaagtctggcaacacggcctccctgacaatctctgggctccaggctgaggacgaggctgattattactgctgctcatatgcaggtagtggcactttcgcact

SEQ ID NO: 296586 - DNA, 211 bp, Homo sapiens
  misc_feature: NA.12.12.B01.2.454.light.1.nb
aggcagagctctgggaatctcaccatggcctggacccctctcctgctccccctcctcactttctgcacagtctctgaggcctcctatgagctgacacagccaccctcggtgtcagtcgtccccaggacaaacggccaggatcacctgctctggagctgcattgccaaataaaatctaccttattggtaccagcagaagtcaggccaggccc

SEQ ID NO: 296587 - DNA, 220 bp, Homo sapiens
  misc_feature: NA.12.13.B02.1.454.light.1.nb
agttaggacccagagggaaccatggaaaccccagcgcagcttctcttcctcctgctactctggctcccagagaccaccggagaaattgtgttgacgcagtctccaggcaccctgtctttatctccgaggggaaagagccaccctctcctgcagggccagtgagaatgttaacaacaggtatctggcctggtaccagcagaaacctggccaggctcccagg

SEQ ID NO: 296588 - DNA, 315 bp, Homo sapiens
  misc_feature: NA.12.18.B07.1.454.light.1.nb
taggacccagagggaaccatggaagccccagctcagcttctcttcctcctgctactctggctcccagataccaccggagaaattgtgttgactcagtctccagccaccctgtctttgtctccaggggaaaagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagacg

SEQ ID NO: 296589 - DNA, 273 bp, Homo sapiens
  misc_feature: NA.12.19.B08.1.454.light.1.nb
  modified_base (156)..(156): a, c, t, g, unknown or other
  misc_feature (156)..(156): n is a, c, g, or t
atgggctggtcgcaccctgtgcaggagtcagtctcagtcaggacacagcatggacatgagggtccccgctcagctcctggggctcctgctactctggctccgagatgtgacatccagatgacccagtctccatcctccctgtctgcatcgtggganacagagtcaccatcacttgccgggcaagtcagaggattagcagttatttaaattggtgtcagcagaagccgagggagacgacccctaaggtcctgatctatgcttcatccagtttgc

SEQ ID NO: 296590 - DNA, 231 bp, Homo sapiens
  misc_feature: NA.12.19.B08.2.454.light.1.nb
gatcgcttctctggctccaagtctggcaacacggcctccctgaccgtctctgggctccaggctgaggatgaggctgattattactgcagctcatatgcaggcagcaactagttttgtcttcggaactgggacccaggtcaccgtcctaggtcagcccaaggcccaaccccactgtcactctcgttcccaccctcctctacgtcgtatctgagcgggctggcaaggcgcata

SEQ ID NO: 296591 - DNA, 263 bp, Homo sapiens
  misc_feature: NA.12.21.B10.1.454.light.1.nb
acaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgtattttggaaattttgacctagtctcctggtaccaacaataccccggcaaagtccccaagttaatcatttatgagggcactaagcggccctc

SEQ ID NO: 296592 - DNA, 77 bp, Homo sapiens
  misc_feature: NA.12.22.B11.2.454.light.1.nb
tatgcgccttgccagcccgctcagatacgacgtaggaagtagtccttgaccaggcagcccagggccgctgtgccccc

SEQ ID NO: 296593 - DNA, 82 bp, Homo sapiens
  misc_feature: NA.12.22.B11.4.454.light.1.nb
caaacgaactgtggctgcaccatctgtcttcatcttcccgccatctgatacgtcgtatctgagcgggctggcaaggcgcata

SEQ ID NO: 296594 - DNA, 364 bp, Homo sapiens
  misc_feature: NA.12.23.C01.1.454.light.1.nb
  modified_base (139)..(139): a, c, t, g, unknown or other
  misc_feature (139)..(139): n is a, c, g, or t
tgctcagttaggacccagacggaaccatggaagccccagcgcagcttctcttcctcctgctactctggctcccagataccactggagaaatagtgatgaagcagtctccagccaccctgtctgtgtctccaggggaaangccaccctctcctgcagggccagtcagagtgttaatagcgacttagcctggtaccagcagatacctggccaggctcccaggctcctcatctatggtgcatctaccagggccactggtactcccagccaggttcagtggcagtgggtctgggacagagttcactctcaccatcagcagcctgcagtctgaagtattttgctagtttattactgtcagcagtataat

SEQ ID NO: 296595 - DNA, 202 bp, Homo sapiens
  misc_feature: NA.12.23.C01.2.454.light.1.nb
  modified_base (44)..(44): a, c, t, g, unknown or other
  misc_feature (44)..(44): n is a, c, g, or t
ttgacgcagtctccaggcaccctgtctttatctccaggggaaanagccaccctctcctgcagggccagtgagaatgttaacaacaggtatctggcctggtaccagcaagaacctggccaggctcccaggcctcctcatgtacgttactccagcagggccactggcatcccagacaggttcactggcaggtgggtctgggaca

SEQ ID NO: 296596 - DNA, 348 bp, Homo sapiens
  misc_feature: NA.12.26.C04.1.454.light.1.nb
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatcaactccaacaatgagaactacttagcttggtaccagcagaaaccaggacagccgcccaagttgctcatttactgggcatctacccgggaatccggggtcctgaccgattcagtggcagcggtctgagacagatttcactctcaccatcagcagcctgcaggccgaagatgtggc

SEQ ID NO: 296597 - DNA, 105 bp, Homo sapiens
  misc_feature: NA.12.26.C04.2.454.light.1.nb
agactgacggtccccaggagttcaggtgctgggcacagcggccctgggctgcctggtcaaggactacttcctacgtcgtatctgagcgggctggcaaggcgcata

SEQ ID NO: 296598 - DNA, 226 bp, Homo sapiens
  misc_feature: NA.12.3.A03.2.454.light.1.nb
gggtagagaagacaggactcaggacaatctccagcatggccagcttccctctcctcctcaccctcctcactcactgtgcagggtcctgggcccagtctgtgctgactcagccaccctcagcgtcgtgggacccccgggcaggagggtcaccatttcttgttctggaacccactccaacatcggatataattctgtagactggtaccagcagcttccaggacgccgg

SEQ ID NO: 296599 - DNA, 87 bp, Homo sapiens
  misc_feature: NA.12.30.C08.2.454.light.1.nb
tatgcgccttgccagcccgctcagatacgacgtatcagatggcgggaagatgaagacagatggtgcagccacagttcgtctgatttc

SEQ ID NO: 296600 - DNA, 359 bp, Homo sapiens
  misc_feature: NA.12.31.C09.1.454.light.1.nb
  modified_base (306)..(306): a, c, t, g, unknown or other
  misc_feature (306)..(306): n is a, c, g, or t
aggtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtggttcccgtcaaggttcactggccgtggatcagggacagaatttacnctcaccatcagtagtctacagcctgaagatattgcttacttattactgtcagc

SEQ ID NO: 296601 - DNA, 339 bp, Homo sapiens
  misc_feature: NA.12.37.D04.1.454.light.1.nb
  modified_base (304)..(304): a, c, t, g, unknown or other
  misc_feature (304)..(304): n is a, c, g, or t
tcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaatggtttcagcaagaaaccagggaaagcccctagactcctgattcacgaggcatccaattcggaaatagggtcccagaaggttcagtggaggtggagctgggacagtatttacccnaccatcagcagcctgcagcctgaagatcttgcaac

SEQ ID NO: 296602 - DNA, 226 bp, Homo sapiens
  misc_feature: NA.12.37.D04.2.454.light.1.nb
cccctcaagatttcatggcgacttttctgggacaaatttcaccctctccatcagcggtctggaacccgatgactttggaaagtattactgccatcagactcacattttccctccgacgttcggccaagggaccatagtggctctcaggcgaactgtggctgcaccatctgtcttcatcttcccgccatctgatacgtcgtatctgagcgggctggcaaggcgcata

SEQ ID NO: 296603 - DNA, 346 bp, Homo sapiens
  misc_feature: NA.12.39.D06.1.454.light.1.nb
caggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttcgccacccggctctctggagtgccagatatgttcagtggctgcggtca

SEQ ID NO: 296604 - DNA, 213 bp, Homo sapiens
  misc_feature: NA.12.41.D08.1.454.light.1.nb
accctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgattttgctactgtattattgtcagca

SEQ ID NO: 296605 - DNA, 20 bp, Homo sapiens
  misc_feature: NA.12.41.D08.2.454.light.1.nb
ctataataattggcctcgga

SEQ ID NO: 296606 - DNA, 113 bp, Homo sapiens
  misc_feature: NA.12.41.D08.3.454.light.1.nb
tatgcgccttgccagcccgctcagatacgacgtatcagatgcgggaagatgaagacagatggtgcagccacagttcgtttcatctccagcttggtcccctggccaaagtgtac

SEQ ID NO: 296607 - DNA, 15 bp, Homo sapiens
  misc_feature: NA.12.41.D08.4.454.light.1.nb
ggtgcgctaccatac

SEQ ID NO: 296608 - DNA, 357 bp, Homo sapiens
  misc_feature: NA.12.48.E04.1.454.light.1.nb
ctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggacgccggccccccgactcctcatctttaataacaatcagcggccctcgacggggtccctgaccgattctctggctccaagtctggcacctcagcctccctggccatcagtgggctccagtctgaggatgaggctg

SEQ ID NO: 296609 - DNA, 333 bp, Homo sapiens
  misc_feature: NA.12.49.E05.1.454.light.1.nb
agtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaatttttagcctggtatcagcagaaaccagggaaagttccacacctcctgatctatgctgcatccgctttgcaatcagggtcccatctcggttcagcggcagtggatcgtgggacagagttcactctcaccatcagcagcctgcagcctgaag

SEQ ID NO: 296610 - DNA, 239 bp, Homo sapiens
  misc_feature: NA.12.5.A05.1.454.light.1.nb
agcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactatttctcctggtaccagcaacaccaggcaaacgcccccaaactcctcatttatggtgtc

SEQ ID NO: 296611 - DNA, 359 bp, Homo sapiens
  misc_feature: NA.12.50.E06.1.454.light.1.nb
agctgctcagttaggacccagagggaaccatggaaaccccagcgcagcttctcttcctcctgctactctggctcccagataccaccggagaaattgtgttgacgcagtctccaggcaccctgtctttgtctccgggggaaagtcaccctctcctgcagggccagtcagagtgttagcggcaactacttagcctggtaccaacagaaacctggccaggctcccaggctcgtcatctatggtgcatccagcagggccactggcatcccagccaggttcagtggcagtgggtctggggcagacttcactctcaccatcagcagactggagcctgaagatttgcagtttattactgtcagcag

SEQ ID NO: 296612 - DNA, 468 bp, Homo sapiens
  misc_feature: NA.12.53.E09.1.454.light.1.nb
ctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagctactttcgatgtcctattcggcggagggaccaagctgaccgtcctgggtcagcccaaggctgccccctggtcactctgttcccaccctcctctacgtcgtatctgagcggctggcaaggcgcata

SEQ ID NO: 296613 - DNA, 121 bp, Homo sapiens
  misc_feature: NA.12.53.E09.2.454.light.1.nb
caggaagcagcatcggaggtgcctcagccatggcatggatccctctcttcctcggcgtccttgcttactgcacaggttccgtggcctcgtatgacctgactcagccaccctctgtgtccgt

SEQ ID NO: 296614 - DNA, 123 bp, Homo sapiens
  misc_feature: NA.12.55.E11.2.454.light.1.nb
gtgcccccacgaggtggctcctggagcagggcggccaggggaagaccgatgggccttggtggaagccgaggagacagtgaccagggtgcccagcacctgaactcctgggaggaccgtcagtct

SEQ ID NO: 296615 - DNA, 107 bp, Homo sapiens
  misc_feature: NA.12.55.E11.3.454.light.1.nb
agactgacggtcctcccaggagttcaggtgctgggcacagcggccctgggctgcctggtcaaggactacttcctacgtcgtatctgagcgggctggcaaggcgcata

SEQ ID NO: 296616 - DNA, 262 bp, Homo sapiens
  misc_feature: NA.12.57.F02.1.454.light.1.nb
ggggagtctgcaccatggcttggaccccactcctcttcctcaccctcctcctccactgcacagggtctctctcccaacttgtggtgactcaatcgccctctgcctctgcctctctgggagcctcggtcaagctcacctgcactctgagcagtgggcacactaccttcgccatcgcctggcatcaacaacagccagagagggccctgatacttgatgattgtaacagtgatggcagccaacgaacgaagggggacggatcccg

SEQ ID NO: 296617 - DNA, 195 bp, Homo sapiens
  misc_feature: NA.12.66.F11.1.454.light.1.nb
caccctctcctgcagggccagtcagagtattagcaccaacctagcctggtatcaggagaaacctggccagactcccagacttctcatctatgctgcatcctccaggtccactgacatcccagacaggttcagtggcagtgggtctgggacagacttcactctcaccatcaccagactgcagtctgatgtattttg

SEQ ID NO: 296618 - DNA, 158 bp, Homo sapiens
  misc_feature: NA.12.67.G01.1.454.light.1.nb
tcaggaggcagcgctctcgggacgtctccaccatggcctgggctctgctattcctcaccctcctcactcaggcacagggtcctgggcccagtctgccctgactcagcctgcctccgtgtctgggtctcctggacagtcgatcaccatctcctgcactg

SEQ ID NO: 296619 - DNA, 178 bp, Homo sapiens
  misc_feature: NA.12.67.G01.2.454.light.1.nb
gaaccagcagtgacgttggtgttataactatgtctcctggtaccaacagcacccaggcagacgcccccaaatcatgtatttttgatgtcactaatcggccctcaggggtttctgatcgcttctctggctccaagtctgactacacggcctccctgaccatctctggctccaggctgag

SEQ ID NO: 296620 - DNA, 236 bp, Homo sapiens
  misc_feature: NA.12.67.G01.3.454.light.1.nb
  modified_base (209)..(209): a, c, t, g, unknown or other
  misc_feature (209)..(209): n is a, c, g, or t
ggaccagcagtgatgttgggacttataaccttgtctcctggtaccaacaacacccaggcaaacgccccaaactcatgatttatgagggcactaagcggccctcaggggtttcttatcgcttctctggctccgagtctggcaacacggcctccctgacaatctctgggctccaggctgaggacgaggcggattattactgttgctcatangcgggtagtgcactttcgattgtccta

SEQ ID NO: 296621 - DNA, 70 bp, Homo sapiens
  misc_feature: NA.12.71.G05.1.454.light.1.nb
aagaggcagcgctctcgggacgcctccaccatggcctgggctctgctgctcctcactctcctcactcagg

SEQ ID NO: 296622 - DNA, 94 bp, Homo sapiens
  misc_feature: NA.12.71.G05.2.454.light.1.nb
acacagggtcctgggcccagtctgccctgactcagcctgcctccgtgtctgggtctcctggacagtcgatcaccgtctcctgcactgggaccag

SEQ ID NO: 296623 - DNA, 155 bp, Homo sapiens
  misc_feature: NA.12.71.G05.4.454.light.1.nb
cagtgatgttggacttataaccttgtctcctggtaccaacaacacccaggcaaagcccccaaactcatgatttatgaggcactaagcggccctcaggggtttcttatcgcttctctggctccaagtctggcaacacggcctccctgacaatctct

SEQ ID NO: 296624 - DNA, 232 bp, Homo sapiens
  misc_feature: NA.12.71.G05.5.454.light.1.nb
cacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaacgccccccaactcctgatttagaggtcactattcggtcctcaggtaatttctaatcgcttctctggttccaagtctggcaacac

SEQ ID NO: 296625 - DNA, 148 bp, Homo sapiens
  misc_feature: NA.12.71.G05.7.454.light.1.nb
cacagggtcctgggcccagtctgccctgactcagcctgcctccgtgtctgggtctcctggacagtcgatcaccatctcctgcactggaaccagcagtgacgttggtggttataactatgtctcctggtaccaacagcacccgaggcag

SEQ ID NO: 296626 - DNA, 367 bp, Homo sapiens
  misc_feature: NA.12.78.H01.2.454.light.1.nb
gcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtcgtatctgagcgggctggcaaggcgcata

SEQ ID NO: 296627 - DNA, 362 bp, Homo sapiens
  misc_feature: NA.12.8.A08.1.454.light.1.nb
gcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcgccctctggggtccctgagcgattctctggctccgactctgggaacacagtcactctgaccatcagcggacccaggctatgatgaggctgtctactactgtcaggcgtgggacagcagcgtggtg

SEQ ID NO: 296628 - DNA, 283 bp, Homo sapiens
  misc_feature: NA.12.8.A08.2.454.light.1.nb
  modified_base (162)..(162): a, c, t, g, unknown or other
  misc_feature (162)..(162): n is a, c, g, or t
cgtatgacctgactcagccaccctctgtgtccgtgtccccaggacagacagtcacaatctcatgctctggagatgcattgggggaaaatttgctttctggtatcagcagaagccaggccagtcccctgtcttggtcatctataaggatagcaggcggccctnagggattcctgagcgattctccggctccaactccggcaacacagccactctgaccatcagcggacccaggctctcgatgaggctgactattactgccaggcgtgggacagctccacttccg

SEQ ID NO: 296629 - DNA, 89 bp, Homo sapiens
  misc_feature: NA.12.80.H03.1.454.light.1.nb
tcgtcctaggtcagcccaaggccaaccccactgtcactctgttcccaccctcctctacgtcgtatctgagcgggctggcaaggcgcata

SEQ ID NO: 296630 - DNA, 318 bp, Homo sapiens
  misc_feature: NA.12.82.H05.1.454.light.1.nb
gttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtggtctgggacagacttcactctcaccatcaccagactgga

SEQ ID NO: 296631 - DNA, 203 bp, Homo sapiens
  misc_feature: NA.12.85.H08.1.454.light.1.nb
gaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaac

SEQ ID NO: 296632 - DNA, 378 bp, Homo sapiens
  misc_feature: NA.12.86.H09.1.454.light.1.nb
  modified_base (139)..(139): a, c, t, g, unknown or other
  misc_feature (139)..(139): n is a, c, g, or t
tgctcagttaggacccagagggaaccatggaagccccagctcagcttctcttcctcctgctactctggctcccaggtgccaccggagaaattctgttgacacagtctccagccaccctgtctttgtctccaggggaaanagccaccttctcctgcagggccagtcagagtcttagcacctacttagcctggtaccaacagaaacctggccaggctcccaggctcctcatctatgatgcatccaaaagggccactggcatcccagccaggttcagtggcagtggtctggggcagacttcactctcaccatcagcagcctagagcctgaagtattttgctagtttattactgtcagcagcgtagcaactggcctcggttc

SEQ ID NO: 296633 - DNA, 491 bp, Homo sapiens
  misc_feature: NA.12.87.H10.1.454.light.1.nb
tcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcgccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactgtcactctgttcccgccctcctctacgtcgtatctgagcgggctggcaaggcgcata

SEQ ID NO: 296634 - DNA, 79 bp, Homo sapiens
  misc_feature: NA.13.10.A10.1.454.light.1.nb
ctggctccaactctgggaacacagccactctgaccatcagcgggacccagcctatggatgaggctgactattactgtca

SEQ ID NO: 296635 - DNA, 142 bp, Homo sapiens
  misc_feature: NA.13.10.A10.2.454.light.1.nb
ggcgtgggacagcagcactgcccgctatgtcttcggaactgggaccaaggtcaccgtcctaagtcagcccaaggccaaccccactgtcactctgttcccaccctcctctagtacgtgactgagcgggctggcaaggcgcata

SEQ ID NO: 296636 - DNA, 389 bp, Homo sapiens
  misc_feature: NA.13.10.A10.4.454.light.1.nb
cacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggacaaagctgcccttatcatcacggggcccaggcagaagatgaatctgattattactgtgttctttatatgggtagtgcctatttctgtctgtgtt

SEQ ID NO: 296637 - DNA, 481 bp, Homo sapiens
  misc_feature: NA.13.11.A11.1.454.light.1.nb
gttaggacccagagggaaccatggaaaccccagcgcagcttctcttcctcctgctactctggctcccagataccaccggagaaattgtgttgacgcagtctccaggcatcgtgtctttgtctccgaggggaaagccaccctctcctgcagggccagtcagattgtcagcagcaactacttagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgatagtacgtgactgagcgggctggcaaggcgcata

SEQ ID NO: 296638 - DNA, 413 bp, Homo sapiens
  misc_feature: NA.13.11.A11.2.454.light.1.nb
accatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgttgacttggcacaacaacgcctggatcttcggacctgggaccacggtcaccgtcctaggtcagccc

SEQ ID NO: 296639 - DNA, 252 bp, Homo sapiens
  misc_feature: NA.13.11.A11.4.454.light.1.nb
ctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccaagggaccaaggtggaaatcaaacgaactgtggctgcacatctgtcttcatcttcccgcatctgatagtcgtgactgagcgggctggcaaggcgcat

SEQ ID NO: 296640 - DNA, 222 bp, Homo sapiens
  misc_feature: NA.13.11.A11.6.454.light.1.nb
cagcaactacttagcctggtaccagcaaaggcctggccaggctcccaggcgcctcatctatgctgcttccagtagggccactggcgtcccagacaggttcagtggcagtgggtctgggacagacttcaccctcaccatcagcagactggagcctgaagattttgcagtctattactgtcagcagtatggtagccgaaagacgttcggccaagggaccaaggt

SEQ ID NO: 296641 - DNA, 161 bp, Homo sapiens
  misc_feature: NA.13.11.A11.7.454.light.1.nb
atggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacga

SEQ ID NO: 296642 - DNA, 142 bp, Homo sapiens
  misc_feature: NA.13.11.A11.8.454.light.1.nb
  modified_base (103)..(103): a, c, t, g, unknown or other
  misc_feature (103)..(103): n is a, c, g, or t
ctatggtgcatccaccagggccactggtatcccagaccggttcagtggcagtgggtctgggacagacttcactctcaccatcagcagtctgcagtctgaagtnttttgctagttttattactgtcagcagtataataactgg

SEQ ID NO: 296643 - DNA, 131 bp, Homo sapiens
  misc_feature: NA.13.11.A11.9.454.light.1.nb
tgaggcatcccttccagaagtcactatacagtaggagacatgcaaatggggtcctccctctgccgatgaaaaccagcccagccctgaccctgcagctcgtgggagaggagccccagccctgagtacttccc

SEQ ID NO: 296644 - DNA, 224 bp, Homo sapiens
  misc_feature: NA.13.12.B01.2.454.light.1.nb
cagacagattcagcggcagtgggtcaggcactgatttcacattgaaaatcaccagggtggaggctgaggatgttgggatttattactgcatgcaagctacattctggcctttcactttcggccctgggaccaaagtggataccaatcgaactgtggctgcaccatctgtcttcatcttcccgccatctgatagtacgtgactgagcgggctggcaaggcgcata

SEQ ID NO: 296645 - DNA, 156 bp, Homo sapiens
  misc_feature: NA.13.12.B01.3.454.light.1.nb
gatgaggctgcctattattgtcaggcgtggtacaatgacgcggttttcggcggagggacgacgctgaccgtcctaagtcagcccaaggctgccccctcggtcactctgttcccgccctcctctagtacgtgactgagcgggctggcaaggcgcata

SEQ ID NO: 296646 - DNA, 281 bp, Homo sapiens
  misc_feature: NA.13.15.B04.1.454.light.1.nb
gctgtgtccaccatggcctggactcctcttcttctcttgctcctctctcactgcacaggttccctctcccagcctgtgctgactcagccaccttcctcctccgcatctcctggagaatccgccagactcacctgcaccttgcccagtgacatcaatgttggtagctacaacatatactggtaccagcagaagccagggagccctcccaggtatctcctgtactactactcagactcagataagggccagggctctggacgtccccagcccgcttctctgga

SEQ ID NO: 296647 - DNA, 201 bp, Homo sapiens
  misc_feature: NA.13.19.B08.1.454.light.1.nb
  modified_base (170)..(170): a, c, t, g, unknown or other
  misc_feature (170)..(170): n is a, c, g, or t
agagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgaacaaaaaaatntgctcggtggttccagcagaagccaggccag

SEQ ID NO: 296648 - DNA, 316 bp, Homo sapiens
  misc_feature: NA.13.2.A02.1.454.light.1.nb
caccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaacgaactgtggctgcacatctgtcttcatctcccgcatctgatagtacgtga

SEQ ID NO: 296649 - DNA, 238 bp, Homo sapiens
  misc_feature: NA.13.20.B09.1.454.light.1.nb
agaccgattctctggctccagctcaggaaacacagcttccttgaccatcactggggctcaggcggaagatgaggctgactattactgcaactcccgggacagcagtggtaaacatttcaatgtgttattcggcggagggaccaagctgaccgtcctcggtcagcccaaggctgccccctcggtcactctgttcccaccctcctctagtacgtgactgagcgggctggcaaggcgcata

SEQ ID NO: 296650 - DNA, 214 bp, Homo sapiens
  misc_feature: NA.13.21.B10.1.454.light.1.nb
tgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattgggcagataaatatacttctggtatcagcagaagtcaggccagtccctgtgctggtcatctatcaa

SEQ ID NO: 296651 - DNA, 467 bp, Homo sapiens
  misc_feature: NA.13.23.C01.1.454.light.1.nb
gctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctgaaagcagctccaacaccggaactggtgatataaactggtaccagcagctcccaggaacggccccaaactcctcatctatactaataatcaccggccctcagggatccctgaccgattctctgcctccaagtctggcacctcagcctccctggccatcagtcggctccagtctgaggatgaggctgattattactgtgcagcatactatgacaccctgaatggtctttgggtgttcggcggagggaccaagctgaccgtctaggtcagccaaggctcgcccctcggtcactctcgttccca

SEQ ID NO: 296652 - DNA, 298 bp, Homo sapiens
  misc_feature: NA.13.23.C01.3.454.light.1.nb
tctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatgggtagtgcctattt

SEQ ID NO: 296653 - DNA, 87 bp, Homo sapiens
  misc_feature: NA.13.24.C02.1.454.light.1.nb
gaaatcaaacgaactgtggctgcaccatctgtcttcatcttcccgccatctgatagtacgtgactgagcgggctggcaaggcgcata

SEQ ID NO: 296654 - DNA, 86 bp, Homo sapiens
  misc_feature: NA.13.24.C02.2.454.light.1.nb
ggagccccagccctgagattcccaggtgtttccattcagtgatcagcactgaacacagaggactcaccatggagttgggactgagc

SEQ ID NO: 296655 - DNA, 54 bp, Homo sapiens
  misc_feature: NA.13.24.C02.3.454.light.1.nb
cctggtcaaggactacttcctagtacgtgactgagcgggctggcaaggcgcata

SEQ ID NO: 296656 - DNA, 347 bp, Homo sapiens
  misc_feature: NA.13.25.C03.1.454.light.1.nb
gaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaacggcccccagagtcatcatttatgggggcaataggcggccgtcagggatttccactcgcttctctggctccaagtctggcaacacggcctcctgacaatctctggtctccaggctgaggacgaggctg

SEQ ID NO: 296657 - DNA, 242 bp, Homo sapiens
  misc_feature: NA.13.28.C06.2.454.light.1.nb
ggccctcagggatccctgagcgattctcaggctccaattctgggaacacagccactctgaccatcagcgggacccaggctatggatgaggctgactattactgtcaggcgtgggacaacaacactgcgattttcggcggagggaccaagctgaccgtcctaggtcagcccaaggctgccccctcggtcactctgttcccgccctcctctagtacgtgactgagcgggctggcaaggcgcata

SEQ ID NO: 296658 - DNA, 343 bp, Homo sapiens
  misc_feature: NA.13.3.A03.1.454.light.1.nb
agcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacggggtcaataagcggccctcagggctttctgatcgcttctctggctcaagtctggcaacacggcctcctgacaatctctggactccaggccgaggacgaggctgtatttt

SEQ ID NO: 296659 - DNA, 246 bp, Homo sapiens
  misc_feature: NA.13.3.A03.2.454.light.1.nb
gagtcagacccactcaggacacagcatggacatgagggtccccgctcagctcctggggctcctgctgctctggctcccgaggtgccagatgtgccatccagatgacccagtctccatcctccctgtctgcatctgtaggagacagagtcaccatcacttgccgggcaagtcagggcattagaaatgatttaggctggtatcagcagaaaccgagggaaacgcccctaagctcttgatctatggtgc

SEQ ID NO: 296660 - DNA, 293 bp, Homo sapiens
  misc_feature: NA.13.30.C08.2.454.light.1.nb
gacccttgggctgatccttggtctcctgctcctcaggctcacctgggcccagtagtgactcactagagtgtgtttctccctctttccaggctcttgggcccagtctgccctgattcagcctcctcccgcgtccgagtctcttggtcagtcagtcaccatctcctaagctggagccagcagtgattttgggagttttgactctgtctcttgggtccagcaacacccagtcacaggccccaaagtcatgctgtgcaatgtcactcttcagtcctcaagagtccctgtactttttc

SEQ ID NO: 296661 - DNA, 87 bp, Homo sapiens; identical to SEQ ID NO: 296653
  misc_feature: NA.13.30.C08.3.454.light.1.nb

SEQ ID NO: 296662 - DNA, 156 bp, Homo sapiens
  misc_feature: NA.13.33.C11.5.454.light.1.nb
gaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcac

SEQ ID NO: 296663 - DNA, 353 bp, Homo sapiens
  misc_feature: NA.13.36.D03.2.454.light.1.nb
gagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagtatttg

SEQ ID NO: 296664 - DNA, 296 bp, Homo sapiens
  misc_feature: NA.13.36.D03.4.454.light.1.nb
acaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacggggtcaataagcggccctcagggctttctgatcgcttctctggctccaagtct

SEQ ID NO: 296665 - DNA, 488 bp, Homo sapiens
  misc_feature: NA.13.37.D04.1.454.light.1.nb
cagtaagcagcatcggaggtgcctcagccatggcatggatccctctcttcctcggcgtcctggcttactgctcagcctccatggcctcctataaggtgacccaggcaccctcagtgtccgtgcccccaggacagacagccatcatcacctgctctggagataaattgggggagaaatttgcttcctggtatcagaagaagccaggccagtcccctgtggtggtcatttatcaagataccaaacggccctcagggatccctgagcgattctctggttccaactctgggaatacagccactctgaccatcaacgggactcaggctatggatgaggctgactattactgtcaggtgtgggacagcaacacctatgtggtattcggcggagggaccaagctgaccgtcctaggtcagcccaaggctgccccctcggtcactctgttcccaccctcctctagtacgtgactgagcgggctggcaaggcgcata

SEQ ID NO: 296666 - DNA, 172 bp, Homo sapiens
  misc_feature: NA.13.37.D04.3.454.light.1.nb
caagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactaggaaacagcagtga

SEQ ID NO: 296667 - DNA, 387 bp, Homo sapiens
  misc_feature: NA.13.39.D06.1.454.light.1.nb
  modified_base (173)..(173): a, c, t, g, unknown or other
  misc_feature (173)..(173): n is a, c, g, or t
acaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggcagtttattactgtcagcaatattatagtactcctcga

SEQ ID NO: 296668 - DNA, 250 bp, Homo sapiens
  misc_feature: NA.13.39.D06.2.454.light.1.nb
ctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataattggcagataaatatacttcctggtatcagcagaagtcaggccagtcccctgtgctggtcatctatcaagatgccaagcggccc

SEQ ID NO: 296669 - DNA, 243 bp, Homo sapiens
  misc_feature: NA.13.39.D06.3.454.light.1.nb
ggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgtggtgttataactatgtctcctggtaccaacaacacccagcaaagcccccaaatcatgatttatg

SEQ ID NO: 296670 - DNA, 236 bp, Homo sapiens
  misc_feature: NA.13.39.D06.4.454.light.1.nb
gctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacaccggaactggtgatataaactggtaccagcagctcccaggaaccggcccccaaac

SEQ ID NO: 296671 - DNA, 179 bp, Homo sapiens
  misc_feature: NA.13.4.A04.1.454.light.1.nb
caaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactattt

SEQ ID NO: 296672 - DNA, 182 bp, Homo sapiens
  misc_feature: NA.13.4.A04.2.454.light.1.nb
aaattggtatcagcagaaaccaggtaaagcccctaagctcctgatctacgatgcatccaatttggaaacaggggtcccatcaaggttcagtggaagtggatcgtgggacagtattttacttcaccatcagcagcctgcagcctgaagatattgcaacatattactgtcagcagtatgataat

SEQ ID NO: 296673 - DNA, 145 bp, Homo sapiens
  misc_feature: NA.13.4.A04.3.454.light.1.nb
aggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaa

SEQ ID NO: 296674 - DNA, 87 bp, Homo sapiens
  misc_feature: NA.13.41.D08.2.454.light.1.nb
tatgcgccttgccagcccgctcagtcacgtactatcagatggcgggaagatgaagacagatggtgcagccacagttcgtttaatctc

SEQ ID NO: 296675 - DNA, 326 bp, Homo sapiens
  misc_feature: NA.13.42.D09.5.454.light.1.nb
  modified_base (136)..(136): a, c, t, g, unknown or other
  misc_feature (136)..(136): n is a, c, g, or t
tcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgttagcagcagctacttagcctggtaccagcagaaacctggccaggctcccaggctcctcatctatgtattcaggagggccactggcatcccagacaggttcagtggcagtgggtctgggacagacttcactctcaccatcagcagactggaacctgaag

SEQ ID NO: 296676 - DNA, 86 bp, Homo sapiens
  misc_feature: NA.13.42.D09.7.454.light.1.nb
aaatcaaacgaactgtggctgcaccatctgtcttcatcttcccgccatctgatagtacgtgactgagcgggctggcaaggcgcata

SEQ ID NO: 296677 - DNA, 365 bp, Homo sapiens
  misc_feature: NA.13.46.E02.4.454.light.1.nb
ctcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgca

SEQ ID NO: 296678 - DNA, 278 bp, Homo sapiens
  misc_feature: NA.13.46.E02.7.454.light.1.nb
actcctgctgctctggctctcaggtgccagatgtgacatccagatgacccagtctccatcctccctgtctgcatctgtaggagacagagtcaccatcacttgccaggcgagtcaggacattaacaactattaaattggtatcagcagaaaccaggtaaagcccctaagctcctgatctacgatgcatccaatttggaaacagggtcccatcaaggttcagtggaagtggatctgggacagtattttactttcacctatcagcagcctgcagcctgaag

SEQ ID NO: 296679 - DNA, 347 bp, Homo sapiens
  misc_feature: NA.13.48.E04.1.454.light.1.nb
tcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtcccatcaaggttcagcggcagtggatctggcacagacttcattctcaccatcagcagcctgcagcctgaagattttgctaacttatt

SEQ ID NO: 296680 - DNA, 383 bp, Homo sapiens
  misc_feature: NA.13.5.A05.1.454.light.1.nb
  modified_base (167)..(167): a, c, t, g, unknown or other
  misc_feature (167)..(167): n is a, c, g, or t
aggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtcctgaccgattcagtggcagcgggtctgggacagatttcactctcaccatcagcagcctgcaggctgaagatgtggcagtttattactgtcagcaatattatagtactcctcgagct

SEQ ID NO: 296681 - DNA, 334 bp, Homo sapiens
  misc_feature: NA.13.5.A05.2.454.light.1.nb
agaactctgggtgtctcaccatggcctggatccctctacttctccccctcctcactctctgcacagctctgaggcctcgtatgagctgacacagccactctcggtgtcagtgtccccaggacagacggccaggatcacctgctctgcagatgcattgccataacattttgcttattgctgtcagcagaaaccaggccaggccaggccaggcccctatacttcctgatataaaaagcattgaggggccctcagtgatccctgagcgattctctggctccatctcagggcaacagtcacgttgaccatcagtggagtccaggcagagggacgaggc

SEQ ID NO: 296682 - DNA, 159 bp, Homo sapiens
  misc_feature: NA.13.5.A05.4.454.light.1.nb
tcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcag

SEQ ID NO: 296683 - DNA, 155 bp, Homo sapiens
  misc_feature: NA.13.5.A05.6.454.light.1.nb
gccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcag

SEQ ID NO: 296684 - DNA, 318 bp, Homo sapiens
  misc_feature: NA.13.50.E06.1.454.light.1.nb
tgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggctcctcatttatggtgcatccacagggccactggcatcccagacaggttcagtggcaggtgggtctgggacagacttcactctcaccatcagcaga

SEQ ID NO: 296685 - DNA, 226 bp, Homo sapiens
  misc_feature: NA.13.50.E06.2.454.light.1.nb
gtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaagcaacagtgatattggtgttatacctatgtctcctggtaccaacagcacccaggacaaacg

SEQ ID NO: 296686 - DNA, 113 bp, Homo sapiens
  misc_feature: NA.13.51.E07.1.454.light.1.nb
tatgcgccttgccagcccgctcagtcacgtactaggaagtagtccttgaccaggcagcccagggccgctgtgcccccagaggtgctcttggaggagggtgccagggggaagac

SEQ ID NO: 296687 - DNA, 59 bp, Homo sapiens
  misc_feature: NA.13.53.E09.1.454.light.1.nb
tctcagtcaggacacagcatggacatgagggtccccgctcagctcctggggctcctgct

SEQ ID NO: 296688 - DNA, 267 bp, Homo sapiens
  misc_feature: NA.13.53.E09.2.454.light.1.nb
actctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtggatcccatcaaggttcagtggcagtagatctggaacagattttaccctcaccatcagggtctacagcctgaag

SEQ ID NO: 296689 - DNA, 238 bp, Homo sapiens
  misc_feature: NA.13.53.E09.3.454.light.1.nb
gctctggctcccaggtgccagatgtgacatccagatgacccagtctccatcctccctgtctgcatctgtaggagacagagtcaccatcacttgccggcagtcaggacattaaaactatttaggctggtatcagcagaaaccagggaaagccctaagctcctgatctatgtgcatccaatttggaaacaggggtcccatacaaggttcagtggaagtggatcgtgggacagtattttac

SEQ ID NO: 296690 - DNA, 339 bp, Homo sapiens
  misc_feature: NA.13.55.E11.1.454.light.1.nb
acacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtcccatcaaggttcagcggcagtggatctggcacagacttcattctcaccatcagcagcctgcagcctgaagtattttgactaacttattactgt

SEQ ID NO: 296691 - DNA, 337 bp, Homo sapiens
  misc_feature: NA.13.55.E11.2.454.light.1.nb
tgggccctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagacgcccaagacgggat

SEQ ID NO: 296692 - DNA, 321 bp, Homo sapiens
  misc_feature: NA.13.55.E11.3.454.light.1.nb
caggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaatcataatttatgatttcactaatcggccctcaggtgtatctaatcgcttcactggctccaagtctggcaacacggcctccctgaccatctct

SEQ ID NO: 296693 - DNA, 307 bp, Homo sapiens
  misc_feature: NA.13.55.E11.5.454.light.1.nb
actcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaagacctacttgaattggtttcagcagaggccaggccagtctccaaggcgcctaatttataattgtttttacccgggactcgtcggggtcccagacagattcagcggcagtgggtcaggcac

SEQ ID NO: 296694 - DNA, 342 bp, Homo sapiens
  misc_feature: NA.13.56.F01.1.454.light.1.nb
  modified_base (154)..(154): a, c, t, g, unknown or other
  misc_feature (154)..(154): n is a, c, g, or t
tcgtggggaggaactgctcagttaggacccagacggaaccatggaagccccagcgcagcttctcttcctcctgctactctggctcccagatactagtggagaaatagtgatgacgcagtctccagccaccctgtctgtgtctccaaggggaaanagccaaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtct

SEQ ID NO: 296695 - DNA, 363 bp, Homo sapiens
  misc_feature: NA.13.59.F04.1.454.light.1.nb
ctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcggggtccatctcggttcagtggcggtggatctaggacagaattcactctcaccatcaccaacctgcaccctgaagatgttggaagttattactgtcagacctatagtgt

SEQ ID NO: 296696 - DNA, 43 bp, Homo sapiens
  misc_feature: NA.13.6.A06.2.454.light.1.nb
actataccggggcgatattcgcgacctggacttctacttctac

SEQ ID NO: 296697 - DNA, 20 bp, Homo sapiens
  misc_feature: NA.13.6.A06.4.454.light.1.nb
agcgtagtaacgttcgtggg

SEQ ID NO: 296698 - DNA, 377 bp, Homo sapiens
  misc_feature: NA.13.6.A06.5.454.light.1.nb
cagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctcctggtaccaacaacacccaggcaaagccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtac

SEQ ID NO: 296699 - DNA, 19 bp, Homo sapiens
  misc_feature: NA.13.61.F06.4.454.light.1.nb
cccctggggcccgggaacc

SEQ ID NO: 296700 - DNA, 388 bp, Homo sapiens
  misc_feature: NA.13.67.G01.1.454.light.1.nb
acaggcaggcaggggcagcaagatggtgttgcagacccaggtcttcatttctctgttgctctggatctctggtgcccacgggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtgcagtttattactgtcagcaatattatagtactcctccgag

SEQ ID NO: 296701 - DNA, 88 bp, Homo sapiens
  misc_feature: NA.13.67.G01.6.454.light.1.nb
ggacatcaaacgaactgtggctgcaccatctgtcttcatcttcccgccatctgatagtacgtgactgagcgggctggcaaggcgcata

SEQ ID NO: 296702 - DNA, 61 bp, Homo sapiens
  misc_feature: NA.13.71.G05.3.454.light.1.nb
tgcacctcacactggacaccttctaaaatagcaacaaggaaaacccagctcagccccaatt

SEQ ID NO: 296703 - DNA, 266 bp, Homo sapiens
  misc_feature: NA.13.71.G05.7.454.light.1.nb
ctcagccatggcatggatccctctcttcctcggcgtccttgcttactgcacaggatccgtggcctcctatgagctgactcagccaccctcagtgtccgtgtccccaggacagacagccagcatcacctgctctggaaataaattgggggataaatatacttctggtatcagcagaagtcaggccagtcccctgtgctggtcatctatcaagataccaagcggccctcagggatccctgagcgattctctggctccaactctgggaa

SEQ ID NO: 296704 - DNA, 165 bp, Homo sapiens
  misc_feature: NA.13.73.G07.1.454.light.1.nb
cagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgat

SEQ ID NO: 296705 - DNA, 280 bp, Homo sapiens
  misc_feature: NA.13.73.G07.2.454.light.1.nb
cttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggtttcttctgtggtcttcggcggagggtccaaagtgaccgtcctaggtcagcccaaggctcgccccctggtcactctcgtt

SEQ ID NO: 296706 - DNA, 197 bp, Homo sapiens
  misc_feature: NA.13.73.G07.3.454.light.1.nb
  modified_base (186)..(186): a, c, t, g, unknown or other
  misc_feature (186)..(186): n is a, c, g, or t
gttgggacttatgaccttgtctcctggtaccgacaacacccaggcaaacgcccccaaactcattatttacggggtcaataagcggccctcagggctttctgatcgcttctctggctccaagtctggcaacacggcctccctgacaatctctggactccaggccgaggacgaggctgtatttttacngttgttcatat

SEQ ID NO: 296707 - DNA, 490 bp, Homo sapiens
  misc_feature: NA.13.76.G10.1.454.light.1.nb
tctctggaaaccacacagctcctcctgcagcagcccctgactgctgatttgcatcacgggccgctctttccagcaaggggataagagaggcctggaagaacctgcccagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccg

SEQ ID NO: 296708 - DNA, 383 bp, Homo sapiens
  misc_feature: NA.13.76.G10.3.454.light.1.nb
acttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatggtagtgcctatttctgctg

SEQ ID NO: 296709 - DNA, 229 bp, Homo sapiens
  misc_feature: NA.13.76.G10.4.454.light.1.nb
tggggtcccagagagattcagcggcagtgggtcaggcacttatttcacactgaaaatcgacagggtggaggctgaggatgctgggtctattactgcatgcaagctacacactggcctccgctcaccttcggccaagggacacgactggagatagaacgaactgtggctgcaccatctgtcttcatcttcccgccatctgatagtacgtgactgagcgggctggcaaggc

SEQ ID NO: 296710 - DNA, 112 bp, Homo sapiens
  misc_feature: NA.13.76.G10.6.454.light.1.nb
agcgctctcgggacgtctccaccatggcctgggctctgctgctcctcaccctcctcactcaggacacagggtcctgggcccagtctgccctgactcagcctgcctccatgtc

SEQ ID NO: 296711 - DNA, 68 bp, Homo sapiens
  misc_feature: NA.13.76.G10.7.454.light.1.nb
agcagcatcggaggtgcctcagccatggcctggaccgctctcctgctgagcctccttgctcactttac

SEQ ID NO: 296712 - DNA, 274 bp, Homo sapiens
  misc_feature: NA.13.77.G11.1.454.light.1.nb
cctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctc

SEQ ID NO: 296713 - DNA, 109 bp, Homo sapiens
  misc_feature: NA.13.77.G11.2.454.light.1.nb
gggctccaactctgggaacacggccactctgaccatcagtagggtcgaagccgggatggaggccgactattactgtcaggtgtgggatagtagtcgtgagcatgtggta

SEQ ID NO: 296714 - DNA, 95 bp, Homo sapiens
  misc_feature: NA.13.77.G11.3.454.light.1.nb
tggctccaactctgggaactcagccactctgaccatcagcgggacccaggctatggatgaggctgactattactgtcaggcgtgggacagcagca

SEQ ID NO: 296715 - DNA, 219 bp, Homo sapiens
  misc_feature: NA.13.78.H01.3.454.light.1.nb
aggttcagcggcagtggatctggcacagacttcattctcaccatcagcagcctgcagcctgaagattttgcaacttattactgtctacaagatcacaattatcctgggacgttcggccaagggaccaaggtggaaatcaaacgaactgtggctgcaccatctgtcttcatcttcccgccatctgatagtacgtgactgagcgggctggcaaggcgcata

SEQ ID NO: 296716 - DNA, 235 bp, Homo sapiens
  misc_feature: NA.13.8.A08.1.454.light.1.nb
tggggtcccagagagattcagcggcagtgggtcaggcacttatttcacactgaaaatcgacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcata

SEQ ID NO: 296717 - DNA, 221 bp, Homo sapiens
  misc_feature: NA.13.8.A08.2.454.light.1.nb
ctggctccaacgaaggggacacggccaccctgaccatcagcagggtcgaagccggggatgaggccgactatttctgtcaggtgtgggacagtaatagtgatgaagtggttttcggcggcgggaccaagctgaccgtcctaggtcagcccaaggctgccccctcggtcactctgttcccaccctcctctagtacgtgactgagcgggctggcaaggcgcata

SEQ ID NO: 296718 - DNA, 87 bp, Homo sapiens; identical to SEQ ID NO: 296674
  misc_feature: NA.13.80.H03.1.454.light.1.nb

SEQ ID NO: 296719 - DNA, 72 bp, Homo sapiens
  misc_feature: NA.13.81.H04.1.454.light.1.nb
gatgaatctgattattactgtgttctttatatgggtagtgccatttctgctgtgttcggaggaggcacccgg

SEQ ID NO: 296720 - DNA, 94 bp, Homo sapiens
  misc_feature: NA.13.81.H04.10.454.light.1.nb
cagacaggttcagtggcagtgggtctgggacagacttcactctcaccatcagcacactggagcctgaagtatttttgcagtgtattactgtcag

SEQ ID NO: 296721 - DNA, 23 bp, Homo sapiens
  misc_feature: NA.13.81.H04.3.454.light.1.nb
ccccctcggtcactctgttcccg

SEQ ID NO: 296722 - DNA, 42 bp, Homo sapiens
  misc_feature: NA.13.81.H04.4.454.light.1.nb
tatgcgccttgccagcccgctcagtcacgtactagaggaggg

SEQ ID NO: 296723 - DNA, 23 bp, Homo sapiens
  misc_feature: NA.13.81.H04.5.454.light.1.nb
ccccatcggtcactctgttccca

SEQ ID NO: 296724 - DNA, 28 bp, Homo sapiens
  misc_feature: NA.13.81.H04.6.454.light.1.nb
ctgaccgtcctcggtcagcccaaggctg

SEQ ID NO: 296725 - DNA, 368 bp, Homo sapiens
  misc_feature: NA.13.81.H04.7.454.light.1.nb
tgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatatactcatctctgggctccagtctgacgatgaggctgactattactgtttgacttggcacaaca

SEQ ID NO: 296726 - DNA, 298 bp, Homo sapiens
  misc_feature: NA.13.81.H04.8.454.light.1.nb
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (293)..(293): a, c, t, g, unknown or other
  misc_feature (293)..(293): n is a, c, g, or t
ggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggccccaaatcatatttangatttcactaatcggccctnaggtntatctaatcgcttcactggctcaagtctggcaacncgcct

SEQ ID NO: 296727 - DNA, 224 bp, Homo sapiens; identical to SEQ ID NO: 296644
  misc_feature: NA.13.81.H04.9.454.light.1.nb

SEQ ID NO: 296728 - DNA, 121 bp, Homo sapiens
  misc_feature: NA.13.85.H08.2.454.light.1.nb
accattgggtgttcggcggagggaccaagctgaccgtcctaggtcagcccaaggctgcccctcggtcactctgttcccgccctcctctagtacgtgactgagcgggctggcaaggcgcata

SEQ ID NO: 296729 - DNA, 107 bp, Homo sapiens
  misc_feature: NA.13.86.H09.2.454.light.1.nb
gcggagggaccaagctgaccgtccttcgtcagcccaaggctgccccctcggtcactctgttcccgccctcctctagtacgtgactgagcgggctggcaaggcgcata

SEQ ID NO: 296730 - DNA, 105 bp, Homo sapiens
  misc_feature: NA.13.86.H09.3.454.light.1.nb
agactgacggtccccaggagttcaggtgctgggcacagcggccctgggctgcctggtcaaggactacttcctagtacgtgactgagcgggctggcaaggcgcata

SEQ ID NO: 296731 - DNA, 325 bp, Homo sapiens
  misc_feature: NA.13.87.H10.1.454.light.1.nb
ccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagacaaaaaccagggaaatccctaagctcctgatctatgttgcatccactttgcaaagtgggtcccatcaaggttcagcggcagtggatctgggacagaattcactctcacaatcagcagcctgcagcctgaag

SEQ ID NO: 296732 - DNA, 361 bp, Homo sapiens
  misc_feature: NA.14.11.A11.1.454.light.1.nb
cactcaggacacagcatggacatgagggtccccgctcagctcctggggctcctgctgctctggctcccaggtgccagatgtgccatccaagtgacccagtctccatccctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactgggtcccatcaaggttcagcggcagtggatctggcacagatttcactctcaccatcagcagcctgcagcctgaagtatttgactaacttattactgtactacaagtattac

SEQ ID NO: 296733 - DNA, 226 bp, Homo sapiens
  misc_feature: NA.14.12.B01.1.454.light.1.nb
tcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgactgtggctgcaccatctgtcttcatcttcccgccatctgagtactagacgctgagcgggctggcaaggcgcata

SEQ ID NO: 296734 - DNA, 219 bp, Homo sapiens
  misc_feature: NA.14.2.A02.2.454.light.1.nb
accgattcagtggcagcgggtctgggacagatttcactctcaccatcagcagcctgcaggctgaagatgtggcagtttattactgtcaacaatattataataatccatttaattcggcggagggaccaaggtggagatcaaacgaactgtggctgcaccatctgtcttcatcttcccgcatctgagtactagacgctgagcgggctggcaaggcgcata

SEQ ID NO: 296735 - DNA, 221 bp, Homo sapiens
  misc_feature: NA.14.22.B11.1.454.light.1.nb
tctggctccaagtctggcacgtcagccaccctgggcatcaccggactcctgactggggacgaggccgattattactgcggaacatgggatagtggcctaagtgtgggggtgttcggcggagggaccaggctgaccgtcctaggtcagcccaaggctgccccctggtcactctgttcccgccctcctcgtactagacgctgagcgggctggcaaggcgcata

SEQ ID NO: 296736 - DNA, 386 bp, Homo sapiens
  misc_feature: NA.14.23.C01.1.454.light.1.nb
gtgctcagttaggacccagacggaaccatggaagccccagcgcagcttctcttcctcctgctactctggctcccagataccactggagaaatagtgatgacgcagtctccagccaccctgtctgtgtctccaggggaaaagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagtattttgctagtttattattgtcagcagtataataactggcctcgtggacgttcgg

SEQ ID NO: 296737 - DNA, 386 bp, Homo sapiens
  misc_feature: NA.14.3.A03.1.454.light.1.nb
gcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaatcattatttatgaggtcaataatcggccctcaggagtttctaatcgcttctctggctccaagtctggcaacacggcctccctgagcatctctgggctccaggctgaggacgaggctgattattactgcagctcatatactattagctagaactgtggttttcg

SEQ ID NO: 296738 - DNA, 327 bp, Homo sapiens
  misc_feature: NA.14.30.C08.1.454.light.1.nb
tcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatccatcaaggttcagtggcggtggatcgtggggcgtatttcactctcaccatcagcagtctgcaacc

SEQ ID NO: 296739 - DNA, 504 bp, Homo sapiens
  misc_feature: NA.14.33.C11.1.454.light.1.nb
ctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccaccctcctcgtactagacgctgagcgggctggcaaggcgcata

SEQ ID NO: 296740 - DNA, 377 bp, Homo sapiens
  misc_feature: NA.14.35.D02.2.454.light.1.nb
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggctagtttatactgtcagcaatattata

SEQ ID NO: 296741 - DNA, 395 bp, Homo sapiens
  misc_feature: NA.14.36.D03.1.454.light.1.nb
tctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaatcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggtttc

SEQ ID NO: 296742 - DNA, 368 bp, Homo sapiens
  misc_feature: NA.14.42.D09.1.454.light.1.nb
tgcagacccaggtcttcatttctctgttgctctggatctctggtgcctacggggacatcgtgatgacccagtcgccagactccctggctgtgtctctgggcgagagggccaccatcaactgcaagtccagccagagtgttttaacacctccaacaataagaacctcttaaattggtaccagcaagaaaccaggacagcctcctaagctgctcgtttactgggcatcaacccgggaatctggggtccctgaccgattcagtggcagcgggtctgagacacatttcactctcaccatcagcagcctgcaggctgaagatgtggctagtttattactgtcaacagcattatactactccgtactactttgg

SEQ ID NO: 296743 - DNA, 343 bp, Homo sapiens
  misc_feature: NA.14.5.A05.1.454.light.1.nb
tgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctctgcgctcactttcggcggagggaccaaggtggagatcaaacgactgtggctgcacatctgtctcatc

SEQ ID NO: 296744 - DNA, 278 bp, Homo sapiens
  misc_feature: NA.14.53.E09.2.454.light.1.nb
gaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagtatttgttgacaaagcagtatgctttttggaccagcagaagccaggccaggcccctctcttgattatatataaggacactgagaggccctcagggatccctgagcgattctctggctcagctc

SEQ ID NO: 296745 - DNA, 361 bp, Homo sapiens
  misc_feature: NA.14.55.E11.1.454.light.1.nb
gtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtccctcaaggttcagtggcagtggatctgggacagatttcactctcaccgtcagcagtctgcaacctgaagtattttgactaacttactactgtcaacagtagttacacg

SEQ ID NO: 296746 - DNA, 349 bp, Homo sapiens
  misc_feature: NA.14.56.F01.1.454.light.1.nb
agacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgctaacttattactg

SEQ ID NO: 296747 - DNA, 482 bp, Homo sapiens
  misc_feature: NA.14.57.F02.2.454.light.1.nb
ctgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcactttcggcgggggaccaaggtggagttcaaacgaactgtggctgcaccatctgtcttcatcttcccgccatctgagtactagacgctgagcgggctggcaaggcgca

SEQ ID NO: 296748 - DNA, 400 bp, Homo sapiens
  misc_feature: NA.14.61.F06.1.454.light.1.nb
atgaacattctgtaggggccactgtcttctccacggtgctccctccgcgtccgggtctcctggacagtcagtcaccatctcctgcactggaaccagcagtgacgttggcacttatgactatatttcctggtaccaacaacacccaggcaaagcccccaaagtcgtgatttatgaggtccgtaagcggccctcgaggggtccctgatcgcttctctggttccaagtctggcaacacggcctccctgaccgtctctgggctccaggctgaggatgaggctcaatattactgcgcctcatatgaagccaataacaatttgcttttcggcggagggaccaagctgaccgtcctaggtcagccaaggctgcccctcggtcactctgttcccaccctcctcgtact

SEQ ID NO: 296749 - DNA, 365 bp, Homo sapiens
  misc_feature: NA.14.64.F09.1.454.light.1.nb
tcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagacaaaaaccagggaaagcccctaacctcctgatctttgatgcatccaatttgcagatgggtcccatcacgcttcactggcagtggctcgtgggacagatttcactctcaccatcagcggtctccaacctgaagtattttgcaacttactactgtcaacagagttatgataccccgt

SEQ ID NO: 296750 - DNA, 377 bp, Homo sapiens
  misc_feature: NA.14.66.F11.1.454.light.1.nb
agtggcccctacagaatgttcataggttcccaactctgaccccacccacgggagcctggacccctctctggctcgctctcctcactctttgcataggttctgtggtttcttctgagctgactcaggaccctgctgtgtctgtggccttgggacagacagtcaggatcacatgccaaggagacggcctcggaagctattatgcaagctggtaccagcagaagccaggacaggcccctgtacttgtcatctataggtaaaaacatccggccctcagggatcccagaccgattctctggctccaactcaggaaacacagcttcctgaccatcactgggctcaggcgaagatgaggctgactattactgtaattcccggga

SEQ ID NO: 296751 - DNA, 290 bp, Homo sapiens
  misc_feature: NA.14.76.G10.1.454.light.1.nb
acaaagagcttcaacaggggagagtgttagagggagaagtgcccccacctgctcctcagttccagcctgacccccctccatcaaggttcagcggcagtggatctgggacagaattcactctcactatcaccagcctgcaacctgatgattttgctaacttattactgccaacagtatcatcatcattgtaattcggtgaggaccaaggtggaggtcaaacgaactgtggctgcaccatctgtcttcatcttcccgcatctgagtactagacgctgagcgggctggcaagg

SEQ ID NO: 296752 - DNA, 340 bp, Homo sapiens
  misc_feature: NA.14.85.H08.2.454.light.1.nb
gaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgag

SEQ ID NO: 296753 - DNA, 372 bp, Homo sapiens
  misc_feature: NA.14.86.H09.1.454.light.1.nb
tgctcagttaggacccagagggaaccatggcagccccagctcagcttctcttcctcctgctactctggctcccagatatcaccggagaaattgtgttgacacagtctccagccaccctgtctttgtctccaggggaaagacgccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagacgcctggagtattttgtagtttattactgtcagctagtatagcagctgg

SEQ ID NO: 296754 - DNA, 414 bp, Homo sapiens
  misc_feature: NA.15.1.A01.2.454.light.1.nb
tcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtcctgcgtcacgcccaaggctcgcccctcggtccactctcgttcccgccct

SEQ ID NO: 296755 - DNA, 242 bp, Homo sapiens
  misc_feature: NA.15.1.A01.3.454.light.1.nb
  modified_base (167)..(167): a, c, t, g, unknown or other
  misc_feature (167)..(167): n is a, c, g, or t
tctcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccngcagtgacgttggtacttataactatgtctcctggtaccaacagaacccaggcaaagcccccaaatcatgattta

SEQ ID NO: 296756 - DNA, 277 bp, Homo sapiens
  misc_feature: NA.15.11.A11.1.454.light.1.nb
tgcaactgtcagcctcagcagagctctggggagtctgcaccatggcttggaccccactcctcttcctcaccctcctcctccactgcacagggtctctctcccagcttgtgctgactcaatcgccctctgcctctgcctcccgtgggacgcctcggtcaagctcacctgcactctgagcagtgggcacaccagctacgccatcgcatggcatcagcagcagccagagaaggccctcgctacttgatgaagcttaacactgatggcagccacgaggtaa

SEQ ID NO: 296757 - DNA, 205 bp, Homo sapiens
  misc_feature: NA.15.21.B10.1.454.light.1.nb
gaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcag

SEQ ID NO: 296758 - DNA, 485 bp, Homo sapiens
  misc_feature: NA.15.26.C04.1.454.light.1.nb
ctcagtcaggacacagcatggacatgagggtccccgctcagctcctggggctcctgctgctctggctcccaggtgcccaatgtgacatccagatgacccagtctccttccaccctgtctgcatctgtgggagacagagtcaccatcacttgccgggccagtcagagtgttactaactggttggcctggtatcagcagaaaccagggaaacgcccctaacctcctaatctatgatgcctccagtttggagagtggggtcccatctaggttcagcggcagtggatttgggacagaattcactctcaccatccgcagcctgcagcctgaagattttgcaacttattactgccaacagtataatagcaattctccgtggacgttcggccaagggaccagggtggatatcaaacgactgtggctgcaccatctgtcttcatcttcccgccatctgagctacgtagactgagcgggctggcaaggcgcata

SEQ ID NO: 296759 - DNA, 372 bp, Homo sapiens
  misc_feature: NA.15.28.C06.2.454.light.1.nb
actcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgctaacttactactgccaagtgcataataatcatttcgg

SEQ ID NO: 296760 - DNA, 349 bp, Homo sapiens
  misc_feature: NA.15.31.C09.1.454.light.1.nb
tcaggaggcagcgctctcaggacatctccaccatggcctgggctctgctgctcctcaccctcctcactcagggcacagggtcctgggcccagtctgccctgactcagcctgcctccgtgtctgggtctcttggacagtcgatcaccatctcctgcactggaaccagcagtgacgttggtacttataactatgtctcctggtaccaacagaacccaggcaaagcccccaaactcatgatttatgaggtcagtaatcggccctcaggggtttctaatcgcttctctggctccaagtctggcaacatggcctccctgaccatctctgggcctccaggctgaggacgaggctg

SEQ ID NO: 296761 - DNA, 464 bp, Homo sapiens
  misc_feature: NA.15.34.D01.1.454.light.1.nb
cctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcacgaccccaggccagcctccacgcacgctcatctacagtacaaacactcgctcttccgggtccctgatcgcttctctggctccatccttggaacaaagctgccctcaccatcgacggggcccaggcagacgatgaatgtgattatcactgcgttcctttatgtggggcgtggctagtttgggtgttcggcggagggaccaaacgtgaccgtcctaggtcagccca

SEQ ID NO: 296762 - DNA, 367 bp, Homo sapiens
  misc_feature: NA.15.37.D04.1.454.light.1.nb
  modified_base (170)..(170): a, c, t, g, unknown or other
  misc_feature (170)..(170): n is a, c, g, or t
gacccagtcaggacacagcatggacatgagggtccccgctcagctcctggggctcctgctgctctggctcccaggtgccatgtgtgacatccagatgacccagtctccttccaccctgtctgcatctgtaggagacagagtcaccttcacttgccgggccagtcaaaatnttactaggtggttggcctggtatcagcagaaaccagggaaggcccctaagtccctcatcaagaaggcgtctactttagaagctggggtccctcaagattcagcgccggtggatcgtgggacagaattcactctcaccatcaacagcctggaacctgatgattttgctaacttattactgaccaacactatgatactc

SEQ ID NO: 296763 - DNA, 380 bp, Homo sapiens
  misc_feature: NA.15.49.E05.1.454.light.1.nb
actgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtggtctgggacagagttcattctcaccatcagcagcctgcagtctgaagtattttgctagtttattactgtcagcagtatatgactgcctcgacgttc

SEQ ID NO: 296764 - DNA, 419 bp, Homo sapiens
  misc_feature: NA.15.5.A05.1.454.light.1.nb
agcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcggtgcgcagcctgaggatgaggctgagtattactgcttgctctcctatagtggtgttcgggtgttcggcggagggaccaagctgaccgtcctaggtcagcccaaggctcgcccctggtcactct

SEQ ID NO: 296765 - DNA, 229 bp, Homo sapiens
  misc_feature: NA.15.50.E06.1.454.light.1.nb
tccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctgccccctcggtcactctgttcccacctcctcgctacgtagactgagcgggctggcaaggcgcata

SEQ ID NO: 296766 - DNA, 503 bp, Homo sapiens
  misc_feature: NA.15.57.F02.1.454.light.1.nb
tcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtagactgagcgggctggcaaggcgcata

SEQ ID NO: 296767 - DNA, 232 bp, Homo sapiens
  misc_feature: NA.15.6.A06.1.454.light.1.nb
atccctgatcgcttctcaggctccagttctggggctgagcgcaccctcgtcatctccagcctccagtctgaggatgagggtgactattattgtcagacgtggggcagtggcgttcaggcattcggcggagggaccaagctgactgtcctcggtcagcccaaggctcgccccctggtcactctgttcccaccctcctcgctacgtagacctgagcgggctggcaaggcgcata

SEQ ID NO: 296768 - DNA, 382 bp, Homo sapiens
  misc_feature: NA.15.66.F11.1.454.light.1.nb
cagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcgaggggtccctgatcgcttctctggctccaagtctggcgactcggcctccctgaccgtctctgggctccagcctgaagatgaggctgattatttctgcggctcatatggagacaattacagctttgtcttcggaagt

SEQ ID NO: 296769 - DNA, 357 bp, Homo sapiens
  misc_feature: NA.15.67.G01.1.454.light.1.nb
tcagacccactcagtacacagcatggacatgagggtccccgctcagctcctggggctcctgctgctctggctcccaggtgccagatgtgccatccagatgacccagtctccatcctcctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgacaacttattactgtactac

SEQ ID NO: 296770 - DNA, 357 bp, Homo sapiens
  misc_feature: NA.15.71.G05.1.454.light.1.nb
gaactgaggagcaggtgggggcacttctccctctaacactctccccgctcagctcctggggctcctgctgctctggttcccaggttccagatgcgacatccagatgagccagtctccatcttccgtgtctgcatctgtaggagacagagtcaccatcacttgtcgggcgagtcagggtattagcagctggttagcctggtatcagcagaaaccagggaaagcccctaagctcctgatctatggtgcatccagtttggaaagtggggtcccacaaggttcagcggcagtgaatctgggacagatttcactctcaccatcagcagcctgcagcctgaggtattttgctaacttactatt

SEQ ID NO: 296771 - DNA, 303 bp, Homo sapiens
  misc_feature: NA.15.81.H04.2.454.light.1.nb
cccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtgcagcactctcgtattc

SEQ ID NO: 296772 - DNA, 279 bp, Homo sapiens
  misc_feature: NA.15.81.H04.3.454.light.1.nb
tcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtc

SEQ ID NO: 296773 - DNA, 372 bp, Homo sapiens
  misc_feature: NA.15.83.H06.1.454.light.1.nb
tctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctaccaacctgaagtattttgactaacttactactgtacaacagtagtttcagtacg

SEQ ID NO: 296774 - DNA, 392 bp, Homo sapiens
  misc_feature: NA.15.86.H09.3.454.light.1.nb
gcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaacgtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaatgatgg

SEQ ID NO: 296775 - DNA, 400 bp, Homo sapiens
  misc_feature: NA.16.1.A01.2.454.light.1.nb
cgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagc

SEQ ID NO: 296776 - DNA, 392 bp, Homo sapiens
  misc_feature: NA.16.10.A10.1.454.light.1.nb
cagaactctgggtgtctcaccatggcctggatccctctacttctcccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtc

SEQ ID NO: 296777 - DNA, 479 bp, Homo sapiens
  misc_feature: NA.16.12.B01.1.454.light.1.nb
gaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcgggccagactatggatgaggctgactattactgtcaggcgtgggacagcaattctgtgattttcggcggagggaccaagttgaccgtcctaggtcagcccaaggctgccccctggtcactctgttcccaccctcctcgagtagtacactgagcgggctggcaaggcgcata

SEQ ID NO: 296778 - DNA, 317 bp, Homo sapiens
  misc_feature: NA.16.12.B01.3.454.light.1.nb
actcagtcaggacacagcatggacatgacgggtccccgctcagctccgtggggctcctgctgctctggctcccaggtatcaaatgtgacatccagatgacccagtctccttccaccctgtctgcatctgtcggagacagagtcaccatcacttgccgggccagtcagagtgtggtacctggttggcctggtatcagcagaaaccagggaaagcccctaagctcctgatctatgatgtctaccaatataggaaagtggggtaccattcaaggttcagcggcagtggatcgtggacagtaatcactctcacatcagtca

SEQ ID NO: 296779 - DNA, 224 bp, Homo sapiens
  misc_feature: NA.16.13.B02.1.454.light.1.nb
ttctctggctccaagtctggcacgtcagccaccctgggcatcgccgggctccagactggggacgaggcctattattactgcggaacatgggatgccagcctgcgtgttgtggtgttcggcggagggaccaagctgaccgtcctcggtcagcccaaggctgccccctggtcactctgttcccaccctcctcgagtagtacactgagcgggctggcaaggcgcata

SEQ ID NO: 296780 - DNA, 314 bp, Homo sapiens
  misc_feature: NA.16.2.A02.1.454.light.1.nb
  modified_base (131)..(131): a, c, t, g, unknown or other
  misc_feature (131)..(131): n is a, c, g, or t
taggacccagagggaaccatggaagccccagctcagcttctcttcctcctgctactctggctcccagataccaccggagaaattgtgttgacacagtctccagccaccctgtctttgtctcccggggaaanagccaccctctcctgcagggccagtcagagtgttagcagcttcttagcctggtaccagcagagacctggccaggctcccagactcctcatctatgatgcatccaacagggccactggcatcccagccaggttcagtggcaggtgggtctgggacagacttcactctcaccatcagcagcctag

SEQ ID NO: 296781 - DNA, 68 bp, Homo sapiens
  misc_feature: NA.16.20.B09.2.454.light.1.nb
tcagttaggacccagacggaaccatggaagccccagcgcagcttctcttcctcctgctactctggcct

SEQ ID NO: 296782 - DNA, 500 bp, Homo sapiens
  misc_feature: NA.16.38.D05.1.454.light.1.nb
tggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcaggtgggtttgggacagacttcactctcaccatcagcaccctgcagtctgaggattttgcaatttattattgtcagcagtataattactggcctccgtacacttttggccaggggaccaagctggagatcaaacgaactgtggctgcaccatctgtcttcatcttcccgccatctgagagtagtacactgagcgggctggcaaggcgcata

SEQ ID NO: 296783 - DNA, 340 bp, Homo sapiens
  misc_feature: NA.16.4.A04.1.454.light.1.nb
caggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtccatcaagattcagcggcagtggatctgggacagagttcactctcaccatcagcagcctgcagcctgatgattttgctaacctattattg

SEQ ID NO: 296784 - DNA, 383 bp, Homo sapiens
  misc_feature: NA.16.46.E02.1.454.light.1.nb
ggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcacgcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcacgtctaggtca

SEQ ID NO: 296785 - DNA, 387 bp, Homo sapiens
  misc_feature: NA.16.49.E05.1.454.light.1.nb
cacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccagcagcacccagacaaagcccccaaactcatgatttatgagggcaataagcggccctcaggagtttctaatcgcttctctggctccacgtctggcaacacggcctcctgacaatctctggcctccaggctgaggacgaggctgattatactgctgctcatattcaagttcgtgtcacttatg

SEQ ID NO: 296786 - DNA, 98 bp, Homo sapiens
  misc_feature: NA.16.57.F02.2.454.light.1.nb
accaagctgaccgtcctaagtcagcccaaggctgcccctcggtcactctgttcccaccctcctcgagtagtacactgagcgggctggcaaggcgcata

SEQ ID NO: 296787 - DNA, 367 bp, Homo sapiens
  misc_feature: NA.16.59.F04.1.454.light.1.nb
gggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtgtg

SEQ ID NO: 296788 - DNA, 215 bp, Homo sapiens
  misc_feature: NA.16.60.F05.1.454.light.1.nb
aggttcagcggcaatgcatctgggacagatttcactctcaccatcagcagcctgcagcctgaagattttgctaacttttttctgccaacagtatattctttaccctccgactttcggcggagggaccagggttgagatcaaacgaactgtggctgcaccatctgtcttcatcttcccgccatctgagagtagtacactgagcgggctggcaaggc

SEQ ID NO: 296789 - DNA, 362 bp, Homo sapiens
  misc_feature: NA.16.66.F11.1.454.light.1.nb
ctggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtcgcccccacagagtgatctatgaggataacctacggccctcgtcggggtccctccgtcggttttctggctccatcgacggtcctccactactcgcctccctcaccatctctggactgaagctgaggacgaggctgactactactgtcagtctatgataac

SEQ ID NO: 296790 - DNA, 360 bp, Homo sapiens
  misc_feature: NA.16.68.G02.2.454.light.1.nb
cagacccagtcaggacacagcatggacatgagggtccccgctcagctcctgggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgctaacttattactgccaacagtatc

SEQ ID NO: 296791 - DNA, 329 bp, Homo sapiens
  misc_feature: NA.16.70.G04.2.454.light.1.nb
tcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtactcccagccaggttcagtggcagtggtctgggacagagttcactctcaccatcagcagcctgcagtctgaagta

SEQ ID NO: 296792 - DNA, 354 bp, Homo sapiens
  misc_feature: NA.16.71.G05.2.454.light.1.nb
ctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagatttgcagtgtattactgtcagc

SEQ ID NO: 296793 - DNA, 361 bp, Homo sapiens
  misc_feature: NA.16.73.G07.2.454.light.1.nb
gcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggctagtttatactgtacaac

SEQ ID NO: 296794 - DNA, 356 bp, Homo sapiens
  misc_feature: NA.16.81.H04.1.454.light.1.nb
caggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgtacttattattgccaacagtataagag

SEQ ID NO: 296795 - DNA, 491 bp, Homo sapiens
  misc_feature: NA.16.83.H06.1.454.light.1.nb
aggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaaccccactgtcactctcgttcccaccctcctcgagtagtacactgagcgggctggcaaggcgcata

SEQ ID NO: 296796 - DNA, 304 bp, Homo sapiens
  misc_feature: NA.16.85.H08.1.454.light.1.nb
aagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagacaaaaatgtgcactggtacatgcagaggccaggccaggcccctgttttggtcgtctatgatgataccgagcggccctcgagggatccctgagcgattctccggctccaactctggtgacacggccaccctgacca

SEQ ID NO: 296797 - DNA, 293 bp, Homo sapiens
  misc_feature: NA.16.86.H09.2.454.light.1.nb
tcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctcaagtctggcaacacggcctccctgaccatctctgggctccaggctgaggacgagggtgattattactgcagctcatatagaagt

SEQ ID NO: 296798 - DNA, 300 bp, Homo sapiens
  misc_feature: NA.16.86.H09.3.454.light.1.nb
tcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggcctcg

SEQ ID NO: 296799 - DNA, 105 bp, Homo sapiens
  misc_feature: NA.16.86.H09.6.454.light.1.nb
agactgacggtccccaggagttcaggtgctgggcacagcggccctgggctgcctggtcaaggactacttccgagtagtacactgagcgggctggcaaggcgcata

SEQ ID NO: 296800 - DNA, 407 bp, Homo sapiens
  misc_feature: NA.16.88.H11.1.454.light.1.nb
ccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgatacaaacaacaaacactcctggacccctgcccggttctcagctccctcgtggggcaaagctgccctgaccctttcgggtgcgcagcctgaggatgaggctgagtattactgcttgctctcctatagtggtgttcgggtgttcggcggaggaccaagctgaccgtcta

SEQ ID NO: 296801 - DNA, 356 bp, Homo sapiens
  misc_feature: NA.16.9.A09.2.454.light.1.nb
agcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaaattaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggaca

SEQ ID NO: 296802 - DNA, 353 bp, Homo sapiens
  misc_feature: NA.17.1.A01.1.454.light.1.nb
actcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaaacaaaaactagggagacgacccctaaactcctgatctatgctgcatccagtttgcagactggggtcccatcaaggttcagcggcagtggatctggcacagatttcactctcaccatcagcagcctgcagcctagaagtattttgactaacttattactgtac

SEQ ID NO: 296803 - DNA, 169 bp, Homo sapiens
  misc_feature: NA.17.1.A01.2.454.light.1.nb
agaggagtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagct

SEQ ID NO: 296804 - DNA, 224 bp, Homo sapiens
  misc_feature: NA.17.10.A10.4.454.light.1.nb
tctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctgccccctcggtcactctgttcccaccctcctcctagtctacgctgagcgggctggcaaggcgcata

SEQ ID NO: 296805 - DNA, 347 bp, Homo sapiens
  misc_feature: NA.17.12.B01.1.454.light.1.nb
cgacgtctcagttcaggtaccaccacgcatggacatgagggtccccgcgtcagctccgtggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaacgccccagacctcctgatctctggtgcatccactctgcgaagtggcgtcccatcgaggttcagtggcagtggatcgtgggacagatttcaatctcaccatcaccactctgcaacctgagattgtg

SEQ ID NO: 296806 - DNA, 80 bp, Homo sapiens
  misc_feature: NA.17.20.B09.2.454.light.1.nb
gacgaactgtggctgcaccatctgtcttcatcttcccgccatctgactagtctacgctgagcgggctggcaaggcgcata

SEQ ID NO: 296807 - DNA, 238 bp, Homo sapiens
  misc_feature: NA.17.23.C01.1.454.light.1.nb
aaggaagcagctctggtggtgcctcagccatggcctggaccgttctcctcctcggcctcctctctcactgcacaggctctgtggcctcctatgtgctgactcagccaccctcggtgtcagtggccccaggacagacggccacaattacctggcgggggaagaacattggaaagtaaaagtgtgcagtggtaccagcagaagccaggccaggccctattctggtcgtctatgatgatag

SEQ ID NO: 296808 - DNA, 365 bp, Homo sapiens
  misc_feature: NA.17.25.C03.2.454.light.1.nb
agtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacg

SEQ ID NO: 296809 - DNA, 245 bp, Homo sapiens
  misc_feature: NA.17.26.C04.1.454.light.1.nb
ctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttg

SEQ ID NO: 296810 - DNA, 303 bp, Homo sapiens
  misc_feature: NA.17.27.C05.1.454.light.1.nb
atgaacattctgtaggggccactgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccc

SEQ ID NO: 296811 - DNA, 312 bp, Homo sapiens
  misc_feature: NA.17.28.C06.2.454.light.1.nb
gctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctcaactaaactatttttgctggtaccagcaattcccaggactccggccccccgactcctcatctatagaaatgatcatcggccctccggggtccctgaccgattctctggctcatgtctggcacctca

SEQ ID NO: 296812 - DNA, 304 bp, Homo sapiens
  misc_feature: NA.17.29.C07.2.454.light.1.nb
tcctccactggaaccagcagtgacgttggtggttataactttgtctcctgataccaacagcacccaggcaaagcacccaaattcatgatttatgaggtcactaatcggcctcaggggtttctaatcgcttctctggctccaagtctggcaacacggcctccctgaccatctctgggctccaggctgaggacgaggctgattattattgcatctcatatacaaccaacagcactctcgactggtattcggcggtagggaccaagctgacccgtctaggtcacgcccaaggcctgccccctggtcc

SEQ ID NO: 296813 - DNA, 200 bp, Homo sapiens
  misc_feature: NA.17.29.C07.3.454.light.1.nb
cccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgagtcagtaatcggcctctaggggtttctaatcgcttctctggc

SEQ ID NO: 296814 - DNA, 436 bp, Homo sapiens
  misc_feature: NA.17.33.C11.1.454.light.1.nb
cggccgaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctagttcggcggagggaccaagctgaccgtcttaagtcagcccaaggctcgcccc

SEQ ID NO: 296815 - DNA, 486 bp, Homo sapiens
  misc_feature: NA.17.36.D03.1.454.light.1.nb
  modified_base (139)..(139): a, c, t, g, unknown or other
  misc_feature (139)..(139): n is a, c, g, or t
tgctcagttaggacccagagggaaccatggaagccccagctcagcttctcttcctcctgctactctggctcccagataccaccggagaaattgtgttgacacagtctccagccaccctgtctttgtctccgggggaaangccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagtattttgctagtttattactgtcagcagcgtagcaactggctcatcaccttcggccaagggacacgactggagatgaaacgaactgtggctgcaccatctgtcttcatcttcccgccatctgactagtctacgctgagcgggctggcaaggcgcata

SEQ ID NO: 296816 - DNA, 339 bp, Homo sapiens
  misc_feature: NA.17.39.D06.1.454.light.1.nb
actgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaacctggccaggctcccaggctcctcatgtatggtgcatctaccagggccactggtgtcccagccaggttcagtggcagtgggtctggggacagagttctctctcatcatcagcagcctgcagtctgaagtattttg

SEQ ID NO: 296817 - DNA, 292 bp, Homo sapiens
  misc_feature: NA.17.4.A04.1.454.light.1.nb
ctcaccatgaggctccctgctcagctcctggggctgctaatgctctggatccctggatccagtgcggatattgtgatgacccagactccactctctctgtccgtcacccctggacagccggcctccatctcctgcaagtctagtcagagcctcctgcatagtgatggaaagacctatttgtattggtacctgcagaaggcaggccagtctccacatctcctaatctatgaagtttccagtcgattctctggagtgccagataggttcagtggcaggcgggtcaggcacagta

SEQ ID NO: 296818 - DNA, 238 bp, Homo sapiens
  misc_feature: NA.17.40.D07.1.454.light.1.nb
ggaagcagagcctggagcatctccactatggcctgggctccactacttctcaccctcctcgctcactgcacaggttcttgggccaactttatgctgactcagcccctctctgtgtcggggtctccggggaagacaataaccatctcctgcacccgcagcagtggcaacattggcagccaatatgtgcagtggtaccagcagcgcccgggcagttcccctagaactgtgatctatgaag

SEQ ID NO: 296819 - DNA, 324 bp, Homo sapiens
  misc_feature: NA.17.41.D08.1.454.light.1.nb
agctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagttgttttaaaaactttagcctggtaccaacagaagcctggccaggctcccaggctcctcatctatggtgcatccaccagggccactggcatcccagacaggttcagtggcggtggtctgggacagaatcactctcaccatcaccagtctgga

SEQ ID NO: 296820 - DNA, 366 bp, Homo sapiens
  misc_feature: NA.17.42.D09.1.454.light.1.nb
aggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgatacaaacaacaaacactcctggacccctgcccggttctcaggctcctcgttgggggcaaagctgccctgaccctttcgggtgcgcagcctgaggatgaggctgagtattactgcttgctctcctatgt

SEQ ID NO: 296821 - DNA, 358 bp, Homo sapiens
  misc_feature: NA.17.43.D10.1.454.light.1.nb
gttaggacccagacggaaccatggaagccccagcgcagcttctcttcctcctgctactctggctcccagatactactggagaaatggtgatgacgcagtctccagccaccctgtctgtttctccaggggaacgagccaccctctcctgcagggccagtcagagtgtgagcagcaacttagcctggtatcagcagaaacctggccaggctcccaggctcctcatctatggtgcttccaccagggccgctggtcgtcccagccagattcgagggcaggtgggtctgggacagagttcactctcaccatcagcagcctgcagtctgaagattttgctagtttattactgtcagctactata

SEQ ID NO: 296822 - DNA, 365 bp, Homo sapiens
  misc_feature: NA.17.49.E05.1.454.light.1.nb
actgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccactcagagtattaccagcaacttagcctggtaccagcagaaacctggccaggctcccaggctcctcatttatggtgcatccaccagggccactggtactcccagccaggttcagtggcaggtgggtctgggacagagttcactctcaccatcagcagcctgcagtctgaagtattttgctagtttattactgtcagtcaata

SEQ ID NO: 296823 - DNA, 345 bp, Homo sapiens
  misc_feature: NA.17.55.E11.1.454.light.1.nb
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttaacagctccaacagtaagaactacttagcttggtaccagcagaaaccaggacagcctctaagctgctcatttactgggcatctacccgggaatccggggtcctgaccgattcagtggcagcgggtctgggacagatttcactctcaccatcagcagcctgcaggctgaagatgt

SEQ ID NO: 296824 - DNA, 260 bp, Homo sapiens
  misc_feature: NA.17.57.F02.1.454.light.1.nb
tgatctatactgcatccaatttgcaaagtggggtcccatcaaggttcagtggcagtggatctgggacagatttcactctcaccatcagcagtctgcaacctgaggattttgcaacttactactgtcaacagggttacagtaccccgtacacttttggccaggggaccaagctggagatcaaacgaactgtggctgcaccatctgtcttcatcttcccgccatctgactagtctacgctgagcgggctggcaaggcgcata

SEQ ID NO: 296825 - DNA, 254 bp, Homo sapiens
  misc_feature: NA.17.86.H09.1.454.light.1.nb
  modified_base (177)..(177): a, c, t, g, unknown or other
  misc_feature (177)..(177): n is a, c, g, or t
aggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagngcttataactatgtctcctggtaccaacagcacccaggcaaggtccccaaagccatgatttatgaggtcagtaatcg

SEQ ID NO: 296826 - DNA, 208 bp, Homo sapiens
  misc_feature: NA.17.9.A09.1.454.light.1.nb
gtgagcgcagaaggcaggactcgggacaatcttcatcatgacctgctcccctctcctcctcacccttctcattcactgcacagggtcctgggcccagtctgtcttgacgcagccgccctcaatgtctgcggccccaggacagaaggtcaccatctcctgctctggaacgcggctaccaacattggaaatattatgtatcgtgttccag

SEQ ID NO: 296827 - DNA, 134 bp, Homo sapiens
  misc_feature: NA.18.10.A10.1.454.light.1.nb
tatgcgccttgccagcccgctcagtacgagtatgggaagtagtccttgaccaggcagcccagggccgctgtgcccagcacctgaactcctgggggaccgtcagtcttcctcttcccccaaaacccaaggacacc

SEQ ID NO: 296828 - DNA, 420 bp, Homo sapiens
  misc_feature: NA.18.11.A11.1.454.light.1.nb
gtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcggtctgggacagatttcactctcaccatcaccaacctgcaggctgaagatgtggcagtttatactgtcagcaatactatagtcctcctctcacgttcggcggaggaccaaggtgagatcaaacgactgtggctgcaccatctgtcttcat

SEQ ID NO: 296829 - DNA, 48 bp, Homo sapiens
  misc_feature: NA.18.20.B09.2.454.light.1.nb
tccctcctgagaagcccccagagcacaactccttaccatggactggac

SEQ ID NO: 296830 - DNA, 394 bp, Homo sapiens
  misc_feature: NA.18.23.C01.1.454.light.1.nb
gtcagacccagtcaggacacagcatggacacgagggtcccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagatttgactaacttactattgtcagcaggcgcacaatttcccgctcactttcggcggaggacc

SEQ ID NO: 296831 - DNA, 322 bp, Homo sapiens
  misc_feature: NA.18.23.C01.2.454.light.1.nb
aggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctct

SEQ ID NO: 296832 - DNA, 105 bp, Homo sapiens
  misc_feature: NA.18.33.C11.3.454.light.1.nb
agactgacggtccccaggagttcaggtgctgggcacagcggccctgggctgcctggtcaaggactacttcccatactcgtactgagcgggctggcaaggcgcata

SEQ ID NO: 296833 - DNA, 79 bp, Homo sapiens
  misc_feature: NA.18.37.D04.1.454.light.1.nb
acgaactgtggctgcaccatctgtcttcatcttcccgccatctgacatactcgtactgagcgggctggcaaggcgcata

SEQ ID NO: 296834 - DNA, 63 bp, Homo sapiens
  misc_feature: NA.18.37.D04.2.454.light.1.nb
tatgcgccttgccagcccgctcagtacgagtatgggaagtagtccttgaccaggcagcccagg

SEQ ID NO: 296835 - DNA, 84 bp, Homo sapiens
  misc_feature: NA.18.39.D06.2.454.light.1.nb
gggcaccctggtcaccgtctcctcagcttccaccaagggcccatcggtcttccccctggcgccctgctccaggagcacctctgg

SEQ ID NO: 296836 - DNA, 104 bp, Homo sapiens
  misc_feature: NA.18.43.D10.1.454.light.1.nb
tatgcgccttgccagcccgctcagtacgagtatgggaagtagtccttgaccaggcagcccagggccgctgtgctctcggaggtgctcctggagcagggcgccag

SEQ ID NO: 296837 - DNA, 366 bp, Homo sapiens
  misc_feature: NA.18.53.E09.1.454.light.1.nb
gtcaggacacagcatggacatgagggtccccgctcagctcctgggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaacagggaaagcccctaagctcctgatctatgctacatccagtttgcaaagtggggtcccatcaaggttcagtggcagtggatctgggacagatttcactctcaccatcagcagtctgcaacctgaagtattttgctaacttactactgtacaacagagttacagtacccgt

SEQ ID NO: 296838 - DNA, 155 bp, Homo sapiens
  misc_feature: NA.18.53.E09.3.454.light.1.nb
tatgcgccttgccagcccgctcagtacgagtatgggaagtagtccttgaccaggcagcccagggccgctgtgcccagagcccaaatcttgtgacacacctcccccatgcccacggtgcccagcacctgaactcctgggaggaccgtcagtcttcc

SEQ ID NO: 296839 - DNA, 76 bp, Homo sapiens
  misc_feature: NA.18.59.F04.1.454.light.1.nb
ggggtctcaggaggcagcgctctcgggacgtctccaccatggcctgggctctgctattcctcaccctcctcactca

SEQ ID NO: 296840 - DNA, 305 bp, Homo sapiens
  misc_feature: NA.18.59.F04.2.454.light.1.nb
gggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagca

SEQ ID NO: 296841 - DNA, 335 bp, Homo sapiens
  misc_feature: NA.18.60.F05.2.454.light.1.nb
tgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgacatactcgtactgagcgggctggcaaggcgcata

SEQ ID NO: 296842 - DNA, 82 bp, Homo sapiens
  misc_feature: NA.18.73.G07.1.454.light.1.nb
tgctgacgcagccgccctcactgtctggggccccagggcagagggtcaccatcaacctgcactgggacctccaacatcgggg

SEQ ID NO: 296843 - DNA, 250 bp, Homo sapiens
  misc_feature: NA.18.73.G07.2.454.light.1.nb
caaattatgatgtacactggtaccagcaacttccaggaacagcccccaaacttgtcatctatggtaacaataatcggccctcaggggtccctgcccgattctctggctccaagtctggcacctcagcctccctggccatcactgggctccaggctgatgatgaggctgattattactgccagtcctatgacactaatctcagtggtctgggggtcttcgggcggagggaccaggctgaccgtcgtgggtc

SEQ ID NO: 296844 - DNA, 257 bp, Homo sapiens
  misc_feature: NA.18.73.G07.3.454.light.1.nb
cgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtgttcgtatgtcttcggatcgtgggaccaaggtcaccgtctaagtcagcccaagg

SEQ ID NO: 296845 - DNA, 215 bp, Homo sapiens
  misc_feature: NA.18.73.G07.4.454.light.1.nb
ctgactcagcctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggcctcgtagggttttcaatcgtcttctctggctccaagtctggacaacacggccctcc

SEQ ID NO: 296846 - DNA, 500 bp, Homo sapiens
  misc_feature: NA.18.78.H01.1.454.light.1.nb
tcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtcactctgttcccaccctcctccatactcgtactgagcgggctggcaaggcgcata

SEQ ID NO: 296847 - DNA, 83 bp, Homo sapiens
  misc_feature: NA.18.81.H04.2.454.light.1.nb
gtcagacgaactgtggctgcaccatctgtcttcatcttcccgcatctgacatactcgtactgagcgggctggcaaggcgcata

SEQ ID NO: 296848 - DNA, 140 bp, Homo sapiens
  misc_feature: NA.18.85.H08.2.454.light.1.nb
tcactctcaccatcaccaacctgcaggctgaagatgtggctagttttatttctgtcagcaactatttttggtattccgatcaccttcggccaagggacacgactggagattaaaagactgtggctgcaccatctgtcttc

SEQ ID NO: 296849 - DNA, 125 bp, Homo sapiens
  misc_feature: NA.18.89.I01.1.454.light.1.nb
tatgcgccttgccagcccgctcagtacgagtatgtcagatggcgggaagatgaagacagatggtgcagccacagttcgtttgatttccaccttggtcccttggccgaacgtccaccacagtgaga

SEQ ID NO: 296850 - DNA, 403 bp, Homo sapiens
  misc_feature: NA.18.9.A09.1.454.light.1.nb
gtgctgacgcagccgccctcagtgtctggggccccagggcagagggtcaccatctcctgcactgggagcacctccaacatcggggcgggttatgatgtacactggtaccagcacttccagggacagcccccaaacttcatctatggtacaaaatcggccctcaggggtccctgacccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaaccctctgtcactctcgttcccaccctcctccatactcgtactgacgcggctggcaaggcgc

SEQ ID NO: 296851 - DNA, 166 bp, Homo sapiens
  misc_feature: NA.18.9.A09.2.454.light.1.nb
tcaccatctcctgcactggaaccagcagtgacgttggtggttataactatgtctcctggtaccaacagcacccaggcaaagcccccaaaactcatgatttatgatgtcactaatcggccctcaggggttttctaatcgcttctctggctcaagtctggcaacacgg

SEQ ID NO: 296852 - DNA, 182 bp, Homo sapiens
  misc_feature: NA.19.1.A01.1.454.light.1.nb
  modified_base (159)..(159): a, c, t, g, unknown or other
  misc_feature (159)..(159): n is a, c, g, or t
aagatggtgttgcagacccaggtcttcatttctctgttgctctggatctctggtgccgtacggggacatcgtcatcgacccagtctccagactccctggctgtgtctctgggcgaggacgggccaccatcaactgcaagtccagccagagttgttttanacagctaccaaacaaataagaac

SEQ ID NO: 296853 - DNA, 126 bp, Homo sapiens
  misc_feature: NA.19.10.A10.2.454.light.1.nb
cccctggggaaagagccaccctctcctgcagggccgataagagtgttgacagcaccttctttgcctggtaccagcagagacctggccaggctcccaggctcctcgtttatggtgcgtccaccaggg

SEQ ID NO: 296854 - DNA, 136 bp, Homo sapiens
  misc_feature: NA.19.10.A10.3.454.light.1.nb
ccactggcactccccgaaggttcagtggcagtgtgtctgggacagacttcactctcaccatcagcagactggagcctgaagattttgcagtgtattactgtcaacgatatgatgagtcacctcgtggtggacattt

SEQ ID NO: 296855 - DNA, 319 bp, Homo sapiens
  misc_feature: NA.19.14.B03.1.454.light.1.nb
aggaggcagcactctcgggacgtctccaccatggcctgggctctgctcctcctcagcctcctcactcagggcacaggatcctgggctcagtctgccctgactcagcctcactcagtgtccgggtctcctggacagtcagtcaccatctcctgcactggaaccagcagtgatgttggtggttataactatgtctcctggtaccaacaacacccaggcaaggccccaaagtcatgatttatgatgtcagtgagcggccctcgacgggtccctgatcgcttctctggctccaagtctggcaacacggcctaccctaaccatc

SEQ ID NO: 296856 - DNA, 129 bp, Homo sapiens
  misc_feature: NA.19.14.B03.2.454.light.1.nb
cacaagaggcagcgctctcgggacgtctccaccatggcctgggctctgctgctcctcactctcctcactcaggacacagggtcctgggcccagtctcgccctgactcagtctgcctcgtgtctgggtct

SEQ ID NO: 296857 - DNA, 310 bp, Homo sapiens
  misc_feature: NA.19.15.B04.1.454.light.1.nb
gttaggacccagagggaaccatggaaaccccagcgcagcttctcttcctcctgctactctggctcccaggctcagaaaccaccggagaaattgtgttgacgcagtctccaggcaccctgtctttgtctccgaggggaaagagccaccctctcctgcagctccagccagaatatccagagctactacatagcctggtaccagcagaagcctggccaggctcccaggttcctcatctatgctggtcccacagggccactggcatcccagacaggttcagtggcagtgggtctgggacagacttcactctcat

SEQ ID NO: 296858 - DNA, 252 bp, Homo sapiens
  misc_feature: NA.19.21.B10.1.454.light.1.nb
acaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatagaaaactacttagcttaggtaccagcagagaccaggacagcctcctaggctgctcatttac

SEQ ID NO: 296859 - DNA, 80 bp, Homo sapiens
  misc_feature: NA.19.21.B10.3.454.light.1.nb
aacgaactgtggctgcaccatctgtcttcatcttcccgccatctgacacgagagtactgagcgggctggcaaggcgcata

SEQ ID NO: 296860 - DNA, 332 bp, Homo sapiens
  misc_feature: NA.19.25.C03.1.454.light.1.nb
gctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggcctcctcatctatggtgcatccaccagggccactggtatcccagccaggttcagtggcaggtgggtctgggacagagttcactctcaccatcagcagcctgcagtctgaagt

SEQ ID NO: 296861 - DNA, 410 bp, Homo sapiens
  misc_feature: NA.19.26.C04.2.454.light.1.nb
gttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggcccctatactggtcatctattataataccgtccggccctcagggactccctgagcgactctctggctccaactctgggaacacggccaccctgaccgtcagcagggtcgaagccggggatgaggccgactattactgtcaggtgtgggatagtagtagcggtcatgtgattttcggcggaggaccaagcgtgaccgtcctaggtcg

SEQ ID NO: 296862 - DNA, 76 bp, Homo sapiens
  misc_feature: NA.19.27.C05.1.454.light.1.nb
acacctgtggttccctgggctgcctggtcaaggactacttcccacgagagtactgagcgggctggcaaggcgcata

SEQ ID NO: 296863 - DNA, 345 bp, Homo sapiens
  misc_feature: NA.19.28.C06.1.454.light.1.nb
tggggagtctgcaccatggcttggaccccactcctcttcctcaccctcctcctccactgcacagggtctctctcccagcttgtgctgactcaatcgccctctgcctctgccctccctgggagcctcggtcaagctcatctgcactctgagcagtgggcacagcaactacgccatcgcatggcatcagcagcagccagagaagggccctcggtacttgatgaaggttaacagtgatggcagccacgacgaaggggacggatcccgtgatcgttttcagggtccagctcgtggggctgagcgctacctcaccatctccagcctccagtctgaggatgaggctgacta

SEQ ID NO: 296864 - DNA, 92 bp, Homo sapiens
  misc_feature: NA.19.28.C06.2.454.light.1.nb
ggctggagatcaaaggaactgtggctgcaccatctgtcttcatcttcccgccatctgacacgagagtactgagcgggctggcaaggcgcata

SEQ ID NO: 296865 - DNA, 338 bp, Homo sapiens
  misc_feature: NA.19.31.C09.1.454.light.1.nb
  modified_base (323)..(323): a, c, t, g, unknown or other
  misc_feature (323)..(323): n is a, c, g, or t
agatggtgttgcagacccaggtcttcatttctctgttgctctggatctctggtgcctacggggacatcgtcatgacccagtctccagactccctggctgtgtctctgggcgagagggccaccatcaactgcaagtccagccagagtgttttatacagctccaacaataagaactacttaacttggtatcagcagaaaccaggacagcctcctaaggtgctcatttcctgggcatctacccgggaatccggggtccctgaccgattcagtggcagcggtctgggacagatttcactctcagcatcagcgcctgcaggctgaagntgtggctagtttatt

SEQ ID NO: 296866 - DNA, 323 bp, Homo sapiens
  misc_feature: NA.19.5.A05.2.454.light.1.nb
gtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgt

SEQ ID NO: 296867 - DNA, 352 bp, Homo sapiens
  misc_feature: NA.19.57.F02.1.454.light.1.nb
tcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtgggtccctcaaggttcagcggcagtggatcgtgggacagatttcactctcgccatcagcagcctgcagactgaagtattttgctaactttattttt

SEQ ID NO: 296868 - DNA, 220 bp, Homo sapiens
  misc_feature: NA.19.59.F04.1.454.light.1.nb
tgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagtaattttgtgtcctggtaccagcagctcccag

SEQ ID NO: 296869 - DNA, 317 bp, Homo sapiens
  misc_feature: NA.19.60.F05.1.454.light.1.nb
tgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgccatctgacacgagagtactgag

SEQ ID NO: 296870 - DNA, 373 bp, Homo sapiens
  misc_feature: NA.19.67.G01.2.454.light.1.nb
acaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaactattttcccacctccaagaacaaaaacttcttagcctggtaccaacagagaccaggacagcctcctaagttgctcatttactgggcttctacgcgcgaattccggggtccctgaccgattccggggcagcgggtctgggacagatttcactctcaccatcagcagcctgcaggctgaagatgtggctagtttatactgtcagctaat

SEQ ID NO: 296871 - DNA, 393 bp, Homo sapiens
  misc_feature: NA.19.71.G05.2.454.light.1.nb
gaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaactaatattattatacttcgtg

SEQ ID NO: 296872 - DNA, 73 bp, Homo sapiens
  misc_feature: NA.19.73.G07.2.454.light.1.nb
tatgcgccttgccagcccgctcagtactctcgtgggaagtagtccttgaccaggcagcccagggccgctgtgc

SEQ ID NO: 296873 - DNA, 105 bp, Homo sapiens
  misc_feature: NA.19.73.G07.3.454.light.1.nb
ccagcacctgaactcctgggggaccgtcagtcttcctcttcccccaaaacccaaggacaccctcatgatctcccggacccctgaggtcacatgcgtggtggtgga

SEQ ID NO: 296874 - DNA, 356 bp, Homo sapiens
  misc_feature: NA.19.75.G09.1.454.light.1.nb
agcaagcatagtgggaatctgcaccatgccctgggctctgctcctcctgaccctcctcactcactctgcagtgtcagtggtccaggcagggctgactcagccaccctcggtgtccgagggcttgggacgaaccgccactctcacctgcactgggaacagcaacaatgttggcaaccgaaggggcagcttggctgcagcagcaccggggccaccctcccaagctcctgtcctacaggaataccaaccggccctcagggatctcagagagattctctgcatccaggtcaggaaacacagcctcctgaccatttctggactccagcctgacgacgaggctgactattactgttcagcgt

SEQ ID NO: 296875 - DNA, 409 bp, Homo sapiens
  misc_feature: NA.19.78.H01.1.454.light.1.nb
gacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctcctgacaatctctgggctccaggctgaggacgaggctgattactactgctgctcatatgcaggtcgtatctcttatgtcttcggactgggaccaaggtc

SEQ ID NO: 296876 - DNA, 397 bp, Homo sapiens
  misc_feature: NA.19.81.H04.1.454.light.1.nb
gtcccttccaatatcagcaccatggcctggactcctctctttctgttcctcctcacttgctgcccagggtccaattcccaggttgtggtgactcaggagccctcactgactgtggccccaggagggacagtcactctcacctgtggctccaacgctggacgtgtcacctctgatcaatactccctattggtatcagcagaagcctggccaagcccccaagacactgatttctgatacaaccaacagacattccttgacacccgcccgcttttcaggttacctccttgggggcaaagctgccctgaccctttcgggcgcgcagcctgaggatgaggcagagtacctgtgttccctcgtccacttccggttttttgtgttcggcggtagggaccagact

SEQ ID NO: 296877 - DNA, 409 bp, Homo sapiens
  misc_feature: NA.19.83.H06.1.454.light.1.nb
tgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagacgcctcctacatagtaatggacacaactatttggattggtacctgcagaagccagggcagtctccacagctcctgatctatttgggttctaatcgggcctccggggtccctgacaggttcagtggcagtggatcaggcacagattttacactagaaatcaacagagtggaggctgaggatgttggggtttattactgcatgcaagctctacaactccctcaacgttcggcggaggaccaaggtgagatacgaaacgac

SEQ ID NO: 296878 - DNA, 358 bp, Homo sapiens
  misc_feature: NA.19.85.H08.1.454.light.1.nb
gagcttcagcaagcatagtgggaatctgcaccatgccctgggctctgctcctcctgaccctcctcactcactctgcagtgtcagtggtccaggcaggactgactcagccacccgtcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctacaaacatttcagagagattttcacctccaggacacaaaatcagcctctctgaccattactggtctccagcctgacgacgaggctgactactactgctca

SEQ ID NO: 296879 - DNA, 418 bp, Homo sapiens
  misc_feature: NA.19.86.H09.2.454.light.1.nb
cgtgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaaccggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggtttcggcggagggaccaagctgaccgtcctaagtcagcccaaggctgcccctcggtcactctcgttcccaccctcctccacgagagtactgagcgggctggcaaggcgcat

SEQ ID NO: 296880 - DNA, 84 bp, Homo sapiens
  misc_feature: NA.1.1.A01.2.454.light.1.nb
atcaaacgaactgtggctgcaccatctgtcttcatcttcccgccatctgaacgcactcgtctgagcgggctggcaaggcgcata

SEQ ID NO: 296881 - DNA, 87 bp, Homo sapiens
  misc_feature: NA.1.15.B04.2.454.light.1.nb
gaaatcaaacgaactgtggctgcaccatctgtcttcatcttcccaccctcctcacgcactcgtctgagcgggctggcaaggcgcata

SEQ ID NO: 296882 - DNA, 87 bp, Homo sapiens
  misc_feature: NA.1.15.B04.3.454.light.1.nb
gaaatcaaacgaactgtggctgcaccatctgtcttcatcttcccgccatctgatatacgatcgctgagcgggctggcaaggcgcata

SEQ ID NO: 296883 - DNA, 90 bp, Homo sapiens
  misc_feature: NA.1.16.B05.1.454.light.1.nb
agctggagatcaaacgaactgtggctgcaccatctgtcttcatcttcccgcctctcacgcactcgtctgagcgggctggcaaggcgcata

SEQ ID NO: 296884 - DNA, 99 bp, Homo sapiens
  misc_feature: NA.1.19.B08.1.454.light.1.nb
gggaccaaggtggaaatccaacgaactgtggctgcaccatctgtcttcatcttcccgccatctgaacgcactcgtctgagcgggctggcaaggcgcata

SEQ ID NO: 296885 - DNA, 82 bp, Homo sapiens
  misc_feature: NA.1.2.A02.2.454.light.1.nb
cctgcagggccagtcagagtgttagcaacaactacttagcctggtaccagcagaaacctggccaggctcccaggctcctcat

SEQ ID NO: 296886 - DNA, 188 bp, Homo sapiens
  misc_feature: NA.1.23.C01.1.454.light.1.nb
aggcatagattttacactgaaaatcagcagagtggaggctgaggacgttggggtttattactgcatgcaaggtctacaaaccccgatcaccttcggccgagggacacgcctggagattaaacgaactgtggctgcaccatctgtcttcatcttcccgccatctgaacgcactcgtctgagcgggctgg

SEQ ID NO: 296887 - DNA, 178 bp, Homo sapiens
  misc_feature: NA.1.23.C01.2.454.light.1.nb
aaggttcagcggcagtggatctgggacagaattcactctcaccatcagcagcctgcaccctgatgattttgcaacttactactgccaacagtataatagttatccccggacgttcggccaagggaccaaggtggaaatcaaacgactgtggctgcaccatctgtcttcatcttcccgc

SEQ ID NO: 296888 - DNA, 130 bp, Homo sapiens
  misc_feature: NA.1.23.C01.3.454.light.1.nb
ggagacaaagacagggtggcctggagactgtgtcaacacaatttctccggtggtatctgggagccagagtagcaggaggaagagaagctgagctggggcttccatggttccctctgggtcctaactgagc

SEQ ID NO: 296889 - DNA, 114 bp, Homo sapiens
  misc_feature: NA.1.23.C01.4.454.light.1.nb
gtgttcggcggagggaccaagctgaccgtcctaggtcagcccaaggctgccccctcggtcactctgttcccaccctcctctctctcgactctgagcgggctggcaaggcgcata

SEQ ID NO: 296890 - DNA, 189 bp, Homo sapiens
  misc_feature: NA.1.24.C02.1.454.light.1.nb
tgaccgattcagtggcagcgggtctgggacagatttcactctcaccatcagcagcctgcagcctgaagattttgcaacttattactgtcaacagcttaatagttacccttacacttttggccaggggaccaagctggagatcaaacgaactgtggctgcaccatctgtcttcatcttcccgccatctga

SEQ ID NO: 296891 - DNA, 24 bp, Homo sapiens
  misc_feature: NA.1.24.C02.3.454.light.1.nb
tatgcgccttgccagcccgctcag

SEQ ID NO: 296892 - DNA, 474 bp, Homo sapiens
  misc_feature: NA.1.25.C03.1.454.light.1.nb
cccagtcaggacacagcatggacatgagggtccccgctcagctcctggggctcctgctgctctggttcccaggttccagatgcgacatccagatgacccagtctccatcttccgtgtctgcatctgtcggagacagagtcaccatcacttgtcgggcgagtcagggtattagcagctggttagcctggtatcagcagaaaccagggaaagcccccaaactcctgatctatgctgcatccagtttgaaaagtggggtcccatcaaggttcagcggcagtggatctgggacagatttcactctcaccatcagcagcctgcagcctgaagattttgcaagttactattgtcaacaggccaacagtttccctcgaacgttcggccaagggaccaaggtggaaaccaaacgaactgtggctgcaccatctgtcttcatcttcccgcatctcacgcactcgtctgagcgggctggcaagg

SEQ ID NO: 296893 - DNA, 175 bp, Homo sapiens
  misc_feature: NA.1.25.C03.2.454.light.1.nb
ccatcagcgattctttagcctggttgcagcagaaaccagggcgagcccctcagatcgtagtctatggtgcatccagattgcaaggtggggtcccatccaggttcagtggcagtgcatctgggacagtattacactctcactatcagcagcctgcagcctagaagtatttgactaa

SEQ ID NO: 296894 - DNA, 87 bp, Homo sapiens
  misc_feature: NA.1.25.C03.4.454.light.1.nb
agactgacggtcctgccacagcggccctgggctgcctggtcaaggactacttccacgtactctctgagcgggctggcaaggcgcata

SEQ ID NO: 296895 - DNA, 72 bp, Homo sapiens
  misc_feature: NA.1.27.C05.1.454.light.1.nb
tatgcgccttgccagcccgctcagagagtgcgtggaagtagtccttgaccaggcagcccagggccgctgtgc

SEQ ID NO: 296896 - DNA, 282 bp, Homo sapiens
  misc_feature: NA.1.32.C10.1.454.light.1.nb
  modified_base (213)..(213): a, c, t, g, unknown or other
  misc_feature (213)..(213): n is a, c, g, or t
agtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaacncccctaacctcctgatctatgctgcagccatttgcaaagtggatcccagtcgaggttcagtggctaggt

SEQ ID NO: 296897 - DNA, 488 bp, Homo sapiens
  misc_feature: NA.1.34.D01.1.454.light.1.nb
agaccctgtcaggacacagcatggacatgagggtccccgctcagctcctggggctcctgctgctctggctcccaggtaccagctgtgacatccaattgacccagtctccatcctccctgtctgcatctattggagacagagtcaccatcacttgccgggcgagtcaggccatcagcgattctttagcctggttgcagcagaaaccagggcgagcccctcagatcgtagtctatggtgcatccagattgcaaggtggggtcccatccaggttcagtggcagtgcatctgggacagattacactctcactatcagcagcctgcagcctgaagattttgctaatttattactgtcaacagtattatagtacccctagtggacgttcggccaggggaccaaggtggaagtcaaccgaactgtggctgcaccatctgtcttcatcttcccgccatctgaacgcactcgtctgagcgggctggcaaggcgcata

SEQ ID NO: 296898 - DNA, 44 bp, Homo sapiens
  misc_feature: NA.1.34.D01.3.454.light.1.nb
agcgggaccctcgatgtcccatgcgtgtgtcctcgaccagggtc

SEQ ID NO: 296899 - DNA, 88 bp, Homo sapiens
  misc_feature: NA.1.36.D03.3.454.light.1.nb
tatgcgccttgccagcccgctcagagcgtcgtcttcagatggcgggaagatgaagacagatggtgcagccacagttcgtttgatctcc

SEQ ID NO: 296900 - DNA, 225 bp, Homo sapiens
  misc_feature: NA.1.39.D06.1.454.light.1.nb
tattcagcaggcacacaacagaggcagttacagatttcactctcaccatcagcagtctgcaacctgaagattttgccacttactactgtcaacagagtttcgatgcctggacgtggacgttcggccaagggaccagggtggatatcaaacgactgtggctgcaccatctgtcttcatcttcccgccatctgaacgcactcgtctgagcggctggcaaggcgcata

SEQ ID NO: 296901 - DNA, 86 bp, Homo sapiens
  misc_feature: NA.1.43.D10.1.454.light.1.nb
aaatcaaacgaactgtggctgcaccatctgtcttcatcttcccgccctcctcacgtctactgctgagcgggctggcaaggcgcata

SEQ ID NO: 296902 - DNA, 85 bp, Homo sapiens
  misc_feature: NA.1.43.D10.2.454.light.1.nb
agtcaaacgaactgtggctgcaccatctgtcttcatcttcccgccatctgaacgcactcgtctgagcgggctggcaaggcgcata

SEQ ID NO: 296903 - DNA, 73 bp, Homo sapiens
  misc_feature: NA.1.44.D11.1.454.light.1.nb
ctgtggctgcaccatctgtcttcatcttccgccatctgaacgcactcgtctgagcgggctggcaaggcgcata

SEQ ID NO: 296904 - DNA, 73 bp, Homo sapiens
  misc_feature: NA.1.45.E01.1.454.light.1.nb
agcccgctcagacgagtgcgttcagatggcgggaagatgaagacagatggtgcagccacagttcgtttgattt

SEQ ID NO: 296905 - DNA, 213 bp, Homo sapiens
  misc_feature: NA.1.46.E02.1.454.light.1.nb
ctgcagggccagtcagagtgttagcaacaactacttagcctggtaccagcagaaacctggccaggctcccaggctcctcatctatggtgcatccagcagggccactggcatcccagacaggttcagtggcagtgggtctgggacagacttcactctcaccatcaccagactggagcctgaagattttgcagtgtattactgtcagcagtatgg

SEQ ID NO: 296906 - DNA, 123 bp, Homo sapiens
  misc_feature: NA.1.46.E02.3.454.light.1.nb
aagttcacctctgtcgttcggccaagggaccaaggtagaaatgaaacgaactgtggctgcaccatctgtcttcatcttcccgcatctgactcgtctctactgagcgggctggcaaggcgcata

SEQ ID NO: 296907 - DNA, 59 bp, Homo sapiens
  misc_feature: NA.1.5.A05.5.454.light.1.nb
gtcttccacctggccaccctcctcacgtctacgtgctgagcgggctggcaaggcgcata

SEQ ID NO: 296908 - DNA, 88 bp, Homo sapiens
  misc_feature: NA.1.59.F04.1.454.light.1.nb
tatgcgccttgccagcccgctcagacgagtgcgttcagatggcgggaagatgaagacagatggtgcagccacagttcgtttgatctcc

SEQ ID NO: 296909 - DNA, 221 bp, Homo sapiens
  misc_feature: NA.1.60.F05.1.454.light.1.nb
tgaccgattcagtggcagcgggtctgggacagatttcactctcaccatcagcagcctgcaggctgaagatgtggcagtttatttctgtcagcaatattatactactcttccaactttcggccctgggaccaaagtggctatcaaacgactgtggctgcaccatctgtcttcatcttcccgcatctgaacgcactcgtctgagcgggctggcaaggcgcata

SEQ ID NO: 296910 - DNA, 107 bp, Homo sapiens
  misc_feature: NA.1.62.F07.1.454.light.1.nb
ttcggccctgggaccaaagtggatttcaaacgaactgtggctgcaccatctgtcttcatcttcccgcatctgaacgcactcgtctgagcgggctggcaaggcgcata

SEQ ID NO: 296911 - DNA, 308 bp, Homo sapiens
  misc_feature: NA.1.64.F09.1.454.light.1.nb
cctgcagggccagtcagagtgttaggagcaagttagcctggtaccagcagaaacctggccaggctcccagactcctcatctatcttgcatccaccagggccactggtatccccgcaggttcagtggcagtgggtctgggacagagttcactctcaccatcagcagcctgcagtctgaagactttgcagtttattactgtcagcagtataatgactggcctccggggtttgccaggggaccaagctggagatcaaacgaactgtggctgcacatctgtcttcatcttcccgcatctgaacgcactcgtc

SEQ ID NO: 296912 - DNA, 117 bp, Homo sapiens
  misc_feature: NA.1.67.G01.1.454.light.1.nb
agagttcactctcaccatcaccagtctgcagtctgaagattttgcagtttattactgtcagcagtataatgactggcctccgatcaccttcggccaagggacacgactggatattag

SEQ ID NO: 296913 - DNA, 84 bp, Homo sapiens
  misc_feature: NA.1.67.G01.2.454.light.1.nb
acgaactgtggctgcaccatctgtcttcatcttcccgccatctgaacgcactcgtctgagcgggctggcaaggcgcataaggct

SEQ ID NO: 296914 - DNA, 86 bp, Homo sapiens
  misc_feature: NA.1.68.G02.1.454.light.1.nb
aaatcaaacgaactgtggctgcaccatctgtcttcatcttcccgccatctgaacgcactcgtctgagcgggctggcaaggcgcata

SEQ ID NO: 296915 - DNA, 87 bp, Homo sapiens
  misc_feature: NA.1.70.G04.1.454.light.1.nb
tatgcgccttgccagcccgctcagacgagtgcgtgaagagggcgggaagatgaagacagatggtgcagccacagttcgcttgacttc

SEQ ID NO: 296916 - DNA, 218 bp, Homo sapiens
  misc_feature: NA.1.76.G10.1.454.light.1.nb
caggttcagtggcagtgggtctgggacagacttcactctcacaatcagcagactggagcctgaagattttgcagtgtattactgtcaccagtatggtagttcacctcgaacttttggccaggggaccaggctggagatcaaacgaactgtggctgcaccatctgtcttcatcttccacctcctcacgcactcgtctgagcgggctggcaaggcgcata

SEQ ID NO: 296917 - DNA, 93 bp, Homo sapiens
  misc_feature: NA.1.77.G11.1.454.light.1.nb
tgaccgattcagtggcagcgggtctgggacagatttcactctcaccatcagcagcctgcaggctgaagatgtggcagtttattactgtcagca

SEQ ID NO: 296918 - DNA, 44 bp, Homo sapiens
  misc_feature: NA.1.77.G11.2.454.light.1.nb
gtcgtgtcccttggccgaaggtggtcgaaagaatactataataa

SEQ ID NO: 296919 - DNA, 89 bp, Homo sapiens
  misc_feature: NA.1.77.G11.3.454.light.1.nb
tatgcgccttgccagcccgctcagacgagtgcgttcagatggcgggaagatgaagacagatggtgcagccacagttcgtttgatctcca

SEQ ID NO: 296920 - DNA, 164 bp, Homo sapiens
  misc_feature: NA.1.8.A08.1.454.light.1.nb
cagatttcactctcaccatcagcagcctgcagcctgaagattttgcaacttattactgtcaacaggttaatagttaccctctcgtcacttttggccaggggaccaagctggagatcaaacgaactgtggctgcaccatctgtcttcatcttccgccatctgaac

SEQ ID NO: 296921 - DNA, 84 bp, Homo sapiens
  misc_feature: NA.1.80.H03.1.454.light.1.nb
gatcaaacgaactgtggctgcaccatctgtcttcatcttcccgcctcctcacgcactcgtctgagcgggctggcaaggcgcata

SEQ ID NO: 296922 - DNA, 170 bp, Homo sapiens
  misc_feature: NA.1.89.I01.10.454.light.1.nb
acaatgataaacgaccctcaggaatttctgaccgattctctggctccaagtctggcctgtcagcctccctgggcatcaccggactccaaactggggacgaggccgattattactgcgagacatgggatagtaacttgaatgttgggcgattcggcggagggaccaagttg

SEQ ID NO: 296923 - DNA, 125 bp, Homo sapiens
  misc_feature: NA.1.89.I01.13.454.light.1.nb
tatgcgccttgccagcccgctcagacgagtgcgttcagatggcgggaagatgaagacagatggtgcagccacagttcgtttgatttccaccttggtcccttggccgaacgtccaccacagtgaga

SEQ ID NO: 296924 - DNA, 224 bp, Homo sapiens
  misc_feature: NA.1.89.I01.2.454.light.1.nb
agtcctgggcccagtctgccctgactcagcctgcctccgtgtctgggtctcctggacagtcgatcaccatctcctgcactggaaccagcagtgacgttggtggttatgactatgtctcctggtaccaacatcacccaggcaaaggccccagactcatgatttatgaggtcagtcatcggccctcaggggtttctaatcgcttctctggctccaagtctggcaac

SEQ ID NO: 296925 - DNA, 83 bp, Homo sapiens
  misc_feature: NA.1.89.I01.4.454.light.1.nb
atgagtctacttactattgtgtcctttacttgcgtgatggcattttggctgttcggcggagggaccaaactgaccgtcctagg

SEQ ID NO: 296926 - DNA, 110 bp, Homo sapiens
  misc_feature: NA.1.89.I01.6.454.light.1.nb
ctgaccctctcgggtgcgcagcctgacgatgaggctgactattactgcttcctctcctggcacggtgctctgccggcgttcggcggagggaccaaggtgatcgtcctaag

SEQ ID NO: 296927 - DNA, 277 bp, Homo sapiens
  misc_feature: NA.1.89.I01.7.454.light.1.nb
taggacccagagggaaccatggaagccccagctcagcttctcttcctcctgctactctggctcccagataccaccggagaaattgtgttgacacagtctccagccaccctgtctttgtctccaggggaaagccaccctctcctgcagggccagtcagagtgttagcagctacttagcctggtaccaacagaaacctggccaggctcccaggctcctcatctatgatacatccaacagggccactggcatcccagccaggttcagtggcaggtgggtc

SEQ ID NO: 296928 - DNA, 217 bp, Homo sapiens
  misc_feature: NA.21.11.A11.1.454.light.1.nb
ttgggatggggagagagacccctcccctgggatcctgcagctccaggctgaagacgagggtgattattactgttgctcttatacgagaaggggcgccacgtatgtcttcggaagtgggaccacggtcaccgtcctaggtcagcccaaggccaaccccactgtcactctgttcccaccctcctcctcgtctctactgagcgggctggcaaggcgcata

SEQ ID NO: 296929 - DNA, 280 bp, Homo sapiens
  misc_feature: NA.21.2.A02.1.454.light.1.nb
caggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccag

SEQ ID NO: 296930 - DNA, 114 bp, Homo sapiens
  misc_feature: NA.21.2.A02.2.454.light.1.nb
gtggttattattcctggggccagggtaaccctggtaaccgtctcctcagcctccaccaagggcccatcggtcttccccctggcgccctgctccaggagcacctccgagagcaca

SEQ ID NO: 296931 - DNA, 522 bp, Homo sapiens
  misc_feature: NA.21.22.B11.1.454.light.1.nb
cttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtctaggtcagcccaaggctgccccctggtcactctgttcccgccctcctcctcgtctctactgagcgggctggcaaggcgcata

SEQ ID NO: 296932 - DNA, 386 bp, Homo sapiens
  misc_feature: NA.21.27.C05.2.454.light.1.nb
  modified_base (302)..(302): a, c, t, g, unknown or other
  misc_feature (302)..(302): n is a, c, g, or t
gctcagttaggacccagacggagccatggaagccccagcgcagcttctcttcctcctgcttctctggctcccagacaccactggagtgattgtgatgacgcagtctccagccaccctgtctgtgtctccgaggggggacgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagtagttttcnctcaccatcagcgccctacagagtgaagatgttgctagtttattctgccagcaatataattactggcctgcgtcgacgttcggc

SEQ ID NO: 296933 - DNA, 122 bp, Homo sapiens
  misc_feature: NA.21.27.C05.3.454.light.1.nb
  modified_base (4)..(4): a, c, t, g, unknown or other
  misc_feature (4)..(4): n is a, c, g, or t
aaangttactctctcctgcaaggccagtcagagtgttggcatcgacgttgcctggtaaccaacaaaaacctggccaggctcccagtctcctcatctatggggcatcctacaggatgaccggc

SEQ ID NO: 296934 - DNA, 389 bp, Homo sapiens
  misc_feature: NA.21.30.C08.1.454.light.1.nb
aggaggcagaactctgggtgtctcaggaggcagagctctgggaatctcaccatggcctggacccctctcctgctccccctcctcactttctgcacagtctctgaggcctcctatgagctgacacagccaccctcggtctcagtgtccccgggacaaacggccaggatcacctgctctggagatgcattgaccaaaaaatttgtttttggaccagcagaagtcaggccaggcccctgtgttggtcatccatgaggacaggagacgaccctccgggatccctgagagattctctggctccaactcagggacggtggccacgttgattctcagtggggcccagggtggaggatgaagctgactactactgttactcagcagacagcagtggt

SEQ ID NO: 296935 - DNA, 232 bp, Homo sapiens
  misc_feature: NA.21.30.C08.2.454.light.1.nb
aggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctgcagatggactgaccaaagaatatgcttattggtaccaacagaagccaggccaggcccctgtgttagtgatatataaa

SEQ ID NO: 296936 - DNA, 344 bp, Homo sapiens
  misc_feature: NA.21.32.C10.1.454.light.1.nb
cagtcaggacacagcatggacatgagggtccccgctcagctcctggggctcctgctactctggctccgaggtgccagatgtgacatccagatgacccagtctccatcctccctgtctgcatccagtaggagacagagtcaccatcacttgtcgggcaagccagagcattaccaactatttgaattggtatcagtttaaaccagggaaagcccctaaactcctgatctatgctgcatccactttgcaaagtgggtctcagcaaacttcattggccgtggatcgtgggacagatttcactctcaccatcagcagtttgcaacctgacgattttgactaacttacta

SEQ ID NO: 296937 - DNA, 371 bp, Homo sapiens
  misc_feature: NA.21.33.C11.1.454.light.1.nb
gaagagctgctcagtcaggacccagagggaaccatggaaaccccagcgcagcttctcttcctcctgctactctggctcccagaaaccaccggagagattgtgttgacgcagtctccaggcaccctgtctttgtctccaggggacagacgccaccctctcctgcggggccagtcaaattgtacccgcgactacttagcctggtaccagcagaaacctggccaggctcccagactcctcatccacaatatattctacagggcccgggcatcccagacaggttcagtggcagtgggtctgggacagacttcactctcaccatcagcagactggagcctgaagatttgcaatgtattactgtcagcaatatgctc

SEQ ID NO: 296938 - DNA, 109 bp, Homo sapiens
  misc_feature: NA.21.36.D03.2.454.light.1.nb
tatgcgccttgccagcccgctcagtagagacgagggaagtagtccttgaccaggcagcccagggccgctgtgcccagcacctgaactcctggggaccgtcagtcttcct

SEQ ID NO: 296939 - DNA, 496 bp, Homo sapiens
  misc_feature: NA.21.38.D05.1.454.light.1.nb
tctggagaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaaggttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttcccgcatctgactcgtctctactgagcgggctggcaaggcgcata

SEQ ID NO: 296940 - DNA, 335 bp, Homo sapiens
  misc_feature: NA.21.39.D06.1.454.light.1.nb
tcagacccagtcaggacacagcatggacatgagggtccccgctcagctcctggggctcctgctgctctggttcccaggctccagatgcgacatccagatgacccagtctccatcctccgtgtctgcgtctgtaggagacagagtcaccatcacttgtcgggcgagtcagggtattagcagctggttagcctggtatcagcagaaaccagggaaacgcccctaaaactcctgatctatgctgcatccagtttggaaagtgggtcccatcaaggttcagcggcagtggatcgtgggacagatttcactctcaccatcagcagcctgcagcctgaagt

SEQ ID NO: 296941 - DNA, 294 bp, Homo sapiens
  misc_feature: NA.21.4.A04.2.454.light.1.nb
ctcagaaaccaccggagaaattgtgttgacgcagtctccaggcaccctgtctttgtctccaggggaaagcgccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatgg

SEQ ID NO: 296942 - DNA, 178 bp, Homo sapiens
  misc_feature: NA.21.4.A04.3.454.light.1.nb
  modified_base (64)..(64): a, c, t, g, unknown or other
  misc_feature (64)..(64): n is a, c, g, or t
tgtcaccggagaagttgtcttgacgcagtctccaggcaccctgtctctgtctccaggggaaagngttactctctcctgcaaggccagtcagagtgttggcatcgacgttgcctggtaccaacaaaacctggccaggctccagtctcctcatctatggggcatcctacaggatgaccgg

SEQ ID NO: 296943 - DNA, 244 bp, Homo sapiens
  misc_feature: NA.21.46.E02.2.454.light.1.nb
gcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtacaaacagtagacagtagaggtactcattgggtgttcggcggagggaccaagg

SEQ ID NO: 296944 - DNA, 125 bp, Homo sapiens
  misc_feature: NA.21.46.E02.3.454.light.1.nb
ggagattcattgaccaaaagatatacttgttggttccagcagaagtcaggccaggcccctgtactggtcatccatgaggccagtcgacgacactccgggatccctgagagattctctgcctcagc

SEQ ID NO: 296945 - DNA, 331 bp, Homo sapiens
  misc_feature: NA.21.55.E11.1.454.light.1.nb
tctcagtcaggacacagcatggacatgagggtccccgctcagctcctggggctcctgctactctggctccgaggtgccagatgtgacatccagatgacccagtctccatcatccctgtctgcatctgtcggagacagaatcaccattatttgccggacaagtcacgacataaacaccttttaaatggtatcagcacaaaccagggaagccccaaagctcctgatcgatgctgcatccaatttagagagtgggtcccatccaggttcagtggcgatggatctgggacaaatttcactctcaccatcagcagtctgcaacctgaagtattttg

SEQ ID NO: 296946 - DNA, 323 bp, Homo sapiens
  misc_feature: NA.21.59.F04.1.454.light.1.nb
cagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaagtgaggtccatcaaggttcggcggcagtggatcgtgggacagaattcactctcaccatcagcagcctgcag

SEQ ID NO: 296947 - DNA, 145 bp, Homo sapiens
  misc_feature: NA.21.62.F07.1.454.light.1.nb
tatgcgccttgccagcccgctcagtagagacgagggaagtagtccttgaccaggcagcccagggccgctgtgcccagagcccaaatcttgtgacacacctcccccatgcccacggtgcccagcacctgaactcctgggaggaccg

SEQ ID NO: 296948 - DNA, 288 bp, Homo sapiens
  misc_feature: NA.21.71.G05.1.454.light.1.nb
cctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccagtgtccagtggggaagttgtgatgactcagtctccactctccctgcccgtcgcccttggacagccggcctccatctcctgcaggtctagtcagagcgtcgtgtacagtgacggtaacacctacctcaactggtttcaccagaggccagg

SEQ ID NO: 296949 - DNA, 155 bp, Homo sapiens
  misc_feature: NA.21.74.G08.1.454.light.1.nb
tggccccggggttttggtctgagcctcagtcactgtgttatgtcttcggaactgggaccaaggtcaccgtcctaggtcagcccaaggccaaccccactgtcactctgttcccaccctcctcctcgtctctactgagcgggctggcaaggcgcata

SEQ ID NO: 296950 - DNA, 227 bp, Homo sapiens
  misc_feature: NA.21.75.G09.1.454.light.1.nb
gtcgcttctctggatccaaagatgcttcggccaatgcagggattctcctcatctctggcctccagtctgaggatgaggctgactattactgtatgatttggcacagcgcttatgtcttcggaactgggaccaaggtcaccgtcctaggtcagcccaaggccaaccccactgtcactctgttcccaccctcctcctcgtctctactgagcgggctggcaaggcgcata

SEQ ID NO: 296951 - DNA, 130 bp, Homo sapiens
  misc_feature: NA.21.8.A08.1.454.light.1.nb
aggaggcagagctctgggaatctcaccatggcctggacccctctcctgctccccctcctcactttctgcacagtctctgaggcctcctatgagctgacacagccaccctcggtgtcagtgtccccaggac

SEQ ID NO: 296952 - DNA, 248 bp, Homo sapiens
  misc_feature: NA.21.8.A08.3.454.light.1.nb
aaacggccaggatcacctgctctggagattcattgaccaaaagatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcgaggggta

SEQ ID NO: 296953 - DNA, 207 bp, Homo sapiens
  misc_feature: NA.21.8.A08.4.454.light.1.nb
agacggccaggatcacctgctctgcagatggactgccaaagaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgacta

SEQ ID NO: 296954 - DNA, 309 bp, Homo sapiens
  misc_feature: NA.21.87.H10.1.454.light.1.nb
aagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggccttt

SEQ ID NO: 296955 - DNA, 334 bp, Homo sapiens
  misc_feature: NA.22.14.B03.2.454.light.1.nb
tatttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggctagtttattattgtcagcaatattatattcctcctcagacgttcggccaagggaccaaggtggaaatcaaacgaactgtggctgcaccatctgtcttcatcttcccgccatctgaacgcgtatgtctgagcgggctggcaaggcgcata

SEQ ID NO: 296956 - DNA, 108 bp, Homo sapiens
  misc_feature: NA.22.14.B03.3.454.light.1.nb
atttttacagctccaccaataagagctacttagcttggttccagcagaaaccaggacatcctcctctactgctcatttactgggcgtctacccgggaatccggggtcc

SEQ ID NO: 296957 - DNA, 100 bp, Homo sapiens
  misc_feature: NA.22.15.B04.1.454.light.1.nb
aggaggcagcgctctcaggacgtcaccaccatggcctgggctctgctcctcctcagcctcctcactcagggcacagggtcctgggcccagtctgccctga

SEQ ID NO: 296958 - DNA, 221 bp, Homo sapiens
  misc_feature: NA.22.15.B04.2.454.light.1.nb
  modified_base (139)..(139): a, c, t, g, unknown or other
  misc_feature (139)..(139): n is a, c, g, or t
ctcagcctccctccgcgtccgggtctcctggacagtcagtcaccatctcctgcactggaaccagcagtgacgttggtgttataactatgtctcctggtaccaacaacacccaggcaaacgcccccaaatcatgatttangaggtcactaagcggccctcgacggggtccctgatcgcttctctggctcaagtctggcaacacggcctccctgacccgtctc

SEQ ID NO: 296959 - DNA, 176 bp, Homo sapiens
  misc_feature: NA.22.15.B04.3.454.light.1.nb
cccagcctgcctccgtgtctggatcatctggacagtcgatcagcatttcctgcactgggaccaacagtgacattgggtcttttgactctgtctcctggtaccaacaacaccaggccaaacccccaactcatcatttatgtgtcactcgtcggccctcaggagtctctcatcgcttc

SEQ ID NO: 296960 - DNA, 364 bp, Homo sapiens
  misc_feature: NA.22.20.B09.1.454.light.1.nb
ggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagtctttatgttaattcacc

SEQ ID NO: 296961 - DNA, 267 bp, Homo sapiens
  misc_feature: NA.22.20.B09.2.454.light.1.nb
  modified_base (130)..(130): a, c, t, g, unknown or other
  misc_feature (130)..(130): n is a, c, g, or t
ggacccagagggaaccatggaaaccccagcgcagcttctcttcctcctgctactctggctcccagaaaccaccggagaagttgtgttgacacagtctccagccaccctgtctttgtctccgaggggaaangccaccctctcctgcagggccagtcagagtgttaacagcagcttagcctggtaccagcagaaacctggccaggctcccaggctcctcatctatgatgcatcttacacgggccactggcactcccagccaggttcagt

SEQ ID NO: 296962 - DNA, 367 bp, Homo sapiens
  misc_feature: NA.22.21.B10.1.454.light.1.nb
gcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcggcctcaggggtccctgatcgcttctctggctccaagtctggcgacacggcctccctgaccgtctctgggctccaggctgaggatgaggctgattatactgctactcatatgcaggcgc

SEQ ID NO: 296963 - DNA, 193 bp, Homo sapiens
  misc_feature: NA.22.27.C05.1.454.light.1.nb
caacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtatttttacagctccaccaataagag

SEQ ID NO: 296964 - DNA, 306 bp, Homo sapiens
  misc_feature: NA.22.27.C05.2.454.light.1.nb
ctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaacgactgtggctgcaccatctgtcttcatcttcccgccatctgaacgcgtatgtctgagcgggctggcaaggcgcata

SEQ ID NO: 296965 - DNA, 151 bp, Homo sapiens
  misc_feature: NA.22.27.C05.3.454.light.1.nb
ttacttagcttggttccagcagaaaccaggacatcgtcctgcactgctcatttactgggcgtctacccgggaatccggggtccctgaccgattcagtggcagcggtctgggacagatttcactctcaccatcagcagcctgcaggctgaag

SEQ ID NO: 296966 - DNA, 294 bp, Homo sapiens
  misc_feature: NA.22.29.C07.2.454.light.1.nb
tgccagtgcagaagtagtgatgacgcagtctccaggcaccctgtctgtgtctccgaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactgg

SEQ ID NO: 296967 - DNA, 171 bp, Homo sapiens
  misc_feature: NA.22.29.C07.3.454.light.1.nb
agaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaa

SEQ ID NO: 296968 - DNA, 407 bp, Homo sapiens
  misc_feature: NA.22.30.C08.1.454.light.1.nb
gggagtctgcaccatggcttggaccccactcctcttcctcaccctcctcctccactgcacagggtctctctccaggttgtactgactcaatcgccctctgcctctgcctccctgggagcctcggtcaacctcacctgcgttcttagtagtcaacacgattactacaccgtcgcgtggcatcaacaacagccggagaagggccctcgctactaatgaagattggccattttggcagccaccacaagggggtcgggatccctgatcgcttctcgggctccagctcgtggggccgagcgctacctcaccatctccagcctccagtctgaagatgaggctgactattactgtcagacagtgggacgctggcgtctggctgttcggcggagggaccaagctgaccgtctagg

SEQ ID NO: 296969 - DNA, 307 bp, Homo sapiens
  misc_feature: NA.22.36.D03.2.454.light.1.nb
attcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccaatcatcatttatggtgtcactcgtcggccctcaggagtctctcatcgcttctcaggctccaagtctggcaacacggcctccctaaccatctctgggctccagtttgaggacgagtctacttattactg

SEQ ID NO: 296970 - DNA, 195 bp, Homo sapiens
  misc_feature: NA.22.36.D03.3.454.light.1.nb
cctcctcagcctcctcactcagggcacagggtcctgggcccagtctgccctgactcagcctccctccgcgtccgggtctcctggacagtcagtcaccatctcctgcactggaaccagcagtgacgttggtgttacaagtatgtctctgtaccaacaccaccaggcacagcccccaaatcatgatttatgaggtca

SEQ ID NO: 296971 - DNA, 322 bp, Homo sapiens
  misc_feature: NA.22.5.A05.2.454.light.1.nb
taggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctagaa

SEQ ID NO: 296972 - DNA, 409 bp, Homo sapiens
  misc_feature: NA.22.57.F02.1.454.light.1.nb
ctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggctaacttactactgccaaccgtatagtacttattcggtcaccttcggccaaggg

SEQ ID NO: 296973 - DNA, 361 bp, Homo sapiens
  misc_feature: NA.22.59.F04.1.454.light.1.nb
ctgctcagttaggacccagacggaaccatggaagccccagcgcagcttctcttcctcctgctactctggctcccagtttcagataccactggagaaatagtgatgacgcagtctccagccaccctgtctgtgtctccgaggggaaaggccacactctcctgcagggccagtcagagtgtagcagcagcttagcctggtaccagcagagacctggccaggctcccaggcctcctcatctatggtgcatctacgagggccactggtatcccagccaggttcagtggcagtgggtctgggacagagttcactctcaccatcagcagcctgcagtctgaagtatttgctagtttattactgtcag

SEQ ID NO: 296974 - DNA, 242 bp, Homo sapiens
  misc_feature: NA.22.67.G01.1.454.light.1.nb
gttgagaacctatgaacattctgtaggggccacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctggtcactctgttcccgccctcctcacgcgtatgtctgagcgggctggcaaggcgcata

SEQ ID NO: 296975 - DNA, 362 bp, Homo sapiens
  misc_feature: NA.22.73.G07.1.454.light.1.nb
taggacccagacggaaccatggaagccccagcgcagcttctcttcctcctgctactctggctcccagataccactggagaaatagtgatgacgcagtctccagccaccctgtctgtgtctccaggggaaaggccaccctctcctgcagggccagtcagagtgttagcaacaacttagtctggtaccagcagagacctggccaggctcccaggctcctcatctatggtgcttctaccagggccactggtatccccgcaggttcagtgccagtgggtctgggacagagttcactctcaccatcagcagcctgcagtctgaagtatttgctactttattactgtcagcaatataatgactggttc

SEQ ID NO: 296976 - DNA, 80 bp, Homo sapiens
  misc_feature: NA.22.73.G07.3.454.light.1.nb
aacgaactgtggctgcaccatctgtcttcatcttcccgccatctgaacgcgtatgtctgagcgggctggcaaggcgcata

SEQ ID NO: 296977 - DNA, 371 bp, Homo sapiens
  misc_feature: NA.22.86.H09.2.454.light.1.nb
ctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggtagggaccaag

SEQ ID NO: 296978 - DNA, 147 bp, Homo sapiens
  misc_feature: NA.22.86.H09.3.454.light.1.nb
gcctccgtgtctggatcatctggacagtcgatcagcatttcctgcactgggaccaacagtgacattgggtcttttgactctgtctcctggtaccaacaacacccaggccaaaccccccaactcatcatttatggtgtcactcgtcgg

SEQ ID NO: 296979 - DNA, 492 bp, Homo sapiens
  misc_feature: NA.22.87.H10.1.454.light.1.nb
ctgtgggcacaagaggcagcactcaggacaatctccagcatggcctggtctcctctcctcctcactctcctcgctcactgcacagggtcctgggcccagtctgtgctgacacagccgccctcaatatctggggccccaggacagaaggtcaccatctcctgcactgggtacaactccaacatcggggcatataatgatgtccactggtaccagcaacttccagaaacagccccaaactcctcatctatggtaacaacaatcggccctcaggggtccctgaccgattctctggctccaagtctggcatgtcagcctccctggccatcactgggctccaggctgaggatgaggctgattatttctgccagtcctatgacaacagcctgggtgccgtggtattcggcggaggaccaagctgaccgtctaggtcagcccaaggctcgccccctggtcactctcgttcccgcctcctcacgcgtatgtctgagcggg

SEQ ID NO: 296980 - DNA, 121 bp, Homo sapiens
  misc_feature: NA.22.87.H10.2.454.light.1.nb
gtccgggtcttctggacagtcagtcaccatctcctacactggaaccagcagtgatgttggtgttataactatgtctcctggtaccaacagcacccaggcaaagccccagactcatcattta

SEQ ID NO: 296981 - DNA, 370 bp, Homo sapiens
  misc_feature: NA.22.9.A09.1.454.light.1.nb
agttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtggtctggaagagacttcactctcaccatcaacagcctagagcctgacgattctgctagtttattactgtcagcagcgtaccaagtggcctccga

SEQ ID NO: 296982 - DNA, 61 bp, Homo sapiens
  misc_feature: NA.22.9.A09.2.454.light.1.nb
ttaggacccaggagggaaccagtggaacgccccagctcagtcttcctcttcctctgctact

SEQ ID NO: 296983 - DNA, 310 bp, Homo sapiens
  misc_feature: NA.23.10.A10.2.454.light.1.nb
agccaccctctcctgcagggccagtgacaatgttaggaagttgttagcctggtatcaacacaaacatggccaggctccccggctcctcatctatgatgcatccaatagggccactggcatcccagacaggttcagtggcagtgggtctgggacagacttcactctcaccatcagcagtgtagagcctgaagattttgcagtttattactgtcagcaccgtgacaactggcccactttcggccctgggaccagactggacatccaacgaactgtggctgcaccatctgtcttcatcttcccgccatctgaa

SEQ ID NO: 296984 - DNA, 259 bp, Homo sapiens
  misc_feature: NA.23.21.B10.1.454.light.1.nb
acaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatggttgggacttttaatatggtctcgtggtaccaatacctccaggcaaacgccccaaatcatacttatgaggcactaagcggccctc

SEQ ID NO: 296985 - DNA, 374 bp, Homo sapiens
  misc_feature: NA.23.23.C01.1.454.light.1.nb
ctgctcagtttggacccagagggaaccatggaagccccagctcagcttctcttcctcctgctcctctggctcccagagaccaccggagatattcttttgacacagtctccagacatcgtgtctgtgtctccgaggggagagccaccctctcctgcagggccagtcagagtgttgccgactccttggcctggtaccaacaaaaacctggccagcctcccaggctcgtcattcatggcacatccaacagggccactggcatcccaggcaggttcagtgcagtggctcgtgggacagacttcactctcacgatcagcagtgtcgaccctgacgtatttgctagtttattactgtcagcaacgtggcgcctggcctat

SEQ ID NO: 296986 - DNA, 356 bp, Homo sapiens
  misc_feature: NA.23.24.C02.1.454.light.1.nb
gtctcagtcaggacacagcatggacatgagggtccccgctcagctcctggggctcctgctactctggctccgaggtggcagatgtgacatccagatgacccagtctccatcctccctgtctgcatctgtgggagacacagtcaccatcacttgccgggcaagtcagacaattgacaactatttaaattggtatcgccagagacccgggaaagcccctcacctcctgatctatgctgcgtccactttacaaagtgggtcccatcacggttcagtggcggtggatctgggacagagttcactctcaccatcagcagtctgcagcctgaagtattttgactaacttactactgtacaac

SEQ ID NO: 296987 - DNA, 294 bp, Homo sapiens
  misc_feature: NA.23.26.C04.1.454.light.1.nb
agagcttcagcaagcatagtgggaatctgcaccatgcccggggctctgctcctcctgaccctcctcactcactctgcagtgtcagtggtccaggcaggcctgactcagcccccctgatgtccaaggacatgagacagaccgccacactcacctgcacagggaacgccaacaatgttggcaaccaaggagcagcttggtgcagcagcaccagggcccaccctcccacactcctgtcctacaggaataacaaccggccctcagggatctcagagagattttcgcatccaggtcagg

SEQ ID NO: 296988 - DNA, 336 bp, Homo sapiens
  misc_feature: NA.23.27.C05.2.454.light.1.nb
cctgtcaggacacagcatggacatgagggtccccgctcagctcctggggctcctgctgctctggctcccaggaacgaagggtgacgttcagatgacccagtctccaccctccctgtctgcatctgttggggaccagtcaccatcacttgccgggcgagtcgtgactattttcggttctttagtctggtatcaaacaaaaaccagggtttcgcccctaccgtcctcgtcgctgtcactgacgagttacaaagtggggtcccatcgagattcagtggcagtggaggtgggaccttttacactctcacaatcgccggctgcggcctgaagtattttggg

SEQ ID NO: 296989 - DNA, 110 bp, Homo sapiens
  misc_feature: NA.23.27.C05.3.454.light.1.nb
tgacacacctcccccactgccccaccggtgcccagagcccaaatcttgtgacacacctcccccgtgcccaaggtgcccagcacctgaactcctgggaggaccgtcagtct

SEQ ID NO: 296990 - DNA, 341 bp, Homo sapiens
  misc_feature: NA.23.28.C06.1.454.light.1.nb
caggaggcagaactctgggtgtctctccatggcctggatccctctacttcttcccctcctcactctctgcacagaatctgaggccgcctatgagttgacacagactccgttcggtgtcagtcgtccccgggacacgacggccaggatcacctgctctggagatgcattgccaaagcaatttgcttattggtatcagaagaagccaggtcaggcccctcttctccttatctacaaggacactgagaggccctcagggatacctgttcgcttctctggctccagttcagggacaacagtcacattgagcatcagtggagtccaggcagaagacgaggctgact

SEQ ID NO: 296991 - DNA, 173 bp, Homo sapiens
  misc_feature: NA.23.28.C06.2.454.light.1.nb
ctggctcactctcctcactctttgcataggttctgtggtttcttctgagctgactcaggaccctgctgtgtctgtggccttgggacagacagtcaggatcacatgccaaggagacagcctcagaagctattatgcaagttggtaccagcagaagccaggacacggccccagca

SEQ ID NO: 296992 - DNA, 255 bp, Homo sapiens
  misc_feature: NA.23.4.A04.1.454.light.1.nb
tgctcatatactgggcgtctacgcgggaatccgggtccctgagcgattcattggcagcggatctgggacagatttcagtctcaccgtcagcagcctgcaggctgaggatgcggcgatttattactgtcaccaatattttgaggctccgttcactttcggccaggggaccaaggtggagctcaggcgaactgtggctgcaccatctgtcttcatcttcccgcatctgaatctcgcgtctgagcgggctggcaaggc

SEQ ID NO: 296993 - DNA, 375 bp, Homo sapiens
  misc_feature: NA.23.47.E03.1.454.light.1.nb
tcagttaggacccagagggaaccatggaagccccagctcagcttctcttcctcctgctactctggctcccaggggaaagagccacgctctcctgcagggccagccagagtgttgacacatattttgcctggtaccagcagaaacctggccagcctcccaggctcctcatctatgatgcgtccaaaagggccgctggcgtcccagccaggtttcgtggcagtggaagtgggacagacttcactctcaccatcggcagtctagagcctgaagattttgctagtttattactgtcagcagcgcagcagctggatcacgttcggccaagggacacgactcgaaattaagcgaactgtggctgcaccatctgtcttcatc

SEQ ID NO: 296994 - DNA, 325 bp, Homo sapiens
  misc_feature: NA.23.50.E06.2.454.light.1.nb
tctctctcagtcaggacacagcatggacatgagggtccctgctcagctcctgggactcctgctgctctggctcccaggtatcagatgtgacatccagatgacccagtcctccatcctccctgtctgcgtctgtgggagccagagtcaccatcacttgccgggcgagtcaggacattaacaactatttagcctggtatcagcagaaaccagggaaagtacctaaactcctgatctatggtgcatccactttgcaatcagggctcccatctcgattcagcggcagtggatctgggagagatttcagtctcaccatcagcagcctgca

SEQ ID NO: 296995 - DNA, 310 bp, Homo sapiens
  misc_feature: NA.23.6.A06.1.454.light.1.nb
taagtacttaggctggtaccaacagaaacctggccaggctcccaggctcctcatccatgatgcatccaacagggtccctggcgtcccagacaggttccgtggcagtgggtctgggacagagttcactctcaccgtcagcagcctggagcctgatgattttgctagtttacttctgtcagcagcgttccgccacgccgctcactttcggcgggggaccagggtggagatgagacgaactgtggctgcaccatctgtcttcatcttcccgccatctgaatactcgcgtctgagcgggctggcaaggcgcata

SEQ ID NO: 296996 - DNA, 70 bp, Homo sapiens
  misc_feature: NA.23.6.A06.3.454.light.1.nb
gtctctctcagtcaggacacagcatggacatggagggtccctgctcagctccgtgggactcctgctgctc

SEQ ID NO: 296997 - DNA, 313 bp, Homo sapiens
  misc_feature: NA.23.60.F05.2.454.light.1.nb
tcagttaggacccagagggaaccatggaagccccagctcagcttctcttcctcctgctactctggctcccagataccaccggagaaattgtgttgacacagtctccagccaccctgtctttgtctccaggggaaaagccaccctctcctgcagggccagtcagagtgttagcagctacttagcctggtaccagcagaaacatggccaggctcccaggctcctcatctatgatgcatccaacagggccactggcatcccagccaggttcagtggcaggtgggtctgggacagacttcactctcaccatcagcag

SEQ ID NO: 296998 - DNA, 86 bp, Homo sapiens
  misc_feature: NA.23.68.G02.1.454.light.1.nb
acattaaacgaactgtggctgcaccatctgtcttcatcttcccgccatctgaatactcgcgtctgagcgggctggcaaggcgcata

SEQ ID NO: 296999 - DNA, 389 bp, Homo sapiens
  misc_feature: NA.23.71.G05.1.454.light.1.nb
acaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccgtctcctgcactggaacccgcagtgatgttgggacttttaatatggtctcgtggtaccaatacctccaggcaaagcccccaaatcatactttatgaggcactaagcggccctcaggggtttctagtcgcttctctggctccaagtctggcaacacggcctccctgaccatctctggcctccagcctgacgacgaggctgattattattgctgctcatatgcagatagtagtactttgaggttc

SEQ ID NO: 297000 - DNA, 295 bp, Homo sapiens
  misc_feature: NA.23.72.G06.2.454.light.1.nb
tcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtcgggtcccatcaaggttcagtggcagtggatcgtgggac

SEQ ID NO: 297001 - DNA, 249 bp, Homo sapiens
  misc_feature: NA.23.75.G09.1.454.light.1.nb
cagtcaggacacagcatggacatgagggtccctgctcagctccgtgggactcctgctgctctggctcccagataccagatgtgacatccagatcgacccagtctccatcctccctgtctgcatctgtaggagacagagtcaccatcacttgccgggcgagtcagggcataagcaattatttagcctggtatcagcagaaaccagggaaagttcctaagctcctgatctctgctgcatccactttgcatc

SEQ ID NO: 297002 - DNA, 320 bp, Homo sapiens
  misc_feature: NA.23.80.H03.1.454.light.1.nb
tcatcatgacctgctcccctctcctcctcacccttctcattcactgcacagggtcgtgggcccagtctccattgacgcagccgccctcactttctgcggccccaggacaggcggtcaccatttcctgctcgggaagcacctccaacattgggactcatggtgtttcctggtaccagcagatcgcaggaacacgcccccaattctcatctttgacagttataaacgactctcaggtactcctgaccgcttctctggctccaagtctggcacgtcagccacctggacatcaccggactccagactggggacgaggccgatta

SEQ ID NO: 297003 - DNA, 385 bp, Homo sapiens
  misc_feature: NA.23.83.H06.1.454.light.1.nb
ataagagaggcctggaggttcctccttagctgtgggctcagaagcagagttctggggtgtctccaccatggcctggacccctctctggctcactctcctcactctttgcatagggtctgtggtttcttctgggctgactcaggagcctgctatgtctgtggccgtgggacagacagtcaggatcacctgccgaggagacagcctcagggaccattccgccacctggtaccagcagaagccgggacaggcccctctacttgtcatctttggtagaaacgaccggccctcagggactccccgacgattctctggctccacctcagggaacacagcttcgtgaccatcactggggctcaggcgaagatgaggctgagtattattgcag

SEQ ID NO: 297004 - DNA, 329 bp, Homo sapiens
  misc_feature: NA.23.86.H09.1.454.light.1.nb
tgctcagtcaggacccagagggaaccatggaagccccagctcagcttctcttcctcctgctactctggctcccagataccaccggagaaattgtgttgacacagtctccagccaccctgtctttgtctccaggggacagagccaccctctcctgcagggccagtcagagtattaacaactgcgcagcctggtgccaacaaaaacctggccaggctcccaggctcctcatctttgatgcctccaatacgggtccctggccgtcccagccaggttcagtggcaggtgggtctgggacagacttcactctcaccatcagcagcctggagcct

SEQ ID NO: 297005 - DNA, 360 bp, Homo sapiens
  misc_feature: NA.23.88.H11.1.454.light.1.nb
actgctcagttaggacccagagggaaccatggaagccccagctcagcttctcttcctcctgctactctggctcccagattccaccggcgaaattgtgttgacacagtctccagccaccctgtctttgtctccgggggaacagccaccctctcctgcagggccggccagactgttgacaacgacttagcctggtaccaacagaagcctggccaggctcccaggctcctcatctatgatacttccagtaggccactggcatcccagcccgcttcagtggcagtgggtctgggacagacttcactctcaccatccaccagcctagacgcctgaagtattttgctagtttattactgtcagcac

SEQ ID NO: 297006 - DNA, 221 bp, Homo sapiens
  misc_feature: NA.24.10.A10.1.454.light.1.nb
ctggctccaagtctggcacctcagcctccctggccatcagtgggctccggtccgatgatgaggctgattattactgtgcagcatgggatgccagtctgagtggtacgctgttcggcggagggaccaagctgaccgtcctaggtcagcccaaggctgccccctcggtcactctgttcccgccctcctcacatagtagtctgagcgggctggcaaggcgcata

SEQ ID NO: 297007 - DNA, 135 bp, Homo sapiens
  misc_feature: NA.24.10.A10.2.454.light.1.nb
tctggctccaagtctggcacctcagcctccctggccatcactgggctccaggctgaggatgagggtgattactactgccagtcgtcgaagatgttcggcggagggactaagctgaccgtctaggtcagcccaagg

SEQ ID NO: 297008 - DNA, 192 bp, Homo sapiens
  misc_feature: NA.24.12.B01.1.454.light.1.nb
gaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgattgtttataagtttgtct

SEQ ID NO: 297009 - DNA, 77 bp, Homo sapiens
  misc_feature: NA.24.35.D02.1.454.light.1.nb
ctgctcagttaggacccagagggaaccatggaagccccagctcagcttctcttcctcctgctactctggctcccaga

SEQ ID NO: 297010 - DNA, 33 bp, Homo sapiens
  misc_feature: NA.24.35.D02.2.454.light.1.nb
gaccaccggagaaattgtgttgacacagtctcc

SEQ ID NO: 297011 - DNA, 53 bp, Homo sapiens
  misc_feature: NA.24.35.D02.3.454.light.1.nb
aggcaccctgtctttgtctccaggggagagagccaccctctcctgcagggcca

SEQ ID NO: 297012 - DNA, 207 bp, Homo sapiens
  misc_feature: NA.24.35.D02.4.454.light.1.nb
gccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagacgcctgaagtattttgcggtttactactgtcagcagcgttccgcctgg

SEQ ID NO: 297013 - DNA, 156 bp, Homo sapiens
  misc_feature: NA.24.35.D02.5.454.light.1.nb
gtcagagtgttagcagcagctacttagcctggtaccagcagaaacctggccaggctcccaggctcctcatctatgctgtctccaccagggcccctggtcgtcccagccaggttcgtggcggtgggtctgggacagatttcactctcaccatcagcg

SEQ ID NO: 297014 - DNA, 255 bp, Homo sapiens
  misc_feature: NA.24.35.D02.6.454.light.1.nb
taccactggagaagtagtcatgacgcagtctccagccaccctgtctgtgtctccaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgaag

SEQ ID NO: 297015 - DNA, 213 bp, Homo sapiens
  misc_feature: NA.24.35.D02.7.454.light.1.nb
agccaccctgtctttgtctccaggggaaagagccaccctctcctgcagggccagtgacaatgttaggaagttgttagcctggtatcaacacaaacatggccaggcctccccggctcctcatctatgatgcatccaatagggccactggcatcccagacaggttcagtggcagtgggtctgggacagacttcactctcaccatcagcagtgtag

SEQ ID NO: 297016 - DNA, 355 bp, Homo sapiens
  misc_feature: NA.24.36.D03.1.454.light.1.nb
  modified_base (300)..(300): a, c, t, g, unknown or other
  misc_feature (300)..(300): n is a, c, g, or t
cgccatctcctgcactggaaccaacaatgatattggtggttataactatgtctcctggtaccaacatcaccccggcaaagcccccaaactcctaatttttggtgtctatcaacggccctcaggggtccctgatcgcttctctgcttccaagtctggcaacacggcctccctgaccatctctgggctccaggctgaggatgaggctgactattattgctgctcatatgcaggcaactccggatctgtcttcgggactggggaccatggtcaccgtcctcggtcagcccaaggccaaccccnctgtcactctgttcccaccctcctcacatagtagtctgagcgggctggcaaggcg

SEQ ID NO: 297017 - DNA, 76 bp, Homo sapiens
  misc_feature: NA.24.37.D04.1.454.light.1.nb
tgctcagttaggacccagagggaaccatggaagccccagctcagcttctcttcctcctgctactctggctcccaga

SEQ ID NO: 297018 - DNA, 87 bp, Homo sapiens
  misc_feature: NA.24.37.D04.2.454.light.1.nb
  modified_base (63)..(63): a, c, t, g, unknown or other
  misc_feature (63)..(63): n is a, c, g, or t
tgccaccggagacattgtgttgacacagtctccagccaccctgtctttgtctccaggggaaanagccaccctctcctgcagggccag

SEQ ID NO: 297019 - DNA, 198 bp, Homo sapiens
  misc_feature: NA.24.37.D04.3.454.light.1.nb
tgacaatgttaggaagttgttagcctggtatcaacacaaacatggccaggcctcccggctcctcatctatgatgcatccaatagggccactggcatcccagacaggttcagtggcagtgggtctgggacagacttcactctcaccatcagcagtgtagagcctgaagtattttgctagtttattactgtcagtcaccg

SEQ ID NO: 297020 - DNA, 136 bp, Homo sapiens
  misc_feature: NA.24.37.D04.4.454.light.1.nb
tcagagtgttagcagcagctacttagcctggtaccagcagaaacctggccaggctcccaggctcctcctctatgctgtctccaccgacgggcccctggtcgtcccagccaggttcgtggcggtgggtctgggacag

SEQ ID NO: 297021 - DNA, 171 bp, Homo sapiens
  misc_feature: NA.24.37.D04.5.454.light.1.nb
taccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtcctccacc

SEQ ID NO: 297022 - DNA, 254 bp, Homo sapiens
  misc_feature: NA.24.37.D04.6.454.light.1.nb
gaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggcgtccccgcaggttcagtggcagtgggtctgggacagacttcactctcaccgtcagcagcctagagcctgaaga

SEQ ID NO: 297023 - DNA, 313 bp, Homo sapiens
  misc_feature: NA.24.39.D06.1.454.light.1.nb
gcttaggaagcagagcctggggcatctccaccatggcctggacccctctcctcctccagcttctcaccctctgctcagggatccctgaccgcttctctggctcaaggtctgggaccacagcctccctgattatctcgggcctccagtctgaggacgaggctgattattactgttcaacatgggactacagcctcagttctcaggtgttcggcggagggaccaaggtgaccgtcctaagtcagcccaaggctgccccctggtcactctgttcccgccctcctcacatagtagtctgagcgggctggcaaggcgc

SEQ ID NO: 297024 - DNA, 368 bp, Homo sapiens
  misc_feature: NA.24.4.A04.2.454.light.1.nb
taggacccagagggaaccatggaagccccagctcagcttctcttcctcctgctactctggctcccagagaccgccggagaaggtgtgttgtcgcagtccccaggcaccctgtcgttgtctccaggggacacagccatcctctcctgcagggccagtcagcctctcgtcaaccccttagcctggttccaacaaaagcctggccagcctccacgactcgtcatctatgatacatccaaaagggccgctggcgtcccagccaggttcgctggcagtggtctgggacagacttcactctcaccatcagcagcctggagactgaagattttgcaatgtattactgtcagcagcgtgacaactggcctcccata

SEQ ID NO: 297025 - DNA, 298 bp, Homo sapiens
  misc_feature: NA.24.45.E01.2.454.light.1.nb
gacatgagggtccccgctcagctcctggggctcctgctactctggctccgaggtgccagatgtgacatccagatgacccagtctccatcctccctgtctgcatctgtaggagacagagtcaccatctcttgttgggcaagtgagaccattagcagctctttgagttggcatcaattcaaaccagggaaacgcccctaacctcctgatctatactgcgtccaatttacacagtggggtcccatccaggttcagtggcaatggatctgggacagagttcactctcaccatcagcagtctg

SEQ ID NO: 297026 - DNA, 360 bp, Homo sapiens
  misc_feature: NA.24.53.E09.2.454.light.1.nb
tggaagctgcttgtaccagagggtcaccatctcctgcactgggagcaacatcggcgcaggttttgatgtccactggtacaagcagcttccaaaaacagcccccaaactcctcatttatcgtaacaacaatcggccctctggggtccctgaccgattctccgcctccaagtctggcacctctgcctcgctggccatcactgggctccaggctgaggatgagggtgattactactgccagtcgtcgaagatgttcggcggagggactaagctgaccgtcctaggtcagcccaaggctgccccctggtcactctgttcccaccctcctcacatagtagtctgagcgggctggcaaggcgcata

SEQ ID NO: 297027 - DNA, 88 bp, Homo sapiens
  misc_feature: NA.24.53.E09.3.454.light.1.nb
agactgacggtcctgccacagcggccctgggctgcctggtcaaggactacttccacatagtagtctgagcgggctggcaaggcgcata

SEQ ID NO: 297028 - DNA, 63 bp, Homo sapiens
  misc_feature: NA.24.57.F02.1.454.light.1.nb
tatgcgccttgccagcccgctcagacgctcgacaggaagtagtccttgaccaggcagcccagg

SEQ ID NO: 297029 - DNA, 49 bp, Homo sapiens
  misc_feature: NA.24.57.F02.2.454.light.1.nb
ggccagggatccctggtcaccgtctcctcagcttccaccagggcccatc

SEQ ID NO: 297030 - DNA, 45 bp, Homo sapiens
  misc_feature: NA.24.57.F02.3.454.light.1.nb
agcccaaatcttgtgacacacctcccccgtgcccacggtgcccag

SEQ ID NO: 297031 - DNA, 338 bp, Homo sapiens
  misc_feature: NA.24.59.F04.2.454.light.1.nb
gacatgagggtccctgctcagctcctgggcctcctgctgctctggctctcaggtgccatatgtgacatccagatgacccagtctccatcctccctgtctgcatctgtgggagacagagtcaccatctcttgccaggcgagtcagggcattaactactttgtaaattggtatcatacaaaaaccaggcaagggccctaaactcctggtcaacgatgcatccaatcgggtgccaggggccccatcaaggttcagcggcagtagatctgggacattcttcaccttcaccatcagcggcctgcagcctgagatgttggcacatattactgtacaacaatatg

SEQ ID NO: 297032 - DNA, 317 bp, Homo sapiens
  misc_feature: NA.24.64.F09.1.454.light.1.nb
cactcaggacacagcatggacatgagggtccccgctcagctcctgggctcctgctgctctggctcccaggtgccagatgtgccatccagatgacccagtctccatcctccctgtctgcatctgtgggagacagagtcaccatcacttgccgggcaagtcagggcattagaagtgatttaggctggtatcagcagaaaccagggaaagcccctaaggtcctgatctatgctgcatcccgttacaagtgggtccatcaaggttcagcggcagtggatctggcacagatttcactctcaccatcagcagcctgcagcctg

SEQ ID NO: 297033 - DNA, 413 bp, Homo sapiens
  misc_feature: NA.24.67.G01.2.454.light.1.nb
ataccactggagaaatagtgatgacgcagtctccagccaccctgtctgtgtctccaggggaaagagccaccctctcctgcagggccagtcagagtataagaagcaactacttagcctggtatcaacagaaacctggccaggctcccaggctcctcatctatggtatatccagcagggccactggtgtcccagccaggttcagtggcagtgggtctgggacagagttcactctcaccatcagcagtctgcagtctgaagattttgcagtttattactgccagcagcacagtgactggccgctcactttcggcggagggaccaaggtggagatcaaacgaactgtggctgcaccatctgtcttcatcttcccgccatctgaacatagtagtctgagcgggctggcaaggcgcata

SEQ ID NO: 297034 - DNA, 246 bp, Homo sapiens
  misc_feature: NA.24.67.G01.3.454.light.1.nb
ataccactggagaagtagtcatgacgcagtctccagccaccctgtctgtgtctccgaggggaaagagccaccctctcctgcagggccagtgagaatgttggcagcaacttagcctggtaccagcagaaacctggccaggctcccaggctcctcctctatgctgtctccaccagggcccctggtcgtcccagccaggttcgttggcggtggtctgggacagatttcactctcaccatcagccggcct

SEQ ID NO: 297035 - DNA, 167 bp, Homo sapiens
  misc_feature: NA.24.67.G01.4.454.light.1.nb
agaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctcc

SEQ ID NO: 297036 - DNA, 243 bp, Homo sapiens
  misc_feature: NA.24.67.G01.5.454.light.1.nb
ccatcaccggaggaattgtgttgacgcagtctccaggcaccctgtctttgtctccaggggaagagccaccctctcctgcagggccagtcagagtgttagcagcagctacttagcctggtaccagcagaaacctggcctggctcccaggctcctcatctatggtgcgtccaccagggccacgtggcgtcgcggacaggttcagtggcagtggctttgggacagacttcactctcatcatcgaca

SEQ ID NO: 297037 - DNA, 348 bp, Homo sapiens
  misc_feature: NA.24.75.G09.1.454.light.1.nb
gacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtgtttctgcctgggtggcctggtatcagcagaaaccagggaaacgcccctaaattcctgatctataaggcgtctatttacaagtgggtccctccaggttcagcggcagtggatctgggacagaattcactctcacaatcagcagcctgcagcctgatgatttgctaacttattactgccaacagtatgatg

SEQ ID NO: 297038 - DNA, 419 bp, Homo sapiens
  misc_feature: NA.24.78.H01.2.454.light.1.nb
ccatcaccggaggaattgtgttgacgcagtctccaggcaccctgtctttgctccgaggggaagacgccaccctctcctgcagggccagtcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagcccgaagattttgcagtgtattactgtcagctgtttggtccctctcctcctatgtacacttttggccagggttccaggctggagatcaagcgaactgtggctgcaccatctgtcttcatcttcccgccatctgaacatagtagtctgagcgggctggcaaggcgcata

SEQ ID NO: 297039 - DNA, 169 bp, Homo sapiens
  misc_feature: NA.24.78.H01.3.454.light.1.nb
ataccactggagaagtagtcatgacgcagtctccagccaccctgtctgtgtctccaggggaaaagccaccctctcctgcagggccagtgagaatgttggcagcaacttagcctggtaccagcagaaacctggccaggctcccaggctcctcctctatgctgtctccacc

SEQ ID NO: 297040 - DNA, 376 bp, Homo sapiens
  misc_feature: NA.24.81.H04.1.454.light.1.nb
gaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactgcaaccatcagtgaccttgatgtttataagtttgtctcctggtatcaacaacacccaggcaaagcccccaaactcatgatttatgatgtcagtaatcggccctcgagggcttctgatcgcttctctggctccaggtctggcaacacggcctccctgaccatctctgggctccaggctgaggacgaggctgactattattgctagttcatggacaagcagcag

SEQ ID NO: 297041 - DNA, 88 bp, Homo sapiens
  misc_feature: NA.24.87.H10.2.454.light.1.nb
taccactggagaagtagtcatgacgcagtctccagccaccctgtctgtgtctccgaggggaaagagccaccctctcctgcagggccag

SEQ ID NO: 297042 - DNA, 326 bp, Homo sapiens
  misc_feature: NA.24.87.H10.3.454.light.1.nb
tgagaatgttggcagcaacttagcctggtaccagcagaaacctggccaggctcccaggctcctcctctatgctgtctccaccagggcccctggtcgtcccagccaggttcgttggcggtgggtctgggacagatttcactctcaccatcagcggcctccagtctgaagatttgctactttatttctgtcaacactatggtgactggcctccgtacacttttggccaggggaccaaactggagatcaaacgaactgtggctgcaccatctgtcttcatcttcccgccatctgaacatagtagtctgagcgggctggcaaggcgcata

SEQ ID NO: 297043 - DNA, 128 bp, Homo sapiens
  misc_feature: NA.24.87.H10.4.454.light.1.nb
tgccaccggagacattgtgttgacacagtctccagccaccctgtctttgtctccgaggggaaaagccaccctctcctgcagggccagtgacaatgttaggaagttgttagcctggtatcaacacaaac

SEQ ID NO: 297044 - DNA, 291 bp, Homo sapiens
  misc_feature: NA.24.87.H10.5.454.light.1.nb
gaccaccggagaaattgtgttgacacagtctccaggcaccctgtctttgtctccaggggagagagccaccctctcctgcagggccagccggagtgttagtaagtacttaggctggtaccaacagaaacctggccaggctcccaggctcctcatctatgatgtctccaacagggtcactggccgtccccgcaggttcagtggcagtgggtctgggacagacttcactctcaccgtcagcagcctagacgcctgaagtattttgcggttttactactgtcagcagtcgttccg

SEQ ID NO: 297045 - DNA, 169 bp, Homo sapiens
  misc_feature: NA.24.87.H10.6.454.light.1.nb
tcagagtgttagcagcagctacttagcctggtaccagcagaaacctggcctggctcccaggctcctcatctatggtgcgtccaccagggccactggcgtcgcggacaggttcagtggcagtggctttgggacagacttcactctcatcatcgacagactggagccgaag

SEQ ID NO: 297046 - DNA, 251 bp, Homo sapiens
  misc_feature: NA.25.10.A10.1.454.light.1.nb
tagggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctggtaccaacaacaccccgacaaacgccccaaactcatgatttatgaggcactaagc

SEQ ID NO: 297047 - DNA, 123 bp, Homo sapiens
  misc_feature: NA.25.14.B03.1.454.light.1.nb
ctcctttatatcttcggaactgggaccaaggtcaccgtcctaggtcagcccaaggccaaccccactgtcactctgttcccaccctcctcactgtacagtctgagcgggctggcaaggcgcata

SEQ ID NO: 297048 - DNA, 373 bp, Homo sapiens
  misc_feature: NA.25.15.B04.1.454.light.1.nb
cagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcacgggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcagcctgcagtctgacgtatttgctagtttattactgtcagcagtaataaaactggaccgtac

SEQ ID NO: 297049 - DNA, 277 bp, Homo sapiens
  misc_feature: NA.25.16.B05.1.454.light.1.nb
  modified_base (268)..(268): a, c, t, g, unknown or other
  misc_feature (268)..(268): n is a, c, g, or t
tctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccggcgagtcagggcattggaaattattggcctggtatcagcaagaaaccagggaaacgttcctaacctcctcatctatgctgcatccactttgctaagtttcgggtccctntcgattcag

SEQ ID NO: 297050 - DNA, 241 bp, Homo sapiens
  misc_feature: NA.25.16.B05.3.454.light.1.nb
agcagagttctggggtgtctccaccatggcctggacccctctctggctcactctcctcactctttgcataggttctgtgatttcttctgagctgactcaggaccctgctgtgtctgtggccttgggacagacagtcaggatcacatgccaaggagacagcctcaagaaactattatgcaggctggtaccagcagaagccaggacaggcccctattcttgtcatctttaggaaaaacaccgg

SEQ ID NO: 297051 - DNA, 423 bp, Homo sapiens
  misc_feature: NA.25.20.B09.1.454.light.1.nb
cagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaagcccccaaattatcatttatgaggccactaagcggccctcaggagtttctaatcgcttctctggctccaagtctggcagcacggcctccctgacaatctctgggctccaggctgaggacgaggctgattattactgctactcatatggacacatcacaaatcccgtcttcggacctgggaccagggtcaccgtcctgggtcagcccaagg

SEQ ID NO: 297052 - DNA, 358 bp, Homo sapiens
  misc_feature: NA.25.22.B11.1.454.light.1.nb
gcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaacggcccccaaactcatcatttatgatgtcagtcatcggccctctggagtttctggtcgcttctctggctccaagtctggcaactcggcctcctgaccatctcgggctccaggctgaggacgaggctacttattattgctatttca

SEQ ID NO: 297053 - DNA, 104 bp, Homo sapiens
  misc_feature: NA.25.22.B11.3.454.light.1.nb
tatgcgccttgccagcccgctcagactgtacagtggaagtagtccttgaccaggcagcccagggccgctgtgctctcggaggtgctcctggagcagggcgccag

SEQ ID NO: 297054 - DNA, 420 bp, Homo sapiens
  misc_feature: NA.25.23.C01.1.454.light.1.nb
tcagcttcagctgtggtagagaagacaggattcaggacaatctccagcatggccggcctccctctcctcctcaccctcctcactcactgtgcagggtcctgggcccagtctgtgctgactcagccaccctcagtgtctgggacccccgggcagagggtctccatctcttgttctgggagcagctccgacgtcggaaataagtttgtctactggtaccagcagctcccagaaacggccccaagctcctcatctataggaatgatcagcggccctcagggatacctgaccgattctctggctcgaagtctggctcctcggcctccctggccatcagtgggctccggtccgaggatgaggctgaatattactgtgctagtttggatgccagtctgagtggtccgaggtgttcggcggaggacc

SEQ ID NO: 297055 - DNA, 219 bp, Homo sapiens
  misc_feature: NA.25.25.C03.1.454.light.1.nb
aggttcagcggcagtggatctgggacagaattcactctcaccatcaacagtctgcagcctgatgattttgcaacttattactgtcaaaaatttgacagtgacccgtggatgttcggcccagggaccaaggtggatatcatacgaactgtggctgcaccatctgtcttcatcttcccgccatctgaactgtacagtctgagcgggctggcaaggcgcata

SEQ ID NO: 297056 - DNA, 18 bp, Homo sapiens
  misc_feature: NA.25.28.C06.5.454.light.1.nb
ctgggcaccttgggcgac

SEQ ID NO: 297057 - DNA, 487 bp, Homo sapiens
  misc_feature: NA.25.28.C06.6.454.light.1.nb
tctctctcagtcaggacacagcatggacatgagggtccctgctcagctcctgggactcctgctgctctggctcccagctatcagatgtggcatccagatgacccagtctccatcctccctgtctgcatctgttggagacagagtcaccatcacttgccgggcgagtcagggcattggaaattatttggcctggtatcagcagaaaccagggaaagttcctaacctcctcatctatgctgcatccactttgctaagtttggggtccctctcgattcagcggcagtggtctgggacagaattcactctcaccatcagcagcctgcagcctgaagatgttgcaacttattactgtacaaaaatttgacagtgacccgtggatgttcggcccagggaccaaggtggacatcaaacgaactgtggctgcaccatctgtcttcatcttcccgcatctgaactgtacagtctgagcgggctggcaaggcgcata

SEQ ID NO: 297058 - DNA, 83 bp, Homo sapiens
  misc_feature: NA.25.3.A03.1.454.light.1.nb
  modified_base (81)..(81): a, c, t, g, unknown or other
  misc_feature (81)..(81): n is a, c, g, or t
agagggatccagaactcgtgggtgtctcaccagtggcctggactccctctaccttcctccccctcctcactctctgcacgngg

SEQ ID NO: 297059 - DNA, 87 bp, Homo sapiens
  misc_feature: NA.25.30.C08.2.454.light.1.nb
tatgcgccttgccagcccgctcagactgtacagttcagatggcgggaagatgaagacagatggtgcagccacagttcgtttgatttc

SEQ ID NO: 297060 - DNA, 373 bp, Homo sapiens
  misc_feature: NA.25.32.C10.1.454.light.1.nb
actgctcagttaggacccagacggaaccatggaagccccagcgcagcttctcttcctcctgctactctggctcccagatgccactggagaaattgtgatgacgcagtctccagcctccctgtctgtgtctcctggggaagagccaccctctcctgcagggccagtcagagcgttggcaggaacttagcctggtaccagcagaaacctggccagcctcccagactcctcctctatggtgcttccaccagggcccctgactactccccgcaggttcagtggcagtgggtctgggacagagttcactctcaccatcagcagcctgcagtctgaagattttgctagtttattactgtcaccagtataataactggcc

SEQ ID NO: 297061 - DNA, 316 bp, Homo sapiens
  misc_feature: NA.25.33.C11.2.454.light.1.nb
caagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcacctatttcctgcactggactcagcactgatgttgcaggttattactttgtctcctggtaccaacaacacccaggcaaacgaccccaaacttatcatttatgaggccactaagcggccctcaggagtttctaatcgcttctctggctccaagtctggcagcacggcctcctgac

SEQ ID NO: 297062 - DNA, 228 bp, Homo sapiens
  misc_feature: NA.25.33.C11.3.454.light.1.nb
acaggcaggcaggggcagcaagatggtgttgcagacccaggtcttcatttctctgttgctctggatctctggtgccgtacggggacatcgtgttgacccagtccccggtctccctgcctgtgtctctgggcgagagggccaccatcatctgcaagtccagccagaatctcttcttacctccaacatcagatctacctaaattggtaccagcagaaaccaggacaccct

SEQ ID NO: 297063 - DNA, 174 bp, Homo sapiens
  misc_feature: NA.25.34.D01.1.454.light.1.nb
tgctgtctcagccaccctcagtgtctcggggccccccggcagagggtcgacatctcttgttctggaagtcgctccaacgtcggcagtaatagtgtaagctggtaccagcaactcccaggaaccgcccccacactcctcatgtatgggaatgactcagccgcccctcgacggggt

SEQ ID NO: 297064 - DNA, 63 bp, Homo sapiens
  misc_feature: NA.25.34.D01.2.454.light.1.nb
tatgcgccttgccagcccgctcagactgtacagtggaagtagtccttgaccaggcagcccagg

SEQ ID NO: 297065 - DNA, 96 bp, Homo sapiens
  misc_feature: NA.25.36.D03.1.454.light.1.nb
cacaagaggcagcgctctcgggacgtctccaccatggcctgggctctgctgctcctcactctcctcactcaggacacagggtcctgggcccagtct

SEQ ID NO: 297066 - DNA, 227 bp, Homo sapiens
  misc_feature: NA.25.36.D03.11.454.light.1.nb
aagttattcagcaggcacacaacagaggcagttccagaattcactctcaccatcagcagcctgcagcctgatgattttgcaacttattactgccaacaatataataattattcgaccacttttggccaggggaccaaggtggagatcaaacgaactgtggctgcaccatctgtcttcatcttcccgcatctgaactgtacagtctgagcgggctggcaaggcgcata

SEQ ID NO: 297067 - DNA, 193 bp, Homo sapiens
  misc_feature: NA.25.36.D03.2.454.light.1.nb
ggcctgactcaacctgcctccgtgtctgggtctcctggacgtcaatcaccatttcctgcactggaaccagcactgatgttggctactttgaccttgtctcttggtaccaacaacacccggacaaaggctaccaaactcattaattttgagaccagtaagcggccctctggggtttctagtcgattcactggct

SEQ ID NO: 297068 - DNA, 123 bp, Homo sapiens
  misc_feature: NA.25.36.D03.3.454.light.1.nb
gccgtgactcagcctgcctccgtgtctgggtctcctggacagtcgatcaccatttcctgcactggactcagcactgatgttgctaggttattactttgtctcctggtaccaacaacacccagg

SEQ ID NO: 297069 - DNA, 409 bp, Homo sapiens
  misc_feature: NA.25.36.D03.4.454.light.1.nb
ccaggggtcccttccaatatcagcaccatggcctggactcctctctttctgttcctcctcacttgctgcccaggtccaaatctcagactgtggtgactcaggagccctcactgactgtcgtccccaggagggacagtcactctcacctgtgcttccagcgctgggtcagtcaccagtgagaaccatccaaactggttccagcagaaacctggacaaccacccagggcactgatttatggtgacaaactaaaaaacactcttggacccctgcccggttctcaggctccctccttggggcaaagctgccctgacactgtcagatgtgcagcctgaggacgaggctgactaccactgcctgctctcctctggtgtgcgttgggtgttcggcggagggaccaacgtgaccgtc

SEQ ID NO: 297070 - DNA, 332 bp, Homo sapiens
  misc_feature: NA.25.36.D03.6.454.light.1.nb
gctgtggtagagaagacaggattcaggacaatctccagcatggccggcctccctctcctcctcaccctcctcactcactgtgcagggtcctgggcccagtctgtgctgactcagccaccctcagtgtcgtgggacccccgggcaggagggtctccatctcttgttctgggagcagctccgacgtcggaaatagtttgctactggtaccagcagctcccagaaccggcccccaagctcctcatctataggaatgatcagcggccctcagggatacctgaccgattctctggctcgaagtctggctcctcggcctccctggccatcagtcggct

SEQ ID NO: 297071 - DNA, 332 bp, Homo sapiens
  misc_feature: NA.25.36.D03.7.454.light.1.nb
agtctctctcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcagggtcccatctcggttcagcggcagtgaatctgggacagagttcactctcactatcagcagcctgcagcctgaa

SEQ ID NO: 297072 - DNA, 307 bp, Homo sapiens
  misc_feature: NA.25.37.D04.2.454.light.1.nb
tgctcagttaggacccagagggaaccatggaagccccagctcagcttctcttcctcctgctactctggctcccagatagcaccggagaagttgtgttgacacagtctccagacaccctgtctttgtctccaggggaaagccaccctctcctgcagggccagtcagagtgttatcaggtacttagcctggtaccaacagaaacctggccaggctcccaggctcctcatctatgatgcatccaagagggccactggcatcccagccaggttcagtggcaggtggggctgggacagagttcactctcacc

SEQ ID NO: 297073 - DNA, 291 bp, Homo sapiens
  misc_feature: NA.25.38.D05.2.454.light.1.nb
aggactcctcagttcaccttctcactatgaggctccctgctcagctcttggggctgctaatgctctgggtccctggtaaggacagaaggagatgagggaggagaatggggtgggaaggatccagtgcagagattgtgatgacccagactccactctccttgtctatccaccctggagagcaggcctccatctcctgcaggtctagtcagagcctcctgcatagtgatggatacacctatttgtattggtttctgcagaaagccaggccagtctccacgctcctgatctatg

SEQ ID NO: 297074 - DNA, 96 bp, Homo sapiens; identical to SEQ ID NO: 297065
  misc_feature: NA.25.39.D06.1.454.light.1.nb

SEQ ID NO: 297075 - DNA, 53 bp, Homo sapiens
  misc_feature: NA.25.39.D06.2.454.light.1.nb
gccctgactcagcctgcctccgtgtctgggtctcctggacagtcgatcaccat

SEQ ID NO: 297076 - DNA, 66 bp, Homo sapiens
  misc_feature: NA.25.39.D06.3.454.light.1.nb
ttcctgcactggaaccagcactgatgttggctactttgaccttgtctcttggtaccaacaacaccc

SEQ ID NO: 297077 - DNA, 160 bp, Homo sapiens
  misc_feature: NA.25.39.D06.4.454.light.1.nb
ggacaaaggctccaaactcataatttttgagaccagtaagcggccctctggggtttctagtcgattcactggctccaagtctggcaacacggcctccctaacaatctctgggctccaggctgaagacgaggctgattattactgctactcatatggacac

SEQ ID NO: 297078 - DNA, 53 bp, Homo sapiens
  misc_feature: NA.25.39.D06.5.454.light.1.nb
ggcctgactcaacctgcctccgtgtctgggtctcctggacggtcaatcaccat

SEQ ID NO: 297079 - DNA, 97 bp, Homo sapiens
  misc_feature: NA.25.39.D06.6.454.light.1.nb
aggcaaagcccccaaacttatcatttatgaggccactaagcggccctcaggagtttctaatcgcttctctggctccaagtctggcagcacggcctcc

SEQ ID NO: 297080 - DNA, 135 bp, Homo sapiens
  misc_feature: NA.25.39.D06.7.454.light.1.nb
ctcctgcactggaatcaccactgatgttgcatttcatgaccttgtctcctggtaccaacaacaccccgacaaacgccccaaactcatgatttatgaggcactaagcgcctagggttctgctcgcttctctggctc

SEQ ID NO: 297081 - DNA, 344 bp, Homo sapiens
  misc_feature: NA.25.4.A04.2.454.light.1.nb
tcagtcaggacacagcatggacatgagggtccctgctcagctcctgggactcctgctgctctggctcccagataccagatgtgacgtccagatgacccagtctccatcctccctgtctgcatctgttggagacagaatcagcatcacttgccgggcgagtcagggcattagcaattatttagcctggtatcaacagaaaccagggagagttcctaagctcctgatctatgctgcctccacgttacactcaggggtcccatctcggttcagcggcagtgaatctgggacagagttcactctcactatcagcagcctgcagcctgagatgttgcaacttattactg

SEQ ID NO: 297082 - DNA, 341 bp, Homo sapiens
  misc_feature: NA.25.48.E04.1.454.light.1.nb
agagggatccagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccaatatgcttattggtaccagcagaagtcaggtcaggcccctgtgatgttgatatataaagacagtgagaggccctagagggactccctgagcgattctctggctccagctcagggacaatagtcaccttgaccatcagtggagtccaggcagaggacgaggctgac

SEQ ID NO: 297083 - DNA, 225 bp, Homo sapiens
  misc_feature: NA.25.49.E05.1.454.light.1.nb
atccctgatcgcttctcaggctccagctgtgggactgagcgctacctcaccatctccagcctccagtctgaggatgaaactgactattactgtcagacctggggcactggcattcagggtgttcggcggagggaccaagctgaccgtacctaggtcagcccaaggctcgccccctcggtcactctcgttcccgccctcctcactgtacagtctgagcggctggca

SEQ ID NO: 297084 - DNA, 257 bp, Homo sapiens
  misc_feature: NA.25.50.E06.1.454.light.1.nb
tatggtgcaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttcccaccctcctcactgtacagtctgagcgggctggcaaggcgcata

SEQ ID NO: 297085 - DNA, 354 bp, Homo sapiens
  misc_feature: NA.25.53.E09.3.454.light.1.nb
ctcagttaggacccagagggaaccatggaagccccagctcagcttctcttcctcctgctactctggctcccagattccagcggcgaaactgtgttgacacagtctccagccaccctgtctttgtctccgggggaacagccaccctctcctgcagggccgccagactgttgacaacgacttagcctggtaccaacagaagcctggccaggctcccaggcctcctcatctatgatacttccagtagggccactggcatcccagcccgcttcagtggcagtgggtctggggacagagtttactctcaccatctccagcctagacgcctgaagtattttgctagtttattactgtcag

SEQ ID NO: 297086 - DNA, 374 bp, Homo sapiens
  misc_feature: NA.25.55.E11.1.454.light.1.nb
caggaagcagcatcggaggtgcctcagccatggcatggatccctctcttcctcggcgtccttgcttactgcacaggatttgtgacctcctatgagttgacccagcctccgtcggtgtccgtctcttcgggccagacagccagcctcccctgctctggccttaaagtggggcagaagtctgtatgttggtatcagttgaggccgggccggtctccgactctagtcatgtttcaacatgatagacggccctcagggattcctgaccggttttctggctccaagtctgggactacggccactctcattattcgtgggacccaggatgtggatgaaggtgtctatttctgtcagctgtgggacggcaccgtcgcggtc

SEQ ID NO: 297087 - DNA, 315 bp, Homo sapiens
  misc_feature: NA.25.55.E11.2.454.light.1.nb
tcaggaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacattggtgcttataactatgtctcctggtcccaacaacacccaggcaaggcccccaaactcatcatttatgatgtcagtcatcggccctctggagtttctggtcgcttctctggctccaagtctggcaactcggcctccctga

SEQ ID NO: 297088 - DNA, 231 bp, Homo sapiens
  misc_feature: NA.25.56.F01.1.454.light.1.nb
atccctgatcgcttctcaggctccagctgtgggactgagcgctacctcaccatctccagcctccagtctgaggatgaaactgactattactgtcagacctggggcactggcattcagggtgttcggcggagggaccaagctgaccgtcctaggtcagcccaaggctgccccctggtcactctgttcccaccctcctcactgtacagtctgagcgggctggcaaggcgcata

SEQ ID NO: 297089 - DNA, 257 bp, Homo sapiens
  misc_feature: NA.25.6.A06.1.454.light.1.nb
atggtgcaaactaaaaaacactcttggacccctgcccggttctcaggctccctccttgggggcaaagctgccctgacactgtcagatgtgcagcctgaggacgaggctgactaccactgcctgctctcctctggtggtgcttgggtgttcggcggagggaccaaactgaccgtcctgggtcagcccaaggctgccccctggtcactctgttcccgccctcctcactgtacagtctgagcgggctggcaaggcgcata

SEQ ID NO: 297090 - DNA, 221 bp, Homo sapiens
  misc_feature: NA.25.66.F11.2.454.light.1.nb
tccagccagagtcttttatacagtgccgacaataagaactacttagcttggtatcagcagaagccaggacagcctcctaagctgctcatttcctgggcatctacccgggaatccggggtccctgaccgattcagtggcagcgggtctgggacagatttcactctcatcatcagcggcctgcaacctgacgatgtggtcgtttattactgtcagcaacacta

SEQ ID NO: 297091 - DNA, 256 bp, Homo sapiens
  misc_feature: NA.25.67.G01.1.454.light.1.nb
acaagaggcagcgctctcgggacgtctccaccatggcctgggctctgctgctcctcactctcctcactcaggacacagggtcctgggcccagtctggcctgactcaacctgcctccgtgtctgggtctcctggacagtcaatcaccatttcctgcactggaaccagcactgatgttggctactttgaccttgtctcttggtaccaacaacacccggacaaaggctccaaactcattaattttgagaccagtaagcg

SEQ ID NO: 297092 - DNA, 380 bp, Homo sapiens
  misc_feature: NA.25.72.G06.1.454.light.1.nb
  modified_base (341)..(341): a, c, t, g, unknown or other
  misc_feature (341)..(341): n is a, c, g, or t
  modified_base (375)..(375): a, c, t, g, unknown or other
  misc_feature (375)..(375): n is a, c, g, or t
tgttgacgcagccgccctcagtgtctgcggccccaggacagaaggtcaccatctcctgttctggaagtagctccaacattggggataattatgtatcctggtaccagcaactcccaggaacagcccccaaactcctcattaatgacaatgataagcgaccctcagggattcctgaccgattctctggctccaagtctggcacgtcagccaccctgggcatcaccggactccagactggggacgaggccgattattactgcggaacatgggatagcggcctgaatgttttgtcttcggaactggaccaaggtcgcgtctgggtcagcccaaggccaaccccntcgtcactctcgttcccaccctcctcactgtacngtctg

SEQ ID NO: 297093 - DNA, 248 bp, Homo sapiens
  misc_feature: NA.25.73.G07.1.454.light.1.nb
agcaagcatagtgggaatctgcaccatgccctgggctctgctcctcctgaccctcctcactcactctgaagtgtcagtggtccaggcagggctgactcagccgccctcggtgtccaaggacgtgagacagaccgccacactcacctgcacgtgggaccgcgcctttgtggcaacgctggaattgcttggatacagcatcaccagggccgccctcccaaactcgtggcgaggcggaacaatgagcggcc

SEQ ID NO: 297094 - DNA, 290 bp, Homo sapiens
  misc_feature: NA.25.76.G10.2.454.light.1.nb
caaccaggacacagcatggacatgagggtccctgctcagctcctggggctcctgctgctctggctctcaggtgccagaggtgacatccacatgacccagtctccatcctccctgtctgcatctgtgggagacagagtcaccatcacttgccaggcgactcagaacatctactaacttttaaatggtatcagacaaaaacctgggatggacccctaaactcctgatctaccgtgcatccagtttggaaacaggggtcccatcaaggttcagtggaagtggatagtgggaca

SEQ ID NO: 297095 - DNA, 214 bp, Homo sapiens
  misc_feature: NA.25.76.G10.3.454.light.1.nb
tactgacgcagccgccctcagtgtctggggccccaggcgagagggtcaccatctcctgcactggggacagttccaatatcggggcaccttataatgttcactggtatcaacaacttccagggacagcccccaaatcgtcattcatgctgataacaatcgtccctcaggtgtccctgaccgattctccggctccaagtctggcacctcagcctcc

SEQ ID NO: 297096 - DNA, 105 bp, Homo sapiens
  misc_feature: NA.25.8.A08.1.454.light.1.nb
agtcagtcccaacgaggacacagcatggacatgagggtccctgctcagctcctgggctcctgctgctctggctctcaggtggcagatgtgacatccagatgaccc

SEQ ID NO: 297097 - DNA, 377 bp, Homo sapiens
  misc_feature: NA.25.83.H06.1.454.light.1.nb
gcaggcaggggcagcaagatggtgttgcagacccaggtcttcatttctctgttgctctggatctctggtgcctacggggacttcgtgatgacccagtctccagactccctggctgtgtctctgggcgagagggccaccatcaactgcaagtccagccagagtgtttttacagctccgacaataagaactacttagcttggcaccagcagaaaccaggacagcctcctaagctgctcatttactggcatctacccgggaatccggggtccctgaccgattcagtggcagcggtctgggacagatttcactctcaccatcagcagcctgcaggctgaagatgtggcagtttatactgtcagcaatattatagtactcct

SEQ ID NO: 297098 - DNA, 495 bp, Homo sapiens
  misc_feature: NA.25.86.H09.1.454.light.1.nb
ctggggacactgaactggtgctgagttactgagatgagccagccctgcagctgtgtccagcctgcccatcctctgctcatttgcatattcccagaacacaacctcctgccctgaagacttcttagtaggctggtcacacttcttgcaggagtcagacccactcaggacacagcatggacatgagggtccccgctcagctcctggggcttctgctgctctggctcccaggtgccaaatgtgccatccagttgacccagtctccatcctccctgtctgcctctgttcgagacatagtcaccatcacttgtcgggctagtcgggtcattggcagtgctttagcctggtatcagcagaaaccaggggaagctcctaagctcctgatctttgatgcctcagtttggaaagtggagtcccatcaaggttcagcggcagtggatcgtgggacagatttcatcctcaccatcagcagcctgcagcctgaagtattctgcaacc

SEQ ID NO: 297099 - DNA, 128 bp, Homo sapiens
  misc_feature: NA.25.86.H09.4.454.light.1.nb
tgagtggtccgacggtgttcggcggagggaccaagctgaccgtcctaggtcagcccaaggctgccccctcggtcactctgttcccgccctcctcactgtacagtctgagcgggctggcaaggcgcata

SEQ ID NO: 297100 - DNA, 311 bp, Homo sapiens
  misc_feature: NA.25.87.H10.2.454.light.1.nb
  modified_base (262)..(262): a, c, t, g, unknown or other
  misc_feature (262)..(262): n is a, c, g, or t
cagtcaggacacagcatggacatgagggtccccgctcagctcctggggctcctgctgctctggctcccaggtgcccaatgtgacatccaggtgacccagtctccttccaccctgtctgcatctataggggacagagtcaccatcacttgccgagccagtcggagtgttgggcggcttttggcctggtatcagcacaaaccagggaaacgcccccaaactcctcctctatgaggcgtctactttacacactggacgtcccctnaaggttcagcggcagtggatctgggacagaattcactctcaccatcagc

SEQ ID NO: 297101 - DNA, 301 bp, Homo sapiens
  misc_feature: NA.25.9.A09.1.454.light.1.nb
caactacttagcctggtaccaacagaaacctggccaggctcccaggctcctcatctatgatgcagccaacagggccactggcatcccagccaggttcagtggcagtgggtctgggacagacttcactctcaccatcaccagcctagagcctgaggattctgcagtttacactgtcagcagcgtagccactggcctcagacgttcggccaagggaccaaggtggagatcaaacgaactgtggctgcaccatctgtcttcatcttccgctatctgaactgtacagtctgagcggctggcaagg

SEQ ID NO: 297102 - DNA, 321 bp, Homo sapiens
  misc_feature: NA.26.12.B01.1.454.light.1.nb
tcagtcaggacccagacggaaccatggaagccccagcgcagcttctcttcctcctgctactctggctccagatattaccggaaaaataatgatgactcagtctccaggcaccctgtctgtgtctccaggggaaaggtcaccctctcctgcagggccagtcagagtgttagtaacaacttagcctggtaccagcagaaacctggccaggctcccaggctcctcatctctggtgcatccaccagggccactggtactcccggccagattcagtggcagggggtctgggacagaattcactctcaccatcacagcctgcagtct

SEQ ID NO: 297103 - DNA, 77 bp, Homo sapiens
  misc_feature: NA.26.12.B01.3.454.light.1.nb
gaactgtggctgcaccatctgtcttcatcttcccgccatctgaagtatagtctctgagcgggctggcaaggcgcata

SEQ ID NO: 297104 - DNA, 463 bp, Homo sapiens
  misc_feature: NA.26.21.B10.1.454.light.1.nb
cctcagggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcagggatccctgaccgaatttctggctccaactctgggaacacagccactctgaccatcagcggggcccagccaacggatgagggagactactattgtcaggcgtgggagaatactattgtagtgtttggcggagggaccaggctgaccgtcctaggtcagcccaaggctgccccctggtcactctgttcccaccctcctcagtatagtct

SEQ ID NO: 297105 - DNA, 391 bp, Homo sapiens
  misc_feature: NA.26.23.C01.1.454.light.1.nb
acccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggacca

SEQ ID NO: 297106 - DNA, 431 bp, Homo sapiens
  misc_feature: NA.26.26.C04.1.454.light.1.nb
agctcagctctacccttgccttgactgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttatactgcctgcagagtattcactggccgtggacgttcggccaag

SEQ ID NO: 297107 - DNA, 249 bp, Homo sapiens
  misc_feature: NA.26.37.D04.2.454.light.1.nb
  modified_base (54)..(54): a, c, t, g, unknown or other
  misc_feature (54)..(54): n is a, c, g, or t
agaaatagtgatgacgcagtctccagccaccctgtctgtgtctccaggggaaangtcaccctctcctgcagggccagtcagagtgttagtcgcggcttagcctggtaccagcagacacctgggcagactcccaggctcctcatttagctgcatccaccagggccactggtactcccagccaggttcagtggcagtgggtctgggacagagttcactctcaccatcagcagcctgcagtctgaagtattg

SEQ ID NO: 297108 - DNA, 116 bp, Homo sapiens
  misc_feature: NA.26.37.D04.3.454.light.1.nb
  modified_base (57)..(57): a, c, t, g, unknown or other
  misc_feature (57)..(57): n is a, c, g, or t
acaaaatagtgctgacgcagtctccagcccaccctgtctgcctctccgaggggaaangtcaccatctcctgtcgggccggtcagagtattagcagcaacttagcctggcaccagca

SEQ ID NO: 297109 - DNA, 255 bp, Homo sapiens
  misc_feature: NA.26.5.A05.2.454.light.1.nb
tgggcacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagctccaacagtcggggcaggtcgtaatgtacactggtaaccaacatcttccaggaacacgacccccaaatcgtcatctactacaaa

SEQ ID NO: 297110 - DNA, 316 bp, Homo sapiens
  misc_feature: NA.26.55.E11.1.454.light.1.nb
gtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaa

SEQ ID NO: 297111 - DNA, 241 bp, Homo sapiens
  misc_feature: NA.26.58.F03.1.454.light.1.nb
ctcagttaggacccagacggaaccatggaagccccagcgcagcttctcttcctcctgctactctggctcccagatatcactggagaaatagtgatgacgcagtctccagccaccctgtctgtgtctcccggggaaagagccaccctctcctgcagggccagtcagagtgttggcagcaacttagcctggtaccaacagaaacctgggcaggctcccaggctcttcatctacggtgcatcca

SEQ ID NO: 297112 - DNA, 369 bp, Homo sapiens
  misc_feature: NA.26.60.F05.2.454.light.1.nb
  modified_base (138)..(138): a, c, t, g, unknown or other
  misc_feature (138)..(138): n is a, c, g, or t
ctcagttaggacccagacggaaccatggaagccccagcgcagcttctcttcctcctgctactctggctcccagataccactggcaaaatagtgctgacgcagtctccagccaccctgtctgcctctccgaggggaaanagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagtattttgctagtttattactgtcagcagtatcatgactgg

SEQ ID NO: 297113 - DNA, 406 bp, Homo sapiens
  misc_feature: NA.26.67.G01.1.454.light.1.nb
caggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctccggagatgcattgaccaaaaaaattgcttattggtaccagcagaagtcaggccaggcccctgtgctggtcatctacgaggacagcagacgaccctccgggatccctgagagattctctggctccagttcagggacaatggccacttgactgtcaggtggggcccaggtggaggatgaagctgactactactgttactcaacagacagtagtggttatcacgtgggtgttcggcggagggaccaagctgaccgt

SEQ ID NO: 297114 - DNA, 341 bp, Homo sapiens
  misc_feature: NA.26.67.G01.2.454.light.1.nb
ggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacacgccactctgaccatcagcgggcccagccaacggatgagggagactacta

SEQ ID NO: 297115 - DNA, 134 bp, Homo sapiens
  misc_feature: NA.26.67.G01.3.454.light.1.nb
tatgcgccttgccagcccgctcagagactatactggaagtagtccttgaccaggcagcccagggccgctgtgccccagaggtgctcttggaggagggtgccagggggaagaccgatgggcccttggtggacaag

SEQ ID NO: 297116 - DNA, 350 bp, Homo sapiens
  misc_feature: NA.26.70.G04.1.454.light.1.nb
gacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgtatttttagcctggtttcagcagaaaccagggaaacgccccaagtccctgatctatgctgcgtccactttagaaggtggagtcccatcaaggttcagcggcagtggatcgtgggacagagttcactctcaacatcagcagcctgcagcctgaggattttgctaacttattactg

SEQ ID NO: 297117 - DNA, 479 bp, Homo sapiens
  misc_feature: NA.26.71.G05.1.454.light.1.nb
agcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctattttggtcatcttccaagataagaagcggccctcagggatccctgaccgaatttctggctccaactctgggaacacagccactctgaccatcagcgggcccagccaacggatgagggagactactattgtcaggcgtgggagaatactattgtagtgtttggcggagggaccaggctgaccgtcctaggtcagcccaaggctcgccccctggtcactctgttcccgccctcctcagtatagtctctgagcgggctggcaaggcgcata

SEQ ID NO: 297118 - DNA, 359 bp, Homo sapiens
  misc_feature: NA.26.72.G06.1.454.light.1.nb
tggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggctagtttattactgtcagctaattattttcgt

SEQ ID NO: 297119 - DNA, 358 bp, Homo sapiens
  misc_feature: NA.26.75.G09.1.454.light.1.nb
aggacccagagggaaccatggaaaccccagcgcagcttctcttcctcctgctactctggctcccagattccaccgcagaaattgtgctgacgcagtctcccgggacctgtctttgtctccaggggaaaagccaccctctcctgcagggccagtcagagtgttagcaactactatttagcctggtaccaacagaagtctggccaggctccccggctcctcatctacggaacatccaaccgggccactggcatcccagacaggttcagtggcagtgggtctgagacagacttcactctcactatcagcagactggagcctgaagtattttgcagtgtattactgtcagcagtatgctacc

SEQ ID NO: 297120 - DNA, 186 bp, Homo sapiens
  misc_feature: NA.26.75.G09.2.454.light.1.nb
gacacagcatggacatgagggtccccgctcagctcctggggctcctgctgctctggctcccaggtgtcaaatgtgacatccagatgacccagtctccttccaggctgtctgcatctgtcggagacagagtccaccatccacgttgccgggccagtcagagtattgggtaggtggttggcctggtat

SEQ ID NO: 297121 - DNA, 360 bp, Homo sapiens
  misc_feature: NA.26.78.H01.1.454.light.1.nb
tgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctccaggctcctcatctatgatgcatccaacagggccactggcatcccagccaggttcagtggcagtgagtctgggacagacttcactctcaccatcagcagcctagagcctgaagtatttgctactttattactgtcagcagcgta

SEQ ID NO: 297122 - DNA, 271 bp, Homo sapiens
  misc_feature: NA.26.79.H02.1.454.light.1.nb
ctcagtcaggacacagcatggacatgagggtccccgctcagctcctggggctcctgctactctggctccgaggtgccagatgtgacgtccagatgatccagtctccgccctccctgtctgcatctgtaggagacagagtcaccatcacttgccgggcaagtcagagcattggcacctatttaaatggtatcaacagaaaccagggaaacgcccctaacctcctgatctatgctgcttccaatttgcaaagtggatcccatcaagattcagt

SEQ ID NO: 297123 - DNA, 291 bp, Homo sapiens
  misc_feature: NA.26.80.H03.2.454.light.1.nb
ccacctgcaggtcagggccaaggttatggggtcccaggttcacctcctcagcttcctcctcctttggatctctgggcagagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccactcgactcagtgcaacaaatatggaactagttttta

SEQ ID NO: 297124 - DNA, 341 bp, Homo sapiens
  misc_feature: NA.27.14.B03.1.454.light.1.nb
agaggttctttctctgggatgtggcagtgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctgaggttcagtggcagtggatctgggacacatttcaccctcaccatcaa

SEQ ID NO: 297125 - DNA, 440 bp, Homo sapiens
  misc_feature: NA.27.23.C01.1.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactcgtccccaaactcattctttatgatgtcagtaatcggccccagggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgcccct

SEQ ID NO: 297126 - DNA, 64 bp, Homo sapiens
  misc_feature: NA.27.23.C01.2.454.light.1.nb
tagcaagagccccaaggccgaagtcggttgggagaccgtcccggagaaggcgcctgcctcctga

SEQ ID NO: 297127 - DNA, 449 bp, Homo sapiens
  misc_feature: NA.27.78.H01.1.454.light.1.nb
agaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcaccatcaatagcctggaagctgaagatgctgctaacttattactgtcatcagagtactactttacctcaagtgatcaccttcggccaagggacacgactggagattaaacgactgt

SEQ ID NO: 297128 - DNA, 78 bp, Homo sapiens
  misc_feature: NA.27.78.H01.2.454.light.1.nb
cccagagcagcagaaaaccaatagacgttggtgatggcaaccatcttcctgccttccgacttcgtcacgttttgtctc

SEQ ID NO: 297129 - DNA, 87 bp, Homo sapiens
  misc_feature: NA.28.24.C02.1.454.light.1.nb
tatgcgccttgccagcccgctcagagtacgctattcagatggcgggaagatgaagacagatggtgcagccacagttcgtttgatctc

SEQ ID NO: 297130 - DNA, 223 bp, Homo sapiens
  misc_feature: NA.29.1.A01.1.454.light.1.nb
ctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggctgccccctggtcactctgttcccgccctcctcagtactctatctgagcgggctggcaaggcgcata

SEQ ID NO: 297131 - DNA, 208 bp, Homo sapiens
  misc_feature: NA.29.14.B03.2.454.light.1.nb
acccactcaggacacagcatggacatgagggtccccgctcagctcctggggctcctgctgctctggctcccaggtgccagatgtgccatccagatgacccagtctccatattccctgtctgcatctgtaggagacagagtcagcatcacttgccgggcaagtcaggacatccgaaatgagataagctggtatcaacagaaaccaggga

SEQ ID NO: 297132 - DNA, 87 bp, Homo sapiens
  misc_feature: NA.29.24.C02.2.454.light.1.nb
gaaatcaaacgaactgtggctgcaccatctgtcttcatcttcccgccatctgaagtactctatctgagcgggctggcaaggcgcata

SEQ ID NO: 297133 - DNA, 88 bp, Homo sapiens
  misc_feature: NA.29.26.C04.1.454.light.1.nb
gcgtcctaggtcagcccaaggccaaccccactgtcactctgttcccacctcctctatacgatcgctgagcgggctggcaaggcgcata

SEQ ID NO: 297134 - DNA, 378 bp, Homo sapiens
  misc_feature: NA.29.27.C05.1.454.light.1.nb
tgctcagttaggacccagagggaaccatggaagccccagctcagcttctcttcctcctgctactctggctcccagatgccaccggagaaagtgtgttgacacagtctccagccaccctgtctttgtctccaggggaaagagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgtcagcagcgtagcgactggcgtgggctc

SEQ ID NO: 297135 - DNA, 285 bp, Homo sapiens
  misc_feature: NA.29.28.C06.1.454.light.1.nb
tcaggaggcagcgctctcaggacgtcaccaccatggcctgggctctgctcctcctcaccctcctcactcagggcacagggtcctgggcccagtctgtcctgactcagcctccctccgcgaccgggtctcctggacagtcagtcaccatctcctgcactggaaccagcagtgacgttggtggttatgactatgtctcctggtatcaacaacacccggacaaacgtccccaaactcctgtatttatgacgtcgctacgccgaccctcgacgggtccctgactcgctt

SEQ ID NO: 297136 - DNA, 490 bp, Homo sapiens
  misc_feature: NA.29.35.D02.1.454.light.1.nb
actgctcagttaggacccagacggaaccatggaagccccagctcagcttctcttcctcctgctactctggctcccagataccagcggagagattgtgttgacacagtctccagccaccctgtctttgtctccgggagaaagagccaccctctcctgcagggccagtcagagtgttaacaactacttggcctggttccaacagaaacctggccaggctcccaggctcctcatctatgatgcatccaacagggccactggcatcccagccaggttcagtggcagtgggtctgggacagacttcactctcaccatcagccgcctagagcctgaggattctgccgtttattattgtcttgggcgtagcaactggcctcccgtcacttttggccaggggaccaagctggagatcagacgaactgtggctgcaccatctgtcttcatcttcccgccatctgaagtactctatctgagcgggctggcaaggcgcata

SEQ ID NO: 297137 - DNA, 481 bp, Homo sapiens
  misc_feature: NA.29.36.D03.1.454.light.1.nb
gaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcgaggggtccctgatcgcttctctgggtccaagtctggcagcacggcctccctgattatctctgggctccaggctgaggacgaggctgaatattattgcagctcatatacaagggacaacacttatgtcttcggaactgggaccaaagtcaccgtcctaggtcagcccaaggccaacccactgtcactctcgttcccgccctcctcagtactctatctgagcgg

SEQ ID NO: 297138 - DNA, 243 bp, Homo sapiens
  misc_feature: NA.29.37.D04.1.454.light.1.nb
tgtgttgacgcagccgccctcaatgtctgcggccccaggacagaaggtcaccatctcctgctctggaagcagctccaacattggaggtaattatgtctcctggtaccagcagctcccaagaacacgcccccaaaattctcatttatgacaatgataagcggccctgagggattcctgaccgattctctggctccaagtctggcacgtctgccaccctggccatccaccggactccagactgga

SEQ ID NO: 297139 - DNA, 25 bp, Homo sapiens
  misc_feature: NA.29.42.D09.2.454.light.1.nb
tatgcgccttgccagcccgctcaga

SEQ ID NO: 297140 - DNA, 188 bp, Homo sapiens
  misc_feature: NA.29.55.E11.1.454.light.1.nb
ctcagtcaggacacagcatggacatgagggtccccgctcagctcctggggctcctgctactctggctccgaggtgccagatgtgacatccagatgacccagtctccatcatccctgtctgcatctgtcggagacagaatcaccattattgccgacaagtcacgacataaactaccttttaaatgtatc

SEQ ID NO: 297141 - DNA, 84 bp, Homo sapiens
  misc_feature: NA.29.57.F02.1.454.light.1.nb
atcaaacgaactgtggctgcaccatctgtcttcatcttcccgccatctgatgtcgagcgtctgagcgggctggcaaggcgcata

SEQ ID NO: 297142 - DNA, 371 bp, Homo sapiens
  misc_feature: NA.29.59.F04.1.454.light.1.nb
tcagacccagtcaggacacagcatggacatgagggtccccgctcagctcctggggctcctgctgctctggctcccaggtgccaaatgtgacatccagatgacccagtctccttccactgtgtctgcatctgtaggtgacagagtcaccatcacttgccgggccagtcagagtattagtagctggttggcctggtatcagcagaaaccagggaaagcccctaagctcctgatctataaggcgtctagtttagaaagtgaggtccatcaaggttcggcggcagtggatctgggacagaattcactctcaccatcagcagcctgcagcctgatgattttgactaacttattactgaccaacagtataatagttt

SEQ ID NO: 297143 - DNA, 327 bp, Homo sapiens
  misc_feature: NA.29.59.F04.2.454.light.1.nb
ctgggagttgctggtaccaggatacagaattcttcacaatgttggagctacttccagggacagtccccaaacttctcatttatgacaatagtcagcgaccctcagggattcctgaccgattctctgcctccaagtctggctcgtcagccaccctgggcatcaccgggctccagactggggacaggccgattattatgtggaacatgggatagcagcctgagtgcttacgcttcggaactgggaccaaggtcaccgtctaggtcagcccaaggccaaccccatcgtcacttctcgttccccgccctcctcacgtacctctatctgacg

SEQ ID NO: 297144 - DNA, 339 bp, Homo sapiens
  misc_feature: NA.29.60.F05.1.454.light.1.nb
tcttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaaggaactgtggctgcaccatctgtcttcatcttcccgccatctgatctctcgactctgagcgggctggcaaggcgcata

SEQ ID NO: 297145 - DNA, 341 bp, Homo sapiens
  misc_feature: NA.29.62.F07.1.454.light.1.nb
ctcctgcagggccagtcaaagtattagcagcagaaacttagcctggtaccagcaaaaacctggccaggctcccaggctcctcatctttggtgcatctaccagggccactggcatcccagaccggttcagtggcagtgggtctgggacagacttcactctcaccatcagcagactggggcctgaagatgcatcagtgtattactgtcatcaatatggttcttcagtttcgctcaccttcggccaagggacacgactggagattaaacgactgtggctgcaccatctgtcttcatcttcccgcatctgaagtactctatctgagcgggctggcaaggcgcata

SEQ ID NO: 297146 - DNA, 386 bp, Homo sapiens
  misc_feature: NA.29.67.G01.1.454.light.1.nb
acaggcaggcaggggcagcaagatggtgttgcagacccaggtcttcatttctctgttgctctggatctctggtgcctacggggacatcgtgatgacccagtctccagactccctggctgtgtttctgggcgagagggccaccatcaactgcaagtccagccagaatattttatatagctccaacaataagaattacttagcttggtaccagcagaaaccaggacagcctcctaagctgctcatttactgggcatctacccgggaatccggggtccctgaccgattcagtggcagcgggtctgggacagatttcacactcagtattagcagcctgcaggctgaagatgtggccatttatactgtcagcaatattatactactcccga

SEQ ID NO: 297147 - DNA, 473 bp, Homo sapiens
  misc_feature: NA.29.71.G05.1.454.light.1.nb
gaactgaggagcaggtgggggcacttctccctctaacactctcccctgttgaagctctttgtgacgggcgagctcaggccctgatgggtgacttcgcaggcgtagactttgtgtttctcgtagtctgctttgctcagcgtcagggtgctgctgaggctgtaggtgctgtccttgctaatgctctggatacctggatccagtggagatattgagatgacccagactccactctctctgtccgtcacccctggacagccggcctccatctcctgcaagtctagtcagagcctcgtgcatagtgatggaaagacctatatgtactggtacctgcagaagtcaggccagcctccacgactcctgatttatgaagtttccaagtcgtttattttggagtgccagacaggctcagtggcagcgggtcagggacagatttcacactgaaatcagccgggtggaggctgaggatgtggcta

SEQ ID NO: 297148 - DNA, 382 bp, Homo sapiens
  misc_feature: NA.29.74.G08.1.454.light.1.nb
tggtaggtgctgtccttgctgtcctgctctgtgacactctcctgggagtcaccctcacttgtcaggctaatcaaaacattaagagatatttaaattggtatcagcagaaaccaggaaaagcccctaaactcctcatctacgatgtatccaatttggaacctgggtcccatcaaggttcagtggaggcggaggtgggacagattttactctcactattagcagcctgcagcctgaagatattgcaacatattactgtcaacaatatgatgaactgcctccgacattcggccaagggaccagggtggaggtcagacgaactgtggctgcaccatctgtcttcattcttcccgcatctgaagtctctatctgagcgggctggcaa

SEQ ID NO: 297149 - DNA, 87 bp, Homo sapiens
  misc_feature: NA.29.77.G11.1.454.light.1.nb
gaagtcaaaggaactgtggctgcaccatctgtcttcatcttcccgccctcctcatagcgtactctgagcgggctggcaaggcgcata

SEQ ID NO: 297150 - DNA, 408 bp, Homo sapiens
  misc_feature: NA.29.78.H01.2.454.light.1.nb
catggtgcagactccccagagctctcctcctcctccactgcacagggtctctctcccagcctgtgctgactcaatcgccctctgcctctgcctccctgggaggctcggtcaaggtcacctgtactctgagcagtggacacagcagctacgccatcgcttggcatcagcagaggccagacacgggccctcgttacttgatgacagtcaacaatgatggcagtcacagcaagggggacggatccctgatcgcttctcagtctccagctctgggcctgagcgctacctcacaatctccggcctccagtctgaggatgaggctgactattactgtcagacctggggcactggcattcaggtcttcggaccgggaccaaggtcaccgtcgtcggtcagcccaaggcccaaccc

SEQ ID NO: 297151 - DNA, 100 bp, Homo sapiens
  misc_feature: NA.29.78.H01.4.454.light.1.nb
tcccgccttgacgggctgccatcagcccaaggccaaccccactgtcactctgttcccgccctcctcagtactctatctgagcgggctggcaaggcgcata

SEQ ID NO: 297152 - DNA, 87 bp, Homo sapiens
  misc_feature: NA.29.79.H02.1.454.light.1.nb
aagtcaaaggaactgtggctgcaccatctgtcttcatcttcccagccctcctcatagcgtactctgagcgggctggcaaggcgcata

SEQ ID NO: 297153 - DNA, 423 bp, Homo sapiens
  misc_feature: NA.29.85.H08.2.454.light.1.nb
atcctgggctcagtctgccctgactcagcctcgctcagtgtccgggtctcctggacagtcagtcaccatctcctgcactggaaccagcagcgatgtcggtggttataactttgtctcctggtaccaacaacacccaggcgaggccccccgactcataatttatgatgtcattaagcggccctcaggggtccctgatcgcttctctggctccaagtctggcaacactgcctccctgaccatctctgggctccaggctgacgatgacggtgattattactgctgctcatttgcaggcacccgcactgtgatcttcggcggagggaccaagctgaccgtcctaggtcagctcaaggctcgccccctcggtcactctcgttcccaccctcctcagtactctatctgagcgggctggcaaggcgcata

SEQ ID NO: 297154 - DNA, 168 bp, Homo sapiens
  misc_feature: NA.29.85.H08.3.454.light.1.nb
ctcttgggcccagtctgccctgattcagcctccctccgtgtccgggtctcctggacagtcagtcgccatctcctgcactggaaccagcagtgatgttgagaattatgactgtctcccttggtaccaacaacacccagacacagtccacaaacacatgatatacaatgt

SEQ ID NO: 297155 - DNA, 388 bp, Homo sapiens
  misc_feature: NA.29.87.H10.1.454.light.1.nb
tctctctcagtccagacacagcatggacatgagggcccccgctcagctcctgggactcctgctgctctggctcccagataccagatgtgacatccagatgacccagtctccatcctccctgtctgcatctgtgggagacagagtcaacgtcacttgccgggcgagtcagggcattaacaattatttagcctggtatcagcagcatccagggaaagttcctaagctcctgatctatgctgcatccactttgcaatcagggtcccatctcggttcagtggcggtggatatgggacagagttcactctcaccatcagcagcctgcagcctgaagatgttgcaacttattactgtacaaaagtatacactttgcccctatccaccttcggcc

SEQ ID NO: 297156 - DNA, 91 bp, Homo sapiens
  misc_feature: NA.2.11.A11.1.454.light.1.nb
caggatgtcacatctggcacctcggagccagagtagcaggagccccacggagctgagcggggaccctcatgtccatgctgtgtcctgactg

SEQ ID NO: 297157 - DNA, 62 bp, Homo sapiens
  misc_feature: NA.2.13.B02.1.454.light.1.nb
tatgcgccttgccagcccgctcagacgctcgacaggaagtagtccttgaccaggcagctatg

SEQ ID NO: 297158 - DNA, 181 bp, Homo sapiens
  misc_feature: NA.2.14.B03.1.454.light.1.nb
gtcagacccagtcaggacacagcatggacatgagggtcccgctcagctcctgggctcctgctgctctggttcccaggttccagatgcgacatccagctgacccagtctccttctttcgtgtctgcgtctgtgagagacagacttacgtatcacttgtcgggcgagtcaggatattagtacc

SEQ ID NO: 297159 - DNA, 365 bp, Homo sapiens
  misc_feature: NA.2.26.C04.1.454.light.1.nb
tgctcagttaggacccagacggaaccatggaagccccagcgcagcttctcttcctcctgctactctggctcccagataccactggagaaatagtgctgacgcagtctccagccaccctgtctgtgtctccaggggaaagagccaccctctcctgcagggccagtcagagtgttagcggcaacttagcctggtaccagcagaagcctggccagactcccaggctccttatccatggtgcatccaccagggccactggtactcccagccaggttcagtggcagtgggtctgggacagagttcactctcaccatcagcagcctgcagtctgaagtattttgctagtttattactgtcagcagtataat

SEQ ID NO: 297160 - DNA, 88 bp, Homo sapiens
  misc_feature: NA.2.28.C06.1.454.light.1.nb
agactgacggtcctgccacagcggccctgggctgcctggtcaaggactacttcctgtcgagcgtctgagcgggctggcaaggcgcata

SEQ ID NO: 297161 - DNA, 222 bp, Homo sapiens
  misc_feature: NA.2.36.D03.1.454.light.1.nb
tattcagcaggcacacaacagaggcagttccagatttcaactgctcatcagcggcctgcagcctgaagattatgcaacttactattgtcagagttctaattctttcccgcgcacgtttggccaggggaccaaggtagagatcaaacgactgtggctgcaccatctgtcttcatcttcccgccatctgatgtcgagcgtctgagcgggctggcaaggcgcata

SEQ ID NO: 297162 - DNA, 374 bp, Homo sapiens
  misc_feature: NA.2.38.D05.4.454.light.1.nb
gaggaggcagaactctgggtgtctcaccatggcctggatccctctacttctcccctcttcactctctgcacaggctctgaggcctcctatgagctgacacagccaccctcggtgtcagtgtccccaggacagacggccaggatcacctgctctggagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagatgaggctgactattactgtcaatcagcagacagcagtggttacttttg

SEQ ID NO: 297163 - DNA, 352 bp, Homo sapiens
  misc_feature: NA.2.39.D06.1.454.light.1.nb
gtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttacaaaccgagggaaagcccctaagctcctgatctatgctgcatccagtttacaaagtgggtccatcaaggttcagtggcagtggatctgggacagatttcactctcaccatcagtagtctacaacctgaagtattttgactaacttactactgt

SEQ ID NO: 297164 - DNA, 319 bp, Homo sapiens
  misc_feature: NA.2.43.D10.1.454.light.1.nb
  modified_base (208)..(208): a, c, t, g, unknown or other
  misc_feature (208)..(208): n is a, c, g, or t
acacagcatggacatgagggtccccgctcagctcctggggctcctgctactgtggctccgaggtgccagatgtgacatcgacatgacccagtctccatcctccctgtctgcatctgtgggagaccgagtcaccatcacttgccgggcaagtcaggccgttaacacctatttaaattggtatcagacaaaaaccaggggcacgcccctnagctcctgatctctgctgcatccagattgcagagtggcgtcccatcgcgttcagtggcagtggatcgtgggacagatttctccctcaccatcagcagtctgcaaactgagg

SEQ ID NO: 297165 - DNA, 87 bp, Homo sapiens
  misc_feature: NA.2.68.G02.1.454.light.1.nb
tatgcgccttgccagcccgctcagacgctcgacatcagatggcgggaagatgaagacagatggtgcagccacagttcgtttgatttc

SEQ ID NO: 297166 - DNA, 328 bp, Homo sapiens
  misc_feature: NA.2.70.G04.1.454.light.1.nb
  modified_base (181)..(181): a, c, t, g, unknown or other
  misc_feature (181)..(181): n is a, c, g, or t
gctcagttaggacccagagggaaccatggaaaccccagcgcagcttctcttcctcctgctactctggctcccagataccaccggagaaactgtgttgacgcagtctccaggcaccctgtctttgtctccgaggggaaagccaccctctcttgcagggccagtcagactgttggcagaaacngcttctcctggtaccagcagaaacctggccacgctcccaggctcctcatctatgctacattcagcagcgccactggcatcccagacaggttcagtggcaggtgggtctgggacagagttcactctcaccatcagcagactggagcct

SEQ ID NO: 297167 - DNA, 350 bp, Homo sapiens
  misc_feature: NA.2.72.G06.1.454.light.1.nb
gtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccgagggaaagcccctaaactcctagatctatgttacatccagtttgctaaagtggggtcccatcaaggttcagtggcagtggatctgggacagatttcactctcaccatcagcagtctgacaacctgaagtattttgactaacttactactgt

SEQ ID NO: 297168 - DNA, 332 bp, Homo sapiens
  misc_feature: NA.2.74.G08.1.454.light.1.nb
taggacccagacggaaccatggaagccccagcgcagcttctcttcctcctgctactctggctcccagataccactggagaaatagtgatgacgcagtctccagccaccctgtctgtgtctccaggggaaaagccaccctctcctgcagggccagtcagagtgttagcagcaacttagcctggtaccagcagaaacctggccaggctcccaggctcctcatctatggtgcatccaacagggccactggtatcccagccaggttcagtggcagtgggtctgggatagagttcactctcaccatcagcagcctgcagtctgaagtattttgctag

SEQ ID NO: 297169 - DNA, 365 bp, Homo sapiens
  misc_feature: NA.2.78.H01.1.454.light.1.nb
tcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtgggtccatcgaggttcagaggcagtggatctgggacagatttcactctcaccatcagcggcctgcagcctgaagattctgcaacttactattgtcagtagttctgtattt

SEQ ID NO: 297170 - DNA, 88 bp, Homo sapiens
  misc_feature: NA.2.78.H01.2.454.light.1.nb
agagatcaaacgaactgtggctgcaccatctgtcttcatcttcccgccatctgatgtcgagcgtctgagcgggctggcaaggcgcata

SEQ ID NO: 297171 - DNA, 60 bp, Homo sapiens
  misc_feature: NA.2.83.H06.1.454.light.1.nb
tagctgcctggtcaaggactacttcctgtcgagcgtctgagcgggctggcaaggcgcata

SEQ ID NO: 297172 - DNA, 328 bp, Homo sapiens
  misc_feature: NA.2.87.H10.1.454.light.1.nb
tctcagtcaggacacagcatggacatgagggtcccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccagggaaagcccctaggctcctcctctactctgcaagcagcttgcatgctggggtcccatcaagattccgtggcagtggatcgtgggacagaattcactctcacgatcaccagtctggaacctgacg

SEQ ID NO: 297173 - DNA, 89 bp, Homo sapiens
  misc_feature: NA.30.24.C02.1.454.light.1.nb
gagaaatcaaacgaactgtggctgcaccatctgtcttcatcttcccgccatctgaagtactctatctgagcgggctggcaaggcgcata

SEQ ID NO: 297174 - DNA, 376 bp, Homo sapiens
  misc_feature: NA.30.27.C05.1.454.light.1.nb
gctcagttaggacccagagggaaccatggaagccccagctcagcttctcttcctcctgctactctggctcccagatgccaccggagaaagtgtgttgacacagtctccagccaccctgtctttgtctccaggggaaaagccaccttctcctgcagggccagtcagagtgttggcacctacatagcctggtaccaacagaaacctggccaggctcccaggctcctcatctatgatgcatccaaaagggcctctggcatcccagccaggttcagtggcagtgggtctgggacagacttcactctcaccatcagtagcctagagcctgaagattttgctagtttattactgtcagcagcgtagcgactggcgtgggctc

SEQ ID NO: 297175 - DNA, 87 bp, Homo sapiens; identical to SEQ ID NO: 296882
  misc_feature: NA.30.45.E01.2.454.light.1.nb

SEQ ID NO: 297176 - DNA, 66 bp, Homo sapiens
  misc_feature: NA.30.53.E09.1.454.light.1.nb
gttatcacgggagacacacggcgggtgctaacgtccgtcgtgaagagggaaacaacccagaccgcc

SEQ ID NO: 297177 - DNA, 87 bp, Homo sapiens
  misc_feature: NA.30.57.F02.2.454.light.1.nb
tatgcgccttgccagcccgctcagagcactgtagtcagatggcgggaagatgaagacagatggtgcagccacagttcgtttgatttc

SEQ ID NO: 297178 - DNA, 85 bp, Homo sapiens
  misc_feature: NA.30.60.F05.1.454.light.1.nb
agtcaaaggaactgtggctgcaccatctgtcttcatcttcccgccctcctcacgtagcgtgctgagcgggctggcaaggcgcata

SEQ ID NO: 297179 - DNA, 381 bp, Homo sapiens
  misc_feature: NA.30.67.G01.1.454.light.1.nb
gtcccaaccaggacacagcatggacatgagggtccctgctcagctcctggggctcctgctactctggctctcaagtgccagatgtgacatccagatgacccagtctccagcgtccctgtctgcatctataggagacagagtcaccatcacttgccaggcgagtcaggacatcagcaactatttaaattggtatcagcagaaaccagggacagcccctaagctcctgatccacgatgcttgctaatttggaagttgggtcccatcaagattcagtggcagtggatctgggacatattttacttaaccataaccaactgcagccggaagatattgcagcatattactgtctacaatatgataatctccattcactttcgcctg

SEQ ID NO: 297180 - DNA, 315 bp, Homo sapiens
  misc_feature: NA.30.68.G02.2.454.light.1.nb
agcagcaacttagcctggtaccagcagaaacctggccaggctcccaggctcctcatctatgatgcgtccaccagggtcactggtatcccagccaggttcagcggcagtgggtctgggacagagttcagtctcaccatcagcagcctgcagtctgaagattttgctagtttattattgtcagcactataacaattggcctccggaaacttttggccaggggaccaagcttgagatcaaacgaactgtggctgcaccatctgtcttcatcttcccgcatctgaacgtagcgtgctgagcgggctggcaaggcgcata

SEQ ID NO: 297181 - DNA, 106 bp, Homo sapiens
  misc_feature: NA.30.86.H09.2.454.light.1.nb
gcggagggaccaagctgaccgtccttcgtcagcccaaggctgcccctcggtcactctgttcccaccctcctcacgtagcgtgctgagcgggctggcaaggcgcata

SEQ ID NO: 297182 - DNA, 112 bp, Homo sapiens
  misc_feature: NA.30.89.I01.1.454.light.1.nb
gttcggcggagggaccaagctgaccgtcctaggtcagcccaaggctgccccctcggtcactctgttcccaccctcctcacgtagcgtgctgagcgggctggcaaggcgcata

SEQ ID NO: 297183 - DNA, 296 bp, Homo sapiens
  misc_feature: NA.31.14.B03.2.454.light.1.nb
caacaggcaggcaggggcagcaagatggtgttgcagacccaggtcttcatttctctgttgctctggatctctggtgcctacggggacatcgtgatgagccagtttccagactccctggctgtgtctcgtgggcgagagggccaccatcaactgcaagtccagccagagtgttttattggccccacaataacaactacttagcttggtaccagcagaaagtaggacagcctacctaaactcctgatttactgggcttctacccgggcatccggggttcctaacgattcattggcagc

SEQ ID NO: 297184 - DNA, 87 bp, Homo sapiens
  misc_feature: NA.31.24.C02.1.454.light.1.nb
gagatcaaacgaactgtggctgcaccatctgtcttcatcttcccaccctcctcacgtctactgctgagcgggctggcaaggcgcata

SEQ ID NO: 297185 - DNA, 82 bp, Homo sapiens
  misc_feature: NA.31.24.C02.2.454.light.1.nb
tcaaacgaactgtggctgcaccatctgtcttcatcttccgccatctgaacgtctactgctgagcgggctggcaaggcgcata

SEQ ID NO: 297186 - DNA, 166 bp, Homo sapiens
  misc_feature: NA.31.33.C11.1.454.light.1.nb
acaggcaggcaggggcagcaagatggtgttgcagacccaggtcttcatttctctgttgctctggatctctggtgcctacggggacatcgtgatgagccagtttccagactccctggctgtgtctcgtgggcgagacgggccaaccatcaactgcaagtccagccag

SEQ ID NO: 297187 - DNA, 445 bp, Homo sapiens
  misc_feature: NA.31.78.H01.1.454.light.1.nb
acaacaggcaggcaggggcagcaagatggtgttgcagacccaggtcttcatttctctgttgctctggatctctggtgcctacggggacatcgtgatgagccagtttccagactccctggctgtgtctctgggcgagagggccaccatcaactgcaagtccagccagagttgttttattggccccacaataacaactacttagcttggtaccagcagaaagtaggacagcctcctaaactcctgatttactgggcttctacccgggcatccggggttcctaaccgattcattggcagcgggtctgggaccgatttcactctcaccatcagcagcctgcaggctgaagatgtggcagtttattactgtcagcaacattatacttctttcgtctactttcggcggaggaccaaggtgagatcaaacgactgtggctgcaccatctgtc

SEQ ID NO: 297188 - DNA, 98 bp, Homo sapiens
  misc_feature: NA.31.78.H01.2.454.light.1.nb
acaacgaggcaggcagggcaggcaagactggtgttggccaggacccaggtcttcatttcctctcgttcgctctggagtctctgggtcgccgtaccggg

SEQ ID NO: 297189 - DNA, 220 bp, Homo sapiens
  misc_feature: NA.31.81.H04.1.454.light.1.nb
taaccgattcattggcagcgggtctgggaccgatttcactctcaccatcagcagcctgcaggctgaagatgtggcagtttatactgtcagcaacattatacttctttcgtcactttcggcggagggaccaaggtggagatcaaacgactgtggctgcaccatctgtcttcatcttcccgcatctgaacgtctactgctgagcgggctggcaaggcgcata

SEQ ID NO: 297190 - DNA, 392 bp, Homo sapiens
  misc_feature: NA.33.11.A11.1.454.light.1.nb
actacttctcaccctcctcgctcactgcacaggttcttgggccaattttatactgagtcagccccactctttgtcggggtctccggggaagacggtgagcatatcctgcacccgcagcagtggcagcatcgtcgacaactatgtgcactggtaccagcttcgcccgggcagttcccccaccactgtgatttatgaagttaaccaaagaccctctggggtccctgatcggttctctggctccgtcgacagctcctccaattctgccttctcaccatctctggactgaagactgaggacgaggctgtatattactgtcagtcctatgatagaaccacccatgtggttcgtcgggcgggggaccagtctgaccgtctgagtcagcccaaggctcg

SEQ ID NO: 297191 - DNA, 367 bp, Homo sapiens
  misc_feature: NA.33.12.B01.1.454.light.1.nb
  modified_base (316)..(316): a, c, t, g, unknown or other
  misc_feature (316)..(316): n is a, c, g, or t
gttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctcgtggacgtccccagccgcttctctggatccaaggatgtttcggccaacgcagggattttacncatctctgggctccagtctgacgatgaggctgactattactgtatgtattt

SEQ ID NO: 297192 - DNA, 60 bp, Homo sapiens
  misc_feature: NA.33.14.B03.2.454.light.1.nb
tccaggtccagtccatggtgatgcgctgtgctcccaggggcttctttagaggaggaatga

SEQ ID NO: 297193 - DNA, 77 bp, Homo sapiens
  misc_feature: NA.33.16.B05.1.454.light.1.nb
ctcgtggggagtctgcaccgatggcttggaccccatcctcttcctcaccctcctcctccactgcacagggtctctct

SEQ ID NO: 297194 - DNA, 258 bp, Homo sapiens
  misc_feature: NA.33.20.B09.1.454.light.1.nb
cagcgcccccgggacgtctccaccatggcctgggctctgctaatcctcaccctcctcactcagggcacagggtcctgggcccagtctgccctgactcaacctgcctccgtgtctgggtctcctggacagtcgatcaccatcccctgcactggaaccgcactaccgttggtgattatggctacgtctcctggtaccgacaatacccagacagacgccccccaatcttgatttttgatgtcacttatcggccctcaggta

SEQ ID NO: 297195 - DNA, 321 bp, Homo sapiens
  misc_feature: NA.33.21.B10.1.454.light.1.nb
cagcgctctcgggacgtctccaccatggcctgggctctgctattcctccccctcctcactcagggcacagggtcctgggcccagtctgccctgactcaacctgcctccgtgtctgggtctcctggacagtcggtcaccatctcctgcgctggaaccagtagtgacgttggaggctatgactatgtctcctggtaccaacaacaacctggcaaagcccccaattattgatttctgatgtcactaatcggccctcaggggtttctcatcgcttctctggctccaagtctggcagcacggcctccctgaccatctctgggctcc

SEQ ID NO: 297196 - DNA, 357 bp, Homo sapiens
  misc_feature: NA.33.23.C01.1.454.light.1.nb
ctgctcagttaggacccagagggaaccatggaagccccagctcagcttctcttcctcctgctactctggctcccagataccaccggagaagttgtgttgacgcagtctccaggcaccctgtctttgtctccaggggaaagagccaccctctcctgcagggccaatcagagtgttagcagtaacttagtctggtaccaacatagacctgaccaggctcccaggctcctcatctagatgctccaacagggccactggcatcccagccaggttcagtggcagtgggtctgggacagacttcactctcaccatcagcacctagaacttgaagtattttgctattttattactgtcagcagc

SEQ ID NO: 297197 - DNA, 90 bp, Homo sapiens
  misc_feature: NA.33.23.C01.2.454.light.1.nb
tatgcgccttgccagcccgctcagtacacacacttcagatggcgggaagatgaagacagatggtgcagccacagttcgtttgagctccac

SEQ ID NO: 297198 - DNA, 290 bp, Homo sapiens
  misc_feature: NA.33.25.C03.1.454.light.1.nb
taagaggttgtgtccaccatggcctggactcctctcctcctcctgttcctctctcactgcacaggttccctctcgcaggctgtgctgactcagccggcttccctctctgcatctcctggagcatcagccagtctcacctgcaccttgcgcagtggcatcaatgttgatacctacaggatattctggtaccagcagaagccagatagtcctccccggtatctcctgaggtacaggtcagactcagatacgcagcagggctcgtggacgtccccagccgcttctctggatcc

SEQ ID NO: 297199 - DNA, 331 bp, Homo sapiens
  misc_feature: NA.33.28.C06.1.454.light.1.nb
tggggagtctgcaccatggcttggaccccactcctcttcctcacccctcctcctccactgcacagggtctctctcccagcttgtgctgactcaatcgccctctgcctctgccctcccgtgggagcctcggtcaagctcatctgcactctgagcagtgggcacagcaactacgccatcgcatggcatcagcagcagccagagaagggccctcggtacttgatgaaggttaacagtgatggcagccacgaccgaagggggacggatccctgattcgttttcagggtccagctcgtggggctgagcgctacctcaccatctccagcctccagtc

SEQ ID NO: 297200 - DNA, 152 bp, Homo sapiens
  misc_feature: NA.33.33.C11.1.454.light.1.nb
tatgcgccttgccagcccgctcagtacacacactggaagtagtccttgaccaggcagcccagggccgctgtgcccagagcccaaatcttgtgacacacctcccccgtgcccaaggtgcccagcacctgaactcctgggaggaccgtcagtct

SEQ ID NO: 297201 - DNA, 317 bp, Homo sapiens
  misc_feature: NA.33.34.D01.1.454.light.1.nb
aggaggcagcgctctcaggacgtcaccaccatggcctgggctctgctcctcctcaccctcctcactcagggcacagggtcctgggcccagcctgccctgactcagcctccctccgcgtccgggtctcctggacagtcagtcaccatctcctgcactggaaccagcagtgacattggtggttatcaccgtgtctcctggtaccaacaacacccaggcacagcccccaaactcatactttatgaggtcactaagcggccctcaggggtccctgatcgcttctctggctcaagtctgacaacacggcctccctgaccgtc

SEQ ID NO: 297202 - DNA, 257 bp, Homo sapiens
  misc_feature: NA.33.37.D04.1.454.light.1.nb
tcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattacggaaatttttaaattggtttcagcagaaaccagggaaacgcccctagactcctgattcacgaggcatccaattcggaaat

SEQ ID NO: 297203 - DNA, 316 bp, Homo sapiens
  misc_feature: NA.33.45.E01.1.454.light.1.nb
aggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccagccgtgacgttggtggttataagtatgtctcctggtaccaacagcacccaggcaaagcccccaaatcttgatttatgaggtcactgagcggccctcgacggggtccctgatcgcttctctggctccaagtctggcaacacggcctccctgacc

SEQ ID NO: 297204 - DNA, 278 bp, Homo sapiens
  misc_feature: NA.33.55.E11.1.454.light.1.nb
caggacttgagacagaccgccacaatcacctgcactggggacagcgacaatgttggctacgaaggagcactttggctgcagcgactccagggccaccctcccaaactcctttcctacagggagaacaaccggccctcagggatcccagagaggttttctgcatccaggtcaggcaacacagcctccctgaccatcactggactccggcctgaggacgaggctgagtatttctgcttagcatgggacaggaacctcattgcttgggtgttcggcggagg

SEQ ID NO: 297205 - DNA, 327 bp, Homo sapiens
  misc_feature: NA.33.6.A06.2.454.light.1.nb
acagagccaccctctcctgcagggccagtcagactgttagcagcggcttcttagcctggtaccagcagaaacctggccaggctcccaggctcctcatccatggtgcatccaccagggccactggcatcccagacaggttcagtggcagtgggtctgggacagacttcactctcaccatcgacagactggagcctgaagattttgcagtctattactgtcagcagtatactggggagacgttcggccaagggaccaaggtggaaatcaaacgaactgtggctgcaccatctgtcttcatcttcccgcatctgaagtgtgtgtactgag

SEQ ID NO: 297206 - DNA, 35 bp, Homo sapiens
  misc_feature: NA.33.6.A06.3.454.light.1.nb
aaagagccaccctctcctgcagggccagtcagagt

SEQ ID NO: 297207 - DNA, 202 bp, Homo sapiens
  misc_feature: NA.33.6.A06.4.454.light.1.nb
gctggcagcaacttagcctggtaccaacaaaacctggccagactcccaggctcctcatctatgatgcatccaccagggccactggcatcccagacaggttcagtggcaggtgggtctgggacagacttcactctcaccatcgacagactggagcctagaagtattttgctagtctattactgtcagcagtatacgtggggag

SEQ ID NO: 297208 - DNA, 215 bp, Homo sapiens
  misc_feature: NA.33.6.A06.5.454.light.1.nb
aaagagccaccctctcctgcagggccaatcagagtgttagcagtaacttagtctggtaccaacatagacctgaccaggctcccaggctcctcatctacgatgcgtccaacagggccactggcatcccagccaggttcagtggcaggtggtctgggacagacttcactctcaccatcagcaacctagaacttgaatattttcattttatactgtac

SEQ ID NO: 297209 - DNA, 159 bp, Homo sapiens
  misc_feature: NA.33.6.A06.6.454.light.1.nb
attagcatcttcttggcctggtaccaaagaaacctggccaggctcccaggctcctcatccagaatgcattcaacagggccactggcatcccagacaggttcagtggcagtgggtctgggacagacgttcattctcaccatcagcagactggagcctgag

SEQ ID NO: 297210 - DNA, 192 bp, Homo sapiens
  misc_feature: NA.33.60.F05.1.454.light.1.nb
cttgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcag

SEQ ID NO: 297211 - DNA, 188 bp, Homo sapiens
  misc_feature: NA.33.60.F05.10.454.light.1.nb
tgtagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgcagt

SEQ ID NO: 297212 - DNA, 184 bp, Homo sapiens
  misc_feature: NA.33.60.F05.11.454.light.1.nb
tatgatgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgactgt

SEQ ID NO: 297213 - DNA, 88 bp, Homo sapiens
  misc_feature: NA.33.60.F05.12.454.light.1.nb
ctcttagtagggccagtcagagtgttagcagcaactacttagcctggccaggtgtctgctggtaccaggcctcccaggctcctcatcc

SEQ ID NO: 297214 - DNA, 19 bp, Homo sapiens
  misc_feature: NA.33.60.F05.2.454.light.1.nb
tgtattactgtcagcagta

SEQ ID NO: 297215 - DNA, 117 bp, Homo sapiens
  misc_feature: NA.33.60.F05.4.454.light.1.nb
gcgccttgccagcccgctcagtacacacacttcagatgcgggaagatgaagacagatggtgcagccacagttcgtttgatttccaccttggtcccttggccgaacgtctccccagta

SEQ ID NO: 297216 - DNA, 29 bp, Homo sapiens
  misc_feature: NA.33.60.F05.5.454.light.1.nb
tttattactgtcagcagcgtagcaactgg

SEQ ID NO: 297217 - DNA, 116 bp, Homo sapiens
  misc_feature: NA.33.60.F05.6.454.light.1.nb
tatgcgccttgccagcccgctcagtacacacacttcagatgcgggaagatgaagacagatggtgcagccacagttcgtttgatttccaccttggtcccttggccgaacgtccaaga

SEQ ID NO: 297218 - DNA, 110 bp, Homo sapiens
  misc_feature: NA.33.60.F05.7.454.light.1.nb
cgccttgccagcccgctcagtacacacactcagatggcgggaagatgaagacagatgtgcagccacagtcgtttaatctccagtcgtgtcccttggccgaaggtgttagg

SEQ ID NO: 297219 - DNA, 315 bp, Homo sapiens
  misc_feature: NA.33.60.F05.9.454.light.1.nb
tgcagggccagtcagagtgctggcagcaacttagcctggtaccaacaaaaacctggccagactcccaggctcctcatctatgatgcatccaccagggccactggcatcccagccaggttcagtggcagtgggtctgggacagacttcactctcaccatcagcagcctagagcctgaagattttgcagtttattactgtctgcagcgtagcaactggcctaacaccttcggccaagggacacgactggagattaaacgactgtggctgcaccatctgtcttatcttcccgcatctgaagtgtgtgtactgagcggg

SEQ ID NO: 297220 - DNA, 350 bp, Homo sapiens
  misc_feature: NA.33.63.F08.1.454.light.1.nb
tcagtcaggacacagcatggacatgagggtccctgctcagctcctgggactcctgctgctctggctcccagataccagatgtgacgtccagatgacccagtctccatcctccctgtctgcatcagtgggagacagagtcaccatcacttgccgggcgagtcgggacatttacaatttttggcctggtatcagcagagagaaggggaagttcctagactcctgatctatggtgcatccactttgcaatcaggggtcccatctcgcttcagtggcagtgatttgggacagatttcactctcaccgtcaccagcctgcagctaaagattttgcaacttattactgtcaaaagt

SEQ ID NO: 297221 - DNA, 123 bp, Homo sapiens
  misc_feature: NA.33.65.F10.1.454.light.1.nb
gtcaggacacagcatggacatgagggtccccgctcagctcctggggctcctgctactctggctccgaggtgccagatgtgacatccagatgacccagtctccaccctccctgtctgcatctgt

SEQ ID NO: 297222 - DNA, 235 bp, Homo sapiens
  misc_feature: NA.33.65.F10.2.454.light.1.nb
cggagacagagtcaccatctcttgccgggcaagtcagagcatcgtccgctaattaaattggtatcagcagaaaccagggcaagcccctaaactcctgatctatgctgcgtccagtctgcaaagtgggtccatcaaggttcagtggcagtggatctgggacagatttcactctcaccatcagcagtctgcaacctgaagtattttgctaacttacttctgtcaacacagttacaat

SEQ ID NO: 297223 - DNA, 154 bp, Homo sapiens
  misc_feature: NA.33.65.F10.3.454.light.1.nb
aggagacagagtcaccatcacttgccggcagtgagagcataagcaactatttgaattggtatcagcagaaaccagggaaagcccctaaggtcctgatctatgctgcgtccagtttgcagagcgggtccatcaaggttcagtggcagtggatcgt

SEQ ID NO: 297224 - DNA, 222 bp, Homo sapiens
  misc_feature: NA.33.67.G01.1.454.light.1.nb
aggaagcagagcctggagcatctccactatggcctgggctccactacttctcaccctcctcgctcactgcacaggttcttgggccaactttatgctgactcagccccactctgtgtcggagtcgtccggggaagacggtaaccatctttgcaccacaacagtggcaacattgccagctaattttggcagtggtaccagcagccgcccgggcacgttccccca

SEQ ID NO: 297225 - DNA, 325 bp, Homo sapiens
  misc_feature: NA.33.68.G02.1.454.light.1.nb
ctcagtcaggacacagcatggacatgagggtccccgctcagctcctgggctcctgctcctctggctccgaggtgccagatgtgacgtccagatgacccagtctccatcctccctgtcttcatctgtaggagacagagtcaccatcacttgccgggcaagtgagagcattagaacctatttgaattggtatcagcagagaccagggaaagcccccaaactcctgatctctgccgcatccgatttacacaatgggtcccatcgaggttcagtggcagtggatctgggacagatttcactctcaccataagcagtctggaacctgaag

SEQ ID NO: 297226 - DNA, 355 bp, Homo sapiens
  misc_feature: NA.33.7.A07.1.454.light.1.nb
taggacccagagggaaccatggaagccccagctcagcttctcttcctcctgctactctggctcccagataccaccggagaaattgtgttgacacagtctccagccaccctgtctttgtctccaggagaaagagccaccctctcatgcagggccagtcagagtattagcatcttcttggcctggtaccaacagaaacctggccaggctcccaggctcctcatccagaatgcattcaacagggccactggcatcccagccaggttcagtggcagtgggtctgggacagacttcactctcaccatcagcagcctagagcctgaggattctgctagtttatactgtcagcagcgtctca

SEQ ID NO: 297227 - DNA, 314 bp, Homo sapiens
  misc_feature: NA.33.7.A07.2.454.light.1.nb
taggacccagagggaaccatggaagccccagctcagcttctcttcctcctgctactctggctcccagataccaccggagaagttgtgttgacgcagtctccaggcaccctgtctttgtctcccaggggaaagagccaccctctcctgcagggccagtcagagtgttagcagtacttagtctggtaccaacagagacctgaccaggctcccaggctcctcatctacgatgcgtccaacagggccactggcatcccagccaggttcagtggcggtgggtctgggacagacttcactctcaccatcagcagcctaga

SEQ ID NO: 297228 - DNA, 74 bp, Homo sapiens
  misc_feature: NA.33.70.G04.1.454.light.1.nb
gctcagttaggacccagagggaaccatggaagccccagctcagcttctcttcctcctgctactctggctcccag

SEQ ID NO: 297229 - DNA, 25 bp, Homo sapiens
  misc_feature: NA.33.70.G04.2.454.light.1.nb
ataccaccggggaaattgtgttgac

SEQ ID NO: 297230 - DNA, 33 bp, Homo sapiens
  misc_feature: NA.33.70.G04.3.454.light.1.nb
acagtctccagccaccctgtctttgtctccagg

SEQ ID NO: 297231 - DNA, 67 bp, Homo sapiens
  misc_feature: NA.33.70.G04.4.454.light.1.nb
ggaaagagccaccctctcctgcagggccagtcagagtgttagcgggtacctagcctggtaccaacag

SEQ ID NO: 297232 - DNA, 285 bp, Homo sapiens
  misc_feature: NA.33.70.G04.5.454.light.1.nb
agacctggccaggctcccaggctcctcatctatgatgcatccaacagggccactggcatcccagccaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgaagtgtgtgtactgagcgggctgggcaaggcgcata

SEQ ID NO: 297233 - DNA, 177 bp, Homo sapiens
  misc_feature: NA.33.70.G04.6.454.light.1.nb
aaacctggccagactcccaggctcctcatctatgatgcatccaccagggccactggcatcccagccaggttcagtggcagtgggtctgggacagacttcactctcaccatcagcagcctagagcctgaagtattttgctagtttattactgtctgcagcgtagcaactggacctaac

SEQ ID NO: 297234 - DNA, 137 bp, Homo sapiens
  misc_feature: NA.33.70.G04.7.454.light.1.nb
gcagtctccaggcaccctgtctttgtctccaggggacagagccaccctctcctgcagggccagtcagactgttagcagcggtcttctagcctggtaccagcagaaacctggccaggcctcccaggcctcctcttcta

SEQ ID NO: 297235 - DNA, 149 bp, Homo sapiens
  misc_feature: NA.33.70.G04.8.454.light.1.nb
  modified_base (116)..(116): a, c, t, g, unknown or other
  misc_feature (116)..(116): n is a, c, g, or t
agggccagtcagagtgttagcagcaactacttagcctggtaccagcagaccacctggccaggctcccaggctcctcatccatggtgcatcccaccagggccatggcatcccagacnggttcagtggcaggtgggtctgggtcagacttc

SEQ ID NO: 297236 - DNA, 220 bp, Homo sapiens
  misc_feature: NA.33.71.G05.1.454.light.1.nb
ctcaggaggcagagctctgaatgtctcaccatggcctggatccctctcctgctccccctctcactctctgcacagtctctgtggcctcctatgagctgagacagccatcctcagtgtcagtgtctccgggacagacaaccaggatcacctgctcaggagatctattgacgaaagatcatgttcggtggttccagcagaagcccggccaggcccctgtgtt

SEQ ID NO: 297237 - DNA, 405 bp, Homo sapiens
  misc_feature: NA.33.78.H01.1.454.light.1.nb
gtccaggaggcagaactctgggtgtctcaccatggcctggatccctctacttctccccctcctcactctctgcacaggctctgcggcctcctacgagctgacacagccaccgtcggtttctgtgtcactgggacagacggccaggatcacctgctctggagatgcattgccaaagcaatacgcttattggtaccagcagaagccaggccaggcccctgtactgataatatacaaagagaatgagaggccctcagggatccctgagcgattctccggctacaatgcagggacaacagtcacgttgaccatcagtggagtccaggcagaagacgaggctgactatcactgccactcagcggacctcagtggtaggtgggtgttcggcggagggaccaagtgaccgtc

SEQ ID NO: 297238 - DNA, 326 bp, Homo sapiens
  misc_feature: NA.33.80.H03.1.454.light.1.nb
tcagtctcagtcaggacacagcatggacatgagggtccccgctcagctcctggggctcctgctactctggctccgaggtgccagatgtgacatccagatgacccagtctccatcctccctgtctgcatctgtaggagacagggtcaccatcacttgccgggcaagtcagagcataagcaactatttaaattggtatcaacagaaaccagggaaagcccctaaaggtcctgatctatgctgcgtccagtttgcagagcggggtccatcaaggttcagtggcagtggatcgtgggacagatttcactctcaccatcagcagtctgcaa

SEQ ID NO: 297239 - DNA, 68 bp, Homo sapiens
  misc_feature: NA.33.85.H08.1.454.light.1.nb
tgctcagttaggacccagagggaaccatggaagccccagctcagcttctcttcctcctgctactctgg

SEQ ID NO: 297240 - DNA, 59 bp, Homo sapiens
  misc_feature: NA.33.85.H08.2.454.light.1.nb
ctcccagataccaccggagaaattgtgttgacacagtctccaggccaccctgtctttgt

SEQ ID NO: 297241 - DNA, 344 bp, Homo sapiens
  misc_feature: NA.33.85.H08.3.454.light.1.nb
ctccaggggaaagagccaccctctcctgcagggccagtcagagtgttagcgggtacctagcctggtaccaacagagacctggccaggctcccaggctcctcttctatgatgcatccaacagggccactggcatcccagccaggttcagtggcggtgggtctgggacagacttcactctcaccatcagcagcctagagcctgaagattttgctagtttattactgtcagcagcgtagcaactggtcttggacgttcggccaagggaccaaggtggaaatcaaacgactgtggctgcaccatctgtcttcatcttcccgccatctgaagtgtgtgtactgagcggg

SEQ ID NO: 297242 - DNA, 165 bp, Homo sapiens
  misc_feature: NA.34.1.A01.3.454.light.1.nb
atgaggctgattattactgcctgtcctatgacaagagcctgactgtttatgtcttcggaactgggaccaaggtcaccgtccttggtcagcccaaggccaaccccactgtcactctcgttcccaccctcctcatcacgtgtactgagcgggctggcaaggcgcata

SEQ ID NO: 297243 - DNA, 91 bp, Homo sapiens
  misc_feature: NA.34.1.A01.4.454.light.1.nb
ggtggagatcaaacgaactgtggctgcaccatctgtcttcatcttcccgccatctgaatcacgtgtactgagcgggctggcaaggcgcata

SEQ ID NO: 297244 - DNA, 247 bp, Homo sapiens
  misc_feature: NA.34.10.A10.1.454.light.1.nb
cagcatcggaggtgcctccgccatggcatggatccctctcttcctcggcgtccttgcttactgcacaggatccgtggcctcctatgacctgactcagccaccctcagtgtccatatccccaggacagacagccagcatcacctgctcaggagataaattggggataaatatgtttgctggtatcagcagaagccaggccagtcccctgtgatggtcatctatcaagattataagcggccctctggga

SEQ ID NO: 297245 - DNA, 131 bp, Homo sapiens
  misc_feature: NA.34.14.B03.2.454.light.1.nb
ggtaaccatcagggagtggtcttcggcggagggaccaagctgaccgtcctaggtcagcccaaggctgccccctggtcactctgttcccgcctcctcatcacgtgtactgagcgggctggcaaggcgcatac

SEQ ID NO: 297246 - DNA, 119 bp, Homo sapiens
  misc_feature: NA.34.21.B10.2.454.light.1.nb
agaccgatgggccctggtcaaccgtctcctcagcctccaccaagggcccatcggtcttccccctggcaccctcctccaagagcacctctgggggcacagcggccctgggctgcctggtc

SEQ ID NO: 297247 - DNA, 164 bp, Homo sapiens
  misc_feature: NA.34.22.B11.1.454.light.1.nb
gttaggacccagagggaaccatggaaaccccagcgcagcttctcttcctcctgctactctggctcccagataccaccggagaaattgtgttgacgcagtctccagccaccctgtctttgtctccaggggacagagccaccctctcctgcggggccagtcagagt

SEQ ID NO: 297248 - DNA, 195 bp, Homo sapiens
  misc_feature: NA.34.22.B11.2.454.light.1.nb
attagtagctacttcttagcctggtatcagcagaaacctggcctggcgcccaggctcctcatctataatgcctatagcagggccactggcgtcccagacaggttcagtggcagtgggtctggggcagacttcactctcaccatcagcagactggagcctgaagtattttgctagtgtattattgtcagcagcatc

SEQ ID NO: 297249 - DNA, 144 bp, Homo sapiens
  misc_feature: NA.34.22.B11.3.454.light.1.nb
gttagcagctacttagcctggtaccagcagaaacctggccaggctcccaggctcctcatctatggtgcatccacagggccactggcactcccaggcaggttcagtggcagtggtctgggacagaattcactctcacatcagcag

SEQ ID NO: 297250 - DNA, 223 bp, Homo sapiens
  misc_feature: NA.34.23.C01.1.454.light.1.nb
aggaggcagcgctctcgggacgtctccaccatggcctgggctctgctattcctcaccctcctcactcagggcacagggtcctgggcccagtctgccctgactcaacctgcctccgtctctgggtctcctggacagtcgatcaccatctcctgcactggaaccagcagtgacgttgatgttatgtatgtctcctggtaccgacaatacacagacagacgccccc

SEQ ID NO: 297251 - DNA, 88 bp, Homo sapiens
  misc_feature: NA.34.25.C03.1.454.light.1.nb
agactgacggtcctgccacagcggccctgggctgcctggtcaaggactacttccatcacgtgtactgagcgggctggcaaggcgcata

SEQ ID NO: 297252 - DNA, 383 bp, Homo sapiens
  misc_feature: NA.34.28.C06.1.454.light.1.nb
ggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacaccccggcaaagctcccaaactcatgatttatgatgtcaataatcggccctcaggtgtttctcatcgcttctctgcctcatgtctggcaacacggcctccctgaccatctctgactccaggctgaggacgagggtgattattactgcgcctcatatacattcactgccactctcga

SEQ ID NO: 297253 - DNA, 99 bp, Homo sapiens
  misc_feature: NA.34.28.C06.2.454.light.1.nb
gtctccactcccgccttgacggggctgctatctgccccctcggtcactctgttcccgccctcctcatcacgtgtactgagcgggctggcaaggcgcata

SEQ ID NO: 297254 - DNA, 89 bp, Homo sapiens
  misc_feature: NA.34.31.C09.3.454.light.1.nb
tatgcgccttgccagcccgctcagtacacgtgattcagatggcgggaagatgaagacagatggtgcagccacagttcgtttgatctcca

SEQ ID NO: 297255 - DNA, 506 bp, Homo sapiens
  misc_feature: NA.34.33.C11.1.454.light.1.nb
gctgtgggttgagaagacaggactcaggacagtctccagcatggccagcttccctctcctcctcaccctcctcactcactgtgcagggtcgtgggcccagtctgtgctgactcagccaccctcagcgtctcgggacccccggcagagggtcaccatctcttgttctggaagcagctccaacatcggaagtaatactgtaaactggtttcagcaactcccaggaacggcccccaaactcctcatccatagtaataatcagcggccctcaggggtccctgaccgattctctggctccaagtctggcacctcagcctccctggccatcagtgggctccggtctgaggatgaggctgactattactgtgcagcatgggatgacagcctgaatggctcctatgtcttcggaactgggaccaaggtcaccgtctaggtcagcccaaggcccaacccactgtcactctcgttcccgccctcctcatcacgtgtactgagcgggctggcaaggc

SEQ ID NO: 297256 - DNA, 80 bp, Homo sapiens
  misc_feature: NA.34.33.C11.4.454.light.1.nb
tatgctaacaccaatccggccctcaggggtccctgaccgattctctggctccaagtctggcacctcacgccctcccgtgg

SEQ ID NO: 297257 - DNA, 486 bp, Homo sapiens
  misc_feature: NA.34.34.D01.1.454.light.1.nb
actgctcagttaggacccagacggaaccatggaagccccagcgcagcttctcttcctcctgctactctggctcccagacaccactggagaaatagtgatgacgcagtctccagccaccctgtctgtgtctccgaggggaaagcgccaccctctcctgcagggccagtcagagtgttggcagcaacttagcctggtaccagcagaaacctggccaggctcccagagtcctcatctatgctacatccaccagggccactgctattccagccaggttcagtggcagtgggtctgggacagagttcactctcaccatcagcagcctgcagtctgaagattctgcactttattactgtcagcagtctaataagtggccgtggacgttcggccaagggaccaaggtggaaatcaaacgaactgtggctgcaccatctgtcttcatcttccgcatctgaatcacgtgtactgagcgggctggcaaggcgcata

SEQ ID NO: 297258 - DNA, 386 bp, Homo sapiens
  misc_feature: NA.34.35.D02.1.454.light.1.nb
  modified_base (311)..(311): a, c, t, g, unknown or other
  misc_feature (311)..(311): n is a, c, g, or t
tgggcccagtctgtgctgactcagccaccctcagcgtctgggacccccgggcagagggtcaccatctcttgttctggaagcagctccaacatcggaagaaattatgtatattggcaccagcagttcccaggaacggcccccaaactcctcatctatagtaataatctgcggccctcaggggtccctgaccgattctctggctccaagtctggcacctcagcctccctggccatcagtgggctccggtccgaggatgaggctgattatactgtgcagcatgggatgacagcctgagtggttgggtgttcggnggagggaccaagctgaccgtctaggtcagcccaaggctgcccctggtcactctcgttccccacctcctcactcac

SEQ ID NO: 297259 - DNA, 350 bp, Homo sapiens
  misc_feature: NA.34.36.D03.1.454.light.1.nb
tcaggaggcagcgctctcgggacgtctccaccatggcctgggctctgctattcctcaccctcctcactcagggcacagggtcctgggcccaatctgccctgactcagcctgcctccgtgtctgggtctcctggacagtcgattaccatctcctgcactggaaccagcagtgacgttggtcattatgactatgtctcctggtaccaacattacccaggcaaacgcccccaaactcattatttatgatgtcgctagtcggccctcgaggggtttctaatcgcttctctggctcaagtctggcaacacggcctccctgaccatctctgggctccaggctgaggacgaggctga

SEQ ID NO: 297260 - DNA, 494 bp, Homo sapiens
  misc_feature: NA.34.38.D05.1.454.light.1.nb
agctgctcagttaggacccagagggaaccatggaaaccccagcgcagcttctcttcctcctgctactctggctcccagatgcccccggagaaattgtgttgacgcagtcgccagacaccctgtctctgtctccaggggaaagagccaccctctcctgcagggtcagtcagcgttctaacaccgacttcttcgcctggtaccagcagacgacctggccaggctcccaggctcctcatcttggtgcgtccaccagggccacgtggcactcccagacaggttcagtggcagtgggtctgggacagacttcactctcaccatcagcagacttgagcctgaagtattttgcagtatattactgtcagcaatatcgagacgcactgtgggcgttcggccaagggaccaaggtggaaatcaaacgaactgtggctgcaccatctgtcttcatcttcccgccatctgaatcacgtgtactgagcgggctggcaaggcgcata

SEQ ID NO: 297261 - DNA, 514 bp, Homo sapiens
  misc_feature: NA.34.39.D06.1.454.light.1.nb
gcttcagctgtgggcacaagaggcagcactcaggacaatctccagcatggcctggtctcctctcctcctcactctcctcgctcactgcacagggtcctgggcccagtctgtcctgacgcagccgccctcactgtctcggggcccccggacagagagtcaccatctcctgcacgtgggggcacctccaacatcggggctaggttttgttgtacactggtaccagcagattcccggaacagcccccaaactcctcatctttggtaacaacaatcggccctcaggggtccctgaccgattttctgcctccaagtctggcacctcagcctccctggacattattggactccagcctgaggatgaggctgattattactgtcagtcacatgacaacaccctgggcgggtcttcggcggagggaccaagctgaccgtcctcagtcagcccaaggctcgccccctcggtcactctgttcccacctcctcatcacgtgtactgagcgggctggcaaggcgca

SEQ ID NO: 297262 - DNA, 88 bp, Homo sapiens
  misc_feature: NA.34.45.E01.1.454.light.1.nb
tatgcgccttgccagcccgctcagtacacgtgattcagatggcgggaagatgaagacagatggtgcagccacagttcgtttgatttcc

SEQ ID NO: 297263 - DNA, 343 bp, Homo sapiens
  misc_feature: NA.34.5.A05.1.454.light.1.nb
agatgagaagggctggtgggatcagtcctggtggtagctcaggaagcagagcctggagcatctccactatggcctgggctccactacttctcaccctcctcgctcactgcacaggttcttgggccagttttatgctgactcagccccatctgtgtcggagtctccggggaagcggtgaccatctcctgccacccgcagcagtggcagcattaccaacaactatgtgcagtggtaccaacagcgcccgggcagttcccccaatactctgatctataaaggtgatcaaagaccctctggggtccctgatcggttctcgtggtccatcgacagctccgccaactct

SEQ ID NO: 297264 - DNA, 391 bp, Homo sapiens
  misc_feature: NA.34.57.F02.1.454.light.1.nb
tcccagtcaggacacagcatggacatgagggtccccgctcagctcctggggctcctgctgctctggctcccaggtgccagatgtgacatccagatgacccagtctccatccttcctgtctgcatccataggagacagagtcaccatcacttgccgggccgatcaggacattagcaattatttagcttggtatcaggtaaaaccaggggacgcccctaagctcctgatctcttccgcgtccattttacaaagtgggtcccacagattcagcggcgttggatctgggacagaattcactctcacaatcagcagtccgcggcctgaggactctgcggcttatactgtcaactgcttagtcgttaccccccacttcggccaagggcacgactgga

SEQ ID NO: 297265 - DNA, 333 bp, Homo sapiens
  misc_feature: NA.34.59.F04.1.454.light.1.nb
gggagtctgcaccatggcttggaccccactcctcttcctcaccctcctcctccactgcacagggtctctctcccagcctgtgctgactcaatcgccctctgtctctgcctccctgggagcctcggtcaagctcacctgcactctgagcagtgaacacatcacctacgccatcgcatggcatcagcaacagccacggaagggtcctcggttcttgatgaaacttgacagtgatggcagccacatcgaagggggacggatccctaatcgcttctcaggctccagctcgtggggctgagcgctccctcatcatctccagcctcagtctgaggatga

SEQ ID NO: 297266 - DNA, 121 bp, Homo sapiens
  misc_feature: NA.34.6.A06.1.454.light.1.nb
gcgcagcttctcttcctcctgctactctggctcccagatatcaccggagaaattgtgttgacacagtctccaggcaccctgtctttgtctccaggggaaagagccaccctctcctgcaggg

SEQ ID NO: 297267 - DNA, 328 bp, Homo sapiens
  misc_feature: NA.34.6.A06.2.454.light.1.nb
ccagtcagagtgttaatagcatctacttagcctggtaccagcagaaacctggccagcctcccagactcctcattaatggtgcatactacagggcccctggcatcccagacaggttcagtggcagtgggtctgggacagacttcactctcaccatcaccagactggagcctgaagattttgcagtgtattactgtcaacagttggtctcacacacgtggacgttcggccaagggaccaaggtggaaatcaaacgaactgtggctgcaccatctgtcttcatcttcccgcatctgaatcacgtgtactgagcgggctggcaaggcgcata

SEQ ID NO: 297268 - DNA, 108 bp, Homo sapiens
  misc_feature: NA.34.6.A06.3.454.light.1.nb
tcagtcagcgttctaacaccgtacttcttcgcctggtaccagcagagacctggccaggctcccaggcctcctcatcttggtgcgtccaccagggccactggcatccca

SEQ ID NO: 297269 - DNA, 175 bp, Homo sapiens
  misc_feature: NA.34.6.A06.4.454.light.1.nb
agacaggttcagtggcagtgggtctgggacagacttcactctcaccatcaccagactggagcctgaagattttgcagttgtattactgtcaacagttggtctcacacacgtggacgttcggaccaagggaccaaggtggaaatcaaacgaactgtggctgcaccatctgtctcat

SEQ ID NO: 297270 - DNA, 362 bp, Homo sapiens
  misc_feature: NA.34.63.F08.1.454.light.1.nb
taggacccagacggaaccatggaagccccagcgcagcttctcttcctcctgctactctggctcccagatactactggagaaatagtgatgacgcagtctccagccaccctgtctgtgtccccaggggaaagagccatcctctcctgcagggccagtcagagtattagcaccaacttagcctggtaccagcagaaacctggccagactcccaggctcctcatctatggtgcatccaccagggccactggtatcccaggcaggttcagtggcaggtgggtctgggacagagttcactctcaccatcagcagtctgcagtctgaagtattttgctagtttattactgtcagcactataataagtg

SEQ ID NO: 297271 - DNA, 309 bp, Homo sapiens
  misc_feature: NA.34.66.F11.1.454.light.1.nb
gaagataaatatgcttcctggtttcagcagaagccgggccagtcccctgtgcaggtcatctatcaagatactaagcggccctcagggatccctgagcgattctctggctccaactctgggaacacagccactctgaccatcagcgagacccaggctatggatgacgctgactattactgtcaggcgtgggacaatagcattgtggtattcggcggagggaccaagctgaccgtctaggtcagcccaaggctcgccccctggtcactctgttcccacctcctcatcacgtgtactgagcggctggcaggc

SEQ ID NO: 297272 - DNA, 310 bp, Homo sapiens
  misc_feature: NA.34.68.G02.1.454.light.1.nb
aggaagcagcatcggaggtgcctcagccatggcatggatccctctcttcctcggcgtccttgcttactgcacaggatccgtggcctcctatgagctgacccaaccaccctcagtgtccgtgtccccaggacagacagccagcgtcacctgctctggagaatcattggggataaatatgtttgtggtatcaacagaagccaggccagtcccctgtattggtcatctttgaaaatccaagcgggcctcgagggatccctgggcgattctctggctccaactctgggaacacgagccactctgaccatcagcg

SEQ ID NO: 297273 - DNA, 243 bp, Homo sapiens
  misc_feature: NA.34.71.G05.2.454.light.1.nb
tcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaagttgggggataaatatgcttgctggtatcagcagaagccaggccagtcccctgtgctggtcatctatcaagatagcaa

SEQ ID NO: 297274 - DNA, 228 bp, Homo sapiens
  misc_feature: NA.34.72.G06.2.454.light.1.nb
gtgttgacacagtctccagccaccctgtctttgtctccaggggaaagccaccctctcctgcagggccagtcagagtgttagcggctacttagcctggtaccagcagaaacctggccaggctcccaggctcctcatctatgatgcgtccaacagggccactggcatcccagccaggttcagtggcagtgggtctgggacagacttcactctcaccatcagcagcctaga

SEQ ID NO: 297275 - DNA, 25 bp, Homo sapiens
  misc_feature: NA.34.72.G06.3.454.light.1.nb
agtgatgacgcagtctccagccacc

SEQ ID NO: 297276 - DNA, 184 bp, Homo sapiens
  misc_feature: NA.34.72.G06.4.454.light.1.nb
gtgtctgtgtctccaggggaaagaatcaccctctcctgcagggccagccagagtgttagcagcaacttggcctggtaccagcagaacctggccaggctcccaggctcctcatctatggtgcatccaccagggccactggatcccagccaggttcagtggcagtgggtctgggacagattcactc

SEQ ID NO: 297277 - DNA, 123 bp, Homo sapiens
  misc_feature: NA.34.72.G06.5.454.light.1.nb
tgtctgtgtctccaggggaaagccaccctctcctgcagggccagtcagagtgttggcagcaacttgcctggtaccagcagaaacctggccaggctcccagagtcctcatctatgctacatcca

SEQ ID NO: 297278 - DNA, 214 bp, Homo sapiens
  misc_feature: NA.34.73.G07.1.454.light.1.nb
agagcctggagcatctccactatggcctgggctccactacttctcaccctcctcgctcactgcacaggttcttgggccaattttatgctgactcagccccactctgtgtcggagtctccggggaagacggtgaccatctcctgcacccgcagcagtggcagcatttccagcaactctgtgcagtggtaccaacagcgcccgggcacggtccccc

SEQ ID NO: 297279 - DNA, 293 bp, Homo sapiens
  misc_feature: NA.34.75.G09.1.454.light.1.nb
gttccagcagaaaccaggacagcctcctaagttgctcatttcctgggcatctacccgggaatccggggtccctgaccgattcagtggcagcgggtctgggacagatttcactctcaccatcaccagcctgcagcctgaagatgtggcagtttatactgtcagcaatattatagtcctccgctcactttcggcggagggaccaaggtggagatcaaacgaactgtggctgcaccatctgtcttcatcttcccgcatctgaatcacgtgtactgagcgggctggcaaggcgcata

SEQ ID NO: 297280 - DNA, 284 bp, Homo sapiens
  misc_feature: NA.34.78.H01.2.454.light.1.nb
  modified_base (278)..(278): a, c, t, g, unknown or other
  misc_feature (278)..(278): n is a, c, g, or t
gctcagaagcagagttctggggtgtctccaccatggcctggacccctctctggctcactctcctcactctttgcataggttctggagtttcttctgagctgactcaggaccccgttgtgtctgtggccttgggacacacagtcacgatcacatgccagggagacagcctcgaaaccttttatgcaagctggtaccaacagaagccaggacaggcccctgaacttgtcatgtttggtagaaaacgagcggccctcgagggatctctgaccgtattttcnggctcc

SEQ ID NO: 297281 - DNA, 226 bp, Homo sapiens
  misc_feature: NA.34.81.H04.1.454.light.1.nb
agagcctggagcatctccactatggcctgggctccactacttctcaccctcctcgctcactgcacaggttcttgggccagtttcacgctgactcagccccactctgtgtcggagtctccgggaaagacggtaagcatctcctgcacccgcagcagtggcagcattacgtccggctatgtgcagtggtaccagcagcgcccgggctcttcccccaccaccgtcatcc

SEQ ID NO: 297282 - DNA, 515 bp, Homo sapiens
  misc_feature: NA.34.86.H09.1.454.light.1.nb
cttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggttatgatgtacactggtacaagcagcttccaggaacagcccccaaactcctcatctatgctaacaccaatccggccctcgaggggtccctgaccgattctctggctccaagtctggcacctcagcctccctggccatcactgggctccgggctgaggatgaggctgattattactgtcagtcctttgacagcagcctgagtgcttatgtcttcggaactgggaccaaggtcaccgtctaggtcagcccaaggccaacccactgtcactctcgttcccgccctcctcactcacgtgtactgagcgggctggcaaggcgc

SEQ ID NO: 297283 - DNA, 285 bp, Homo sapiens
  misc_feature: NA.34.86.H09.2.454.light.1.nb
aggaggcagcgctctcgggacgtctccaccatggcctgggctctgctattcctcaccctcctcactcagggcacagggtcctgggcccagtctgccctgactcaggctgcctccgtgtctgggtctcctggacagtcgatcaccatctcctgcactgtaaccggcagtgacgttgatgattataagtctgtctcctggtaccaacaacacccggcaaagctcccaaactcatgatttatgatgtcaataatcggccctcaggtgtttctcatcgcttctctgcct

SEQ ID NO: 297284 - DNA, 65 bp, Homo sapiens
  misc_feature: NA.34.87.H10.4.454.light.1.nb
actcttaccatcaacagactggagcctggagattctgcagtctattacttgtcaacaatttggtc

SEQ ID NO: 297285 - DNA, 364 bp, Homo sapiens
  misc_feature: NA.34.88.H11.1.454.light.1.nb
actgctcagttaggacccagacggaaccatggaagccccagcgcagcttctcttcctcctgctactctggctcccagataccactggagaaatagtgatgacgcagtctccagccaccgtgtctgtgtctccaggggaaagagtcaccctctcctgcagggccagccagagtgttagcagcaacttggcctggtaccagcagaaacctggccaggctcccaggctcctcatctatggtgcatccacagggccactggtatcccagccaggttcagtggcagtggtctgggacagattcactctcaccatcagcagcctgcagtctgaagtattttgctagtttattactgtcagcagtataata

SEQ ID NO: 297286 - DNA, 304 bp, Homo sapiens
  misc_feature: NA.34.9.A09.1.454.light.1.nb
  modified_base (285)..(285): a, c, t, g, unknown or other
  misc_feature (285)..(285): n is a, c, g, or t
tgcagacccaggtcttcatttctctgttgctctggatctctggtgcctacggggacatcgtgatgacccagtctccagactccctggctgtgtctcgtgggcggagggggccaccatcaactgccagtccagtcagaatgttttatacacctccaacagtaagagccgcttacagaaaccaggacagcctcctaagttgctcatttactgggcatctacccggacagtccggggtcctgaccgattcagtggcagcgggtctgggacagatttcactctcccttnagcagcctgctggctgaag

SEQ ID NO: 297287 - DNA, 379 bp, Homo sapiens
  misc_feature: NA.35.1.A01.1.454.light.1.nb
tcaggaggcagcgctctggggacgtctccaccatggcctgggctctgctcctcctcacctcctcactcagggcacaggctcttgggcccagtctgccctgattcagcctccctccgtgtccgggtctcctggacagtcagtcaccatctcctgcactggaacctgcagtgatgttgggaattatgactatgtctcctggtaccaacttcacccagacacacgtccccaaaccatgatctacaatgtcaatattcggccctcaggagtccctaatcgtttctctggctccaagtctggctatgcggcctccgtgcccatctctggactccaggctgaggacgaggctgatttagtgagctgcttatatagaagcagtgcc

SEQ ID NO: 297288 - DNA, 376 bp, Homo sapiens
  misc_feature: NA.35.10.A10.1.454.light.1.nb
agtcaggacacagcatggacatgagggtccccgctcagctcctggggctcctgctgctctggctcccaggtgccaaatgtgacatccagctgacccagtctccctccaccctgtctgcatctgtaggagaaagcgtcaccatcacttgccggaccagtcagagtattagtaattggttggcctggtatcagcagaaaccagggaaagcccctaaactcctgatctttaaggcgtctactttagagagtgggtcccatcaaggttcagcggcagtggatctgggacagacttcactctcaccatcaccagcctgcagcctgatgattttgactaacctattactgccaacagtatggtgtattccgtctacgtttcg

SEQ ID NO: 297289 - DNA, 345 bp, Homo sapiens
  misc_feature: NA.35.11.A11.1.454.light.1.nb
cagagctctgggaatctcaccatggcctggacccctctcctgctccccctcctcactttctgcacagtctctgaggcctcctatgagctgacacagccaccctcggtgtcagtgtccccaggacagacggccaggattacctgctctggagatgcattgtcagaaagatttggtttttggaccagaagaagtcaggccaggcccctgtcttggtcatgttcgaggacgacaagcgaccctccgggatccctgagagattctctggctccagctcagggactatggtcaccttgatcatcactggggcccagggtggaggatgaggctgactattattgttgttac

SEQ ID NO: 297290 - DNA, 202 bp, Homo sapiens
  misc_feature: NA.35.11.A11.2.454.light.1.nb
gagctctgggaatctcaccatggcctggatccctctacttctccccctcctcactctctgcacaggctctgaggcctcctatgagctgacacagccaccctcggtgtcagtcgtccccaggacagacggccaggatcacctgctctggagatgcattgaccaaagcaatatacttattggtaccagcagaagtcaggccagg

SEQ ID NO: 297291 - DNA, 66 bp, Homo sapiens
  misc_feature: NA.35.11.A11.3.454.light.1.nb
gtcctgggccagggaaccctggtcatcgtctcctcagcctccaccaagggcccatcggtcttcccc

SEQ ID NO: 297292 - DNA, 356 bp, Homo sapiens
  misc_feature: NA.35.12.B01.1.454.light.1.nb
ggcaggcaggggcagcaagatggtgttgcagacccaggtcttcatttctctgttgctctggatctctggtgcctacggggacatcgtgatggcccagtctccagactctctggctgtgtctctgggcgagagggccaccatcagctgcaagtcctcccagagtcttttagacatgtccaacaataagaattacttgacttggtaccagcagaaaccaggacagcctccgaagctgctcattttcgggcatctgcccgggaattcgggtccctgaccgattcagtggcagcgggtctgggacagatttcactctcaccatcagcagcctgcaggctgaggatgtggcggtttattac

SEQ ID NO: 297293 - DNA, 226 bp, Homo sapiens
  misc_feature: NA.35.12.B01.2.454.light.1.nb
tcccagacaggttcagtggcagtgggtctgggacagacttcactctcaccatcagcagactggaagctgaagattttgcagtgtattactgtcagcagtatggtagttcaccgtacacttttggccaggggaccacggtggtgatcaaacgaactgtggctgcaccatctgtcttcatcttcccgcatctgaacgatctgtactgagcgggctggcaaggcgcata

SEQ ID NO: 297294 - DNA, 129 bp, Homo sapiens
  misc_feature: NA.35.12.B01.3.454.light.1.nb
ggagggcagagcctggagcatctccactatggcctgggctccactacttctcaccctcctcgctcactgcacaggttcttgggccagtttcacgctgactcagccccactctgtgtcggagtctccggg

SEQ ID NO: 297295 - DNA, 393 bp, Homo sapiens
  misc_feature: NA.35.15.B04.1.454.light.1.nb
ctagctgtgctgtgggtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaagcaatatacttattggtaccagcagaagtcaggccaggcccctgtattgatgatgtataaagacactgagaggccctcagggatccctgagcgattctctggctccagctcagggacaacagtcacgttgaccatcagtggagtccaggcagaagacgaggctgattattactgtcaatcagcagacaccaacaatagtcccgtg

SEQ ID NO: 297296 - DNA, 91 bp, Homo sapiens
  misc_feature: NA.35.15.B04.3.454.light.1.nb
tatgcgccttgccagcccgctcagtacagatcgtggaagtagtccttgaccaggcagcccagggccgctgtgcccagagcccaaatcttgt

SEQ ID NO: 297297 - DNA, 406 bp, Homo sapiens
  misc_feature: NA.35.27.C05.2.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgctgataactatgtctcctggtaccaacaccacccaggcaaagcccccaaactcatgatttatgatgtcagtaatcggccctcaggggtttctaatcgcttctctggctccaagtctggcaacacggcctccctgaccatctctgggctccaggctgacgacgaggctgattattactgcagctcatatacaaccagcagcactctcgtgttcggcggaggaccaag

SEQ ID NO: 297298 - DNA, 373 bp, Homo sapiens
  misc_feature: NA.35.28.C06.1.454.light.1.nb
tcaggaggcagcgctctcaggacgtcaccaccatggcctgggctctgctcctcctcaccctcctcactcagggcacagggtcctgggcccagtctgtcctgactcagcctccctccgcgtccgggtctcctggacagtcagtcaccatctcctgcactggaaccaacaatgacgttggtggttataattctgtctcatggtaccaacaatacccaggcagacgcccccaaactcatgatttttgaggtcagtaagcggccctcgaggggtccctgatcgcttctctggctccaagtctgacaacacggcctcccttaccgtctctgggctccagactgagatgaggctgattatactgcagctcatatgcagg

SEQ ID NO: 297299 - DNA, 321 bp, Homo sapiens
  misc_feature: NA.35.3.A03.2.454.light.1.nb
gtagagaagacaggactcaggacaatctccagcatggccagcttccctctcctcctcaccctcctcactcactgtgcagggtcctgggcccagtctgtggtgactcagccaccctcaacgtctgggacccccgggcagagggtcaccatctcttgttctggaagcagctccaacatcggaagtaatactgtaaactggtaccagcagctcccaggaacggcccccaaactcctcatctataataataatcagcggccctcaggagtccctgaccgattctctggctccaagtctggcgcctcagcctccctggccatcagt

SEQ ID NO: 297300 - DNA, 209 bp, Homo sapiens
  misc_feature: NA.35.34.D01.2.454.light.1.nb
tcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaggttggggaataaatatgcttgctggtatcagcagaagccaggcc

SEQ ID NO: 297301 - DNA, 110 bp, Homo sapiens
  misc_feature: NA.35.34.D01.4.454.light.1.nb
gtctccactcccgccttgacggggctgactattactgtcagtcttatgatggtagcaagtatgtggtcttcggcggaggaccaagctgaccgtcctaggtcagcccaaga

SEQ ID NO: 297302 - DNA, 104 bp, Homo sapiens
  misc_feature: NA.35.35.D02.1.454.light.1.nb
gagggaccaggctgaccgtcctaggtcagcccaaggctgccccctcggtcactctgttcccaccctcctcacgatctgtactgagcgggctggcaaggcgcata

SEQ ID NO: 297303 - DNA, 347 bp, Homo sapiens
  misc_feature: NA.35.36.D03.1.454.light.1.nb
  modified_base (257)..(257): a, c, t, g, unknown or other
  misc_feature (257)..(257): n is a, c, g, or t
cgagtctctggggaggaactgctcagttaggacccagacggaaccatggaagccccagcgcagcttctcttcctcctgctactctggctccgaggaaccactggagaaacagtgatgacgcagtctccagccatcctgtctgtgtctccgaggggaagacgccaccctctcctgcagggccagtcagactattagtaccaacttagcctggtatcagcagaaacctggtcaggctcccaggctcctcatctatggtncatccaccaggccactggtactcccagccaggttcagtggcaggtgggtctgggacagagttcactctcaccatcagcagcctgcagtct

SEQ ID NO: 297304 - DNA, 115 bp, Homo sapiens
  misc_feature: NA.35.4.A04.1.454.light.1.nb
agcagagcctggagcatctccactatggcctgggctccactacttctcaccctcctcgctcactgcacaggttcttgggcctagtttcacgctgactcacgccccactctgtgtc

SEQ ID NO: 297305 - DNA, 204 bp, Homo sapiens
  misc_feature: NA.35.4.A04.2.454.light.1.nb
  modified_base (16)..(16): a, c, t, g, unknown or other
  misc_feature (16)..(16): n is a, c, g, or t
ggggtctccggggganacggttaccctctcctgcacccgcaacagtggcagcatcgccaacaactatgtgcattggtaccagcagcgcccgggcacgttcccccatcattgtcatttttgaagtatagtcaaaggccctctgggtccctgttcgttctctggctccatcgacagttcctcaattctgcctccctcaccatctct

SEQ ID NO: 297306 - DNA, 114 bp, Homo sapiens
  misc_feature: NA.35.4.A04.3.454.light.1.nb
ggagtctccggggaagacggtgaccatctcctgcacccgcagcagtggcagcattaccagcaactatgtgcagtggtaccaacagcgcccgggcacgttcccccaccaccgtca

SEQ ID NO: 297307 - DNA, 332 bp, Homo sapiens
  misc_feature: NA.35.41.D08.1.454.light.1.nb
  modified_base (139)..(139): a, c, t, g, unknown or other
  misc_feature (139)..(139): n is a, c, g, or t
gctcagttaggacccagacggaaccatggaagccccagcgcagcttctcttcctcctgctactctggctcccagataccactggagaaatagtgatgacgcagtctccagccaccctgtctgtgtctccgagggggaanagccatcctctcctgcagggccagtcagagtattcggaacaacgtagtctggtaccagcagaaacctggccaggctcccaggctcctcatctatggtgcatccaccagggccactggtactcccagccaggttcagtggcaggtgggtctgggacagacttcactctcaccatcagcagcctgcagtctgaag

SEQ ID NO: 297308 - DNA, 190 bp, Homo sapiens
  misc_feature: NA.35.46.E02.1.454.light.1.nb
cagtcccaaccaggacacagcatggacatgagggtccctgctcagctcctggggctcctgctgctctggctctcaggtgccagatgtgacatccagatgacccagtctccatccttcctgtctgcatctgtgggagacagagtcaccatcacttgccaggctagtcaggacattaactcctatttaaatt

SEQ ID NO: 297309 - DNA, 222 bp, Homo sapiens
  misc_feature: NA.35.5.A05.1.454.light.1.nb
gtgagcgcagaaggcaggactcgggacaatcttcatcatgacctgctccctctcctcctcacccttctcattcactgcacagggtcctgggcccaatctgtcttgacgcagccgccctcagtgtctgcggccccaggacaacaggtcaccatctcttgctctggatccaagtttgggagtagttatgtttcttggtaccagcaactcccaggatcacgcccc

SEQ ID NO: 297310 - DNA, 141 bp, Homo sapiens
  misc_feature: NA.35.52.E08.2.454.light.1.nb
cctcctcagttcaccttctcacaatgaggctccctgctcagctcctggggctgctaatgctctgggtcccaggatccagtgacgtaggttgtgatgactcagtctccactctccctgcccgtcacccttggacagccgcct

SEQ ID NO: 297311 - DNA, 338 bp, Homo sapiens
  misc_feature: NA.35.53.E09.1.454.light.1.nb
tctcagtcaggacacagcatggacatgaggctccccgctcagctcctggggctcctgctactctggctccgaggtgccagatgtgacatccagatgacccagtctccggcctccctgtctggtgctgtcggagacagactgaccatcacttgccgggcaagtcagaccgttcgcgtctatttaaattggtatcagcagaaaccagggaacgcccctcagctgctgctctatactgtatctagtttccatcttgggtccatcaaggttcagtggcagtggttctgggacagatttcactctcactatcagcagtctgcaacctgagattttgcaaccta

SEQ ID NO: 297312 - DNA, 418 bp, Homo sapiens
  misc_feature: NA.35.59.F04.1.454.light.1.nb
cctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctactagttactaccccagctggtaccaacagaccccaggccaggctccgcgcacgctcatctacagcacaaacactcgctcttctgggtccctgatcgcttctctggctccatccttgggaacaagctgccctcaccatcgacggggcccaggcagatgatgaatctgattattactgtgtgctgtatagtgggtagtggcttcgttg

SEQ ID NO: 297313 - DNA, 423 bp, Homo sapiens
  misc_feature: NA.35.6.A06.1.454.light.1.nb
caggacacagcatggacatgagggtccccgctcagctcctggggctcctgctactctggctccgaggtgccagatgtgacatccagatgacccagtctccatcctccctgtctgcatctgtaggagacagcgtcaccatcacttgccgggcaagtcagagcattggcagttctttaaattggtatcaacggaaaccagggaaagcccctaaactcctgatctatgctgcatccattttgcaaagtcggggtcccgcaaggttcagtggcagtggatctgggacagaattcactctcaccatcagcagtctgcaacctgaagattttgcaacctactattgtcaacagagttacagtacgcccgcgatcagcttcggccaagggacacgactggagaattaaaagaactgtggactgacaccat

SEQ ID NO: 297314 - DNA, 371 bp, Homo sapiens
  misc_feature: NA.35.61.F06.1.454.light.1.nb
ctgagtcatgacaacatctccactctccctgcccgtcacccttggacagccggcctccatctcctgcaggtctagtcaaagcctcgtttccagtgatggaaacacctacttgatttggcttcagcagaggccaggccaatctccaaggcgcctaattaataaagtttctaaccgggactctggggtcccagacagattcagcgccagtgggtcaggcactgacttcacactgaacatcagtagggtggaggctgaggatattgggatttattactgcatgcagggtacacactggccgttcacttttggccaggggaccaagctggagatcaaacgaactgtggctgcaccatctgtcttcatcttcccgc

SEQ ID NO: 297315 - DNA, 344 bp, Homo sapiens
  misc_feature: NA.35.64.F09.1.454.light.1.nb
tcaggacacagcatggacatgagggtccccgctcagctcctggggctcctgctgctctggctcccaggtgccaaatgtgacatccagatgacccagtctccctccaccctgtctgcatctgtaggagacagagtcactattacttgtcgggccagtgagagtataagtagttggttggcctggtatcagcagaaaccagggaaagcccctagactcctgatgtatagggcgtctgttctacaaaagtcggggtacccacgaaggttcagcggcagtggatcgtgggacagaattcactctcacatcagtagcctgcagcctgatgactttgcaacctattactg

SEQ ID NO: 297316 - DNA, 284 bp, Homo sapiens
  misc_feature: NA.35.67.G01.2.454.light.1.nb
caagaggcagcgctctcgggacgtctccaccatggcctgggctctgctgctcctcactctcctcactcaggacacagggtcctgggcacagtctgccctgactcagcctgcctccgtgtctgggtctcctggacagtcgatcaccatctcctgcactggaaccagcagcgatggttgggggttatgaccttgtctcctggtatcaacagcacccaggcaaagcccccaaactcttaattataaggacactaagcgaccctcagggatttctaatcgcttctctg

SEQ ID NO: 297317 - DNA, 123 bp, Homo sapiens
  misc_feature: NA.35.67.G01.4.454.light.1.nb
ggtctccactcccgccttgacgaggctgactattactgtcagtcttatgatggtagcaagtatgtggtcttcggcggagggaccaagctgaccgtcctaggtcagcccaagactgccccctgg

SEQ ID NO: 297318 - DNA, 96 bp, Homo sapiens
  misc_feature: NA.35.67.G01.5.454.light.1.nb
gaacattctgtaggggccactgtcttctccacggtgctcccttcatgcgtgacctggcaactcggcctccctgacaatctctgggctccgggctga

SEQ ID NO: 297319 - DNA, 324 bp, Homo sapiens
  misc_feature: NA.35.69.G03.1.454.light.1.nb
tcagtctcagtcaggacacagcatggacatgaggctccccgctcagctcctggggctcctgctactctggctccgaggtgccagatgtgacatccagatgacccagtctccagcctccctgtctgcatctgtcggagacagagtcaccatcacttgccgggcaagtcagaccattcgcgtctatttaaatggtatcgccagaggccaggagaacgcccctaactactgatgtatactgtatctactttgcatattgcgtccatcaaggttcagtgcagtggatcgtgggacagatttcactctcacatcaacaatatacaacct

SEQ ID NO: 297320 - DNA, 474 bp, Homo sapiens
  misc_feature: NA.35.71.G05.2.454.light.1.nb
aggctccctgctcagctcctggggctgctaatgctctgggtctctggatccagtggggatattgtgatgactcagtctccactctccctgcccgtcaccccgtggacgacgcccggcctccatcctcctgcaggtctagtcagagcctcctgcatagtaatggatacaagtatttgaattggtacctgcagaagccagggcagtctccacagctcctgatctatttgggttctaagtcgggcctccgggtccctgacaggttcagtggcagtggatcaggcacagattttacactgaaaatcagcagagtggaggctgaggatgttggagtttatactgcatgcaaactctacaagctcctcggacgttcggccaagggaccaaggtggaaatcaaacgactgtggctgcaccatctgtcttcatcttcccgccatctgaacgatctgtactgagcgggctggcaaggcgcata

SEQ ID NO: 297321 - DNA, 220 bp, Homo sapiens
  misc_feature: NA.35.74.G08.1.454.light.1.nb
caggttcagtggcggtgggtctgggacagagttcactctcaccatcagcagcctgcagtctgaagattttgctgtttattactgtcagcagtattatgcctggccgtacacttttggccaggggaccgaactggagatcagacgaactgtggctgcaccatctgtcttcatcttcccgccatctgaacgatctgtactgagcgggctggcaaggcgcata

SEQ ID NO: 297322 - DNA, 57 bp, Homo sapiens
  misc_feature: NA.35.74.G08.2.454.light.1.nb
caggttcagtggcggtgggtctgggacagagttcactctcaccatcagcagccctgc

SEQ ID NO: 297323 - DNA, 375 bp, Homo sapiens
  misc_feature: NA.35.78.H01.1.454.light.1.nb
tcctggtggtagctcaggaagcagagcctggagcatctccactatggcctgggctccactacttctcaccctcctcgctcactgcacaggttcttgggccagttttatgctgactcagccccactctgtgtcggagtctccggggaagacggtgaccatctcctgcacccgcagcagtggcagcattaccagcaactatgtgcagtggtaccaacagcgcccgggcagttcccccaatactctgatctataaaggtgatcaaagaccctctggggtccctgatcggttctctgggtccatcgacagctcctccaactctgcctccctcactatctctggactcaagactgaggacgaggctgacttattactgtc

SEQ ID NO: 297324 - DNA, 179 bp, Homo sapiens
  misc_feature: NA.35.78.H01.2.454.light.1.nb
tggtctccactcccgccttgacgaggctgactattactgtcagtcttatgatggtagcaagtatgtggtcttcggcggagggaccaagctgaccgtcctaggtcagcccaagactgccccctggtcactctgttcccacctcctcacgatctgtactgagcgggctggcaaggcgcata

SEQ ID NO: 297325 - DNA, 346 bp, Homo sapiens
  misc_feature: NA.35.8.A08.1.454.light.1.nb
caggacacagcatggacatgagggtccccgctcagctcctggggctcctgctactctggctccgaggtgccagatgtgacattcagatgacccagtctccatcctccctgtctgcatctgtaggagacagagtcaccgtcacttgccgggcaagtcagagcattaacaagaatttaaattggtatcagcagaaacctgggaaagtccctaggctcctcatctatgctgcttccactttgcaagatggggtcccatcaaggttcagaggcactggatctgggacagaattcgctctcaccatcagcagtctgcaacctgaagtatttgactaacttactactgtaca

SEQ ID NO: 297326 - DNA, 212 bp, Homo sapiens
  misc_feature: NA.35.80.H03.1.454.light.1.nb
tcagtcccaaccaggacacagcatggacatgagggtccctgctcagctcctggggctcctgctgctctggctctcaggtgccagatgtgacatccagatgacccagtctccatcctccctgtctgcatctgttggagacagaatcaccatcacttgccaggcgagtcaggacattagcaactatttacattggtttcagcagaaaccaggga

SEQ ID NO: 297327 - DNA, 373 bp, Homo sapiens
  misc_feature: NA.35.81.H04.1.454.light.1.nb
aggcagagcctggagcatctccactatggcctgggctccactacttctcaccctcctcgctcactgcacaggttcttgggccagtttcacgctgactcagccccatctgtgtcggagtctaccggggaaagacggttaccatctcctgcacccgcagcagtggcagcattaccctccggctatgtgcagtggtaccagcagcgcccgggctccttcccccaccaccgtcatccgtgaagacactaaaaggccctctggggttcctgactcggttctctggctccatcgacacgtcctccaattctgcctccctaaccatctctggactgaagactgaggacgaggctgactactactgtcagttctttgaggc

SEQ ID NO: 297328 - DNA, 303 bp, Homo sapiens
  misc_feature: NA.35.82.H05.1.454.light.1.nb
tcctcagttcaccttctcacaatgaggctccctgctcagctcctggggctgctaatgctctgggtcccaggatccagtgacgaggttgtgatgactcagtctccactctccctgcccgtcacccttggacagccggcctccatctcctgttggtgtagtcaaagtctcgtacacagagatggaaacacctacttgaattggtttcagcagaggccaggccaatctccgaggcgccttaatttatttggtttactaaacgggactctggggtcccagacagattcagcggcagcggtcaggcac

SEQ ID NO: 297329 - DNA, 363 bp, Homo sapiens
  misc_feature: NA.35.83.H06.1.454.light.1.nb
agtcaggacacagcatggacatgagggtccccgctcagctcctggggctcctgctgctctggctcccaggtgccaagtgtgacatcgaaatgacccagtctccttccaccctgtctgcatctgtgggagacagcgtcatcatcacttgcctggccagtcagacgattagtgactggttggcctggtatcagcagaaaccaggacaaaaaccctaactcctagatttaaaggcctctagtttacaaagtgggtcccagcaaggttcgcggcagtggatctgggacagatttcactctcaccatcagcaacctgcagcctgaggactttgcaacttattactgccaacagtataatagttaccct

SEQ ID NO: 297330 - DNA, 306 bp, Homo sapiens
  misc_feature: NA.35.85.H08.2.454.light.1.nb
ttctggctcccagatatcactggagaaatagtgatgacgcagtctccaaccactctgtctgtgtctccaggggacagagccaccctctcctgcagggccagtcagagtgttagcagcaacttagcctggtaccagcagaaagttggccaggctcccaggctcctcatctttggtgtgtccactagggccgctggtgtcccagtcaggttcagtggcagtggctcgtgggacagagttcactctcaccatcagcagcctgcagtctgaagattttgctagtttattactgtcagcaatataatagct

SEQ ID NO: 297331 - DNA, 246 bp, Homo sapiens
  misc_feature: NA.35.85.H08.3.454.light.1.nb
ctctggctccgaggaaccactggagaaacagtgatgacgcagtctccagccatcctgtctgtgtctccaggggagagagccaccctctcctgcagggccagtcagactattagtaccaacttagcctggtatcagcagaaacctggtcaggctcccaggctcctcatctatggtgcatccaccagggccactggtatcccagccaggttcagtggcagtgggtctgggacagagttcactctcacc

SEQ ID NO: 297332 - DNA, 81 bp, Homo sapiens
  misc_feature: NA.35.85.H08.5.454.light.1.nb
tacgcccacggcccgttccacgggtccgactggctgtcacccctcggggagtctctcccacgaggggcatctaccaactgc

SEQ ID NO: 297333 - DNA, 346 bp, Homo sapiens
  misc_feature: NA.35.9.A09.1.454.light.1.nb
gcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaccacccaggcaaagcccccaaactcatgatttatgatgtcagtaatcggcctcaggggtttctaatcgcttctctggctcaagtctggcaacacggcctccctgaccgtctctgggctccaggctgacgacgaggctgattatta

SEQ ID NO: 297334 - DNA, 312 bp, Homo sapiens
  misc_feature: NA.36.11.A11.1.454.light.1.nb
cagcacctacttagcctggtaccagcagaaacctggccaggctcccaggctcctcatctatggtgcatccagtagggccactggcatcccagacaggttcagtggcagtgggtctgggacagacttcactctcaccatcagcagactggagcctgaagattttgccgtgtattactgtcaacactatggtacctctctgtacacttttggccaggggaccaagctggagatcaaacgaactgtggctgcaccatctgtcttcatcttcccgcatctgaagacagcgtactgagcgggctggcaaggcgcata

SEQ ID NO: 297335 - DNA, 271 bp, Homo sapiens
  misc_feature: NA.36.12.B01.2.454.light.1.nb
cctcatctatgaggacaccaaacgaccccccgggacccctgagagaatttctggctccagctcagggacaatggccaccttgactatcagtggggcccaggtggaagatgaagctgactactattgttactccacagacaccactggtgatcatagggtcttcggcggagggaccaagctgaccgtcctaggtcagcccaaggctgccccctcggtcactctgttcccgccctcctcagacagcgtactgagcgggctggcaaggcgcata

SEQ ID NO: 297336 - DNA, 367 bp, Homo sapiens
  misc_feature: NA.36.2.A02.1.454.light.1.nb
aggttaggacccagacggaaccatggaagccccagcgcagcttctcttcctcctgctactctggctcccagatatcactggagaaatagtgatgacgcagtctccagccaccctatctgtgtctccaggagaaagacgccaccctctcctgtagggccagtcagagtgttagcagcaacttagcctggtaccagcagaaacctggccaggttcccaggctcatcatctatggtgcatccacgagggccactggtactcccagccacctttagtggcagtgggtctgggacagagttcactctcaccatcagcagcctgcagtctgaagtatttgctagtttattactgtacaactagtacaatgact

SEQ ID NO: 297337 - DNA, 350 bp, Homo sapiens
  misc_feature: NA.36.21.B10.1.454.light.1.nb
ctgctcagttaggacccagacggaaccatggaagccccagcgcagcttctcttcctcctgctactctggctcccagatatcactggagaaatagtgatgacgcagtctccagccaccctatctgtgtctccaggagaaagagccaccctctcctgtagggccagtcagagtgttagcagcaacttagcctggtaccagcagaaacctggccaggttcccaggctcatcatctatggtgcatccaccagggccactggtatcccagccacctttagtggcagtgggtctgggacagagttcactctcaccatcagcagcctgcagtctgaagattttgctagtttattact

SEQ ID NO: 297338 - DNA, 379 bp, Homo sapiens
  misc_feature: NA.36.23.C01.2.454.light.1.nb
tcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgccccgaaactcttaatttatgaggtctttcgtcggccctcagggtttctagtcgcttctccggctccaagtctggcaacacggcctccctgaccatctctagactccaggctgaggacgaggctgactattattgcagctcatatactgaagtcaat

SEQ ID NO: 297339 - DNA, 316 bp, Homo sapiens
  misc_feature: NA.36.27.C05.2.454.light.1.nb
  modified_base (134)..(134): a, c, t, g, unknown or other
  misc_feature (134)..(134): n is a, c, g, or t
agttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgtgagcagcagctacttagcctggtaccagcagaaacctggccaggctccaggctcctcatctatggtgcatccaggagggccactggcatcccagacaggttcagtggcagtgggtctgggacagacttcactctcaccatcagcagact

SEQ ID NO: 297340 - DNA, 326 bp, Homo sapiens
  misc_feature: NA.36.32.C10.1.454.light.1.nb
ctgctcagttaggacccagacggaaccatggaagccccagcgcagcttctcttcctcctgctactctggctcccagatactactggagaaatagtgatgacgcagtctccagccaccctgtctgtgtctccaggggaaagagccaccctctcttgtagggccagtcacagtattagcactaatttaggctggttccagcagaaacctggccaggctcccaggctcctcatctacagtgcatccaccagggccactggtcgtcccagccaggttcagtggcagtgggtctgggacagagttcacgctcaccatcagcagcctgcggt

SEQ ID NO: 297341 - DNA, 132 bp, Homo sapiens
  misc_feature: NA.36.34.D01.1.454.light.1.nb
tggcactaccagctgctaccgaaactggttcgacccctggggccagggaaccctggtcaccgtctcctcagcctccaccaagggcccatcggtcttccccctggcaccctcctccaagagcacctctggggg

SEQ ID NO: 297342 - DNA, 72 bp, Homo sapiens
  misc_feature: NA.36.34.D01.2.454.light.1.nb
cacagcggccctgggctgcctggtcaaggactacttccagacagcgtactgagcgggctggcaaggcgcata

SEQ ID NO: 297343 - DNA, 462 bp, Homo sapiens
  misc_feature: NA.36.34.D01.4.454.light.1.nb
caacaggcaggcaggggcagcaagatggtgttgcagacccaggtcttcatttctctgttgctctggatctctggtgcctgcggggacatcgtgatgacccagtctccagactccctggctgtgtctctgggcgagagggccaccatcaactgcaggtccagccagagtgttttatacagctccaacaataagaactacttaacttggtaccagcagaaaccaggacagcctcctaaactgctcatttactgggcatctacccgggaatccggggtcctgaccgattcagtggcagcgggtctgggacagatttcactctcaccatcagcagcctgcaggctgaagatgtggcagtttatactgtcagcaatattatagtattccgctcactttcggcggagggccaaggtggagatcaaacgaactgtggctgcaccatctgtcttcatcttcccgccatct

SEQ ID NO: 297344 - DNA, 399 bp, Homo sapiens
  misc_feature: NA.36.35.D02.4.454.light.1.nb
acaggcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcgggctgaagatgtggcggtttattactgtcagcagtattatgttactcctcactag

SEQ ID NO: 297345 - DNA, 327 bp, Homo sapiens
  misc_feature: NA.36.36.D03.2.454.light.1.nb
ctcaggaggcagcgctctcaggacatctccaccatggcctgggctctgctgctcctcaccctcctcactcagggcacagggtcctgggcccagtctgccctgactcagcctgcgtccgtgtctgggtctcctggacagtcgatcaccatctcctgcactggaaccagcagtgactttggtggtaacaatcatgtctcctggtaccaacagtacccaggcaaacgcccccaaactcatctatttttgacgtcggtagtcggccctcaggtatttctaatcgcttctctggctccaagtctgccaacacggcctccctgacccatctct

SEQ ID NO: 297346 - DNA, 252 bp, Homo sapiens
  misc_feature: NA.36.37.D04.1.454.light.1.nb
ctcctcagttcaccttctcacaatgaggctccctgctcagctcctggggctgctaatgctctgggtctctggatccagaggggatattgtgatgactcagtctcccctctccctgcccgtcacccctggagagccggcctccatctcctgcaggtgtagtcagagcctcctgacaaagactgtggctgcaccatctgtcttcatcttcccgcatctgaagacagcgtactgagcgggctggcaaggcgcata

SEQ ID NO: 297347 - DNA, 230 bp, Homo sapiens
  misc_feature: NA.36.37.D04.2.454.light.1.nb
cagttaggacccagagggaaccatggaaaccccagcgcagcttctcttcctcctgctactctggctcccagataccaccggagaaattgtgttgacgcagtctccaggcaccctgtctttgtctccgaggggaaagccaccctctcctgcagggccagtcagagtgtagcagcagctactagcctggtaccagcagaaacctggccaggcctcccagacctcctcatcta

SEQ ID NO: 297348 - DNA, 336 bp, Homo sapiens
  misc_feature: NA.36.39.D06.1.454.light.1.nb
gtcagtcccaaccaggacacagcatggacatgagggtccctgctcagctcctgggctcctgctgctctggctctcaggtgccagatgtgacatccagatgacccagtctccatcctccctgtctgcatctgtaggcgacagagtcaccatcacttgccaggcgagtcaggacattgacaactatttaaattggtatcagcagaagccagggatggcccctaagctcctgatctacgatgcttccaatttgaaaacaggggtcccatcaaggttcagtgcaagtcgatctgggacagattttacttcagcatcaccagcctgcagtctgaagatatt

SEQ ID NO: 297349 - DNA, 371 bp, Homo sapiens
  misc_feature: NA.36.4.A04.1.454.light.1.nb
gttaggacccagagggaaccatggaagccccagctcagcttctcttcctcctgctactctggctcccagatactaccggagaaattgtgttgacacagtctccagccaccctgtctttgtctccaggggaaagagccaccctctcctgcagggccagtcagagtgttagcagctacttagcctggtaccaacagaaacctggccaggcctcccaggctcctcatctatgatacatcctacagggccactggcatcccagccaggttcagtggcagtgggtctgggacagacttcactctcaccatcagcagcctagaacctgaagtattttgctagtttattactgtcagcagcgagaggctttcggccct

SEQ ID NO: 297350 - DNA, 357 bp, Homo sapiens
  misc_feature: NA.36.43.D10.1.454.light.1.nb
taggacccagacggaaccatggaagccccagcgcagcttctcttcctcctgctactctggctcccagatatcactggagaaatagtgatgacgcagtctccaggcaccctgtctgtgtctccgaggggaaaggccaccctctcctgcagggccagtcagagtgttagtaccgacttggcctggtaccagcagaaacctggccaggctcccaggctcctcatctatggtgcatccaccagggccactggtatcccaggccggttcagtggcagtgggtctgggacagagttcacgctcaccatcagcagcctgcagagtgaagtatttcgctagtttattattgtcagcagtataata

SEQ ID NO: 297351 - DNA, 154 bp, Homo sapiens
  misc_feature: NA.36.43.D10.2.454.light.1.nb
  modified_base (56)..(56): a, c, t, g, unknown or other
  misc_feature (56)..(56): n is a, c, g, or t
ggggaagttgtgttgacacagtctccagccaccctgactttgtctccgggggaaanagccacctctcctgcagggccagtcggagtgtttcagtctacttaatgtgtaccaacagaaacctggccaggctccaggctcctcatctatgatacat

SEQ ID NO: 297352 - DNA, 77 bp, Homo sapiens
  misc_feature: NA.36.46.E02.1.454.light.1.nb
ctgctcagttaggacccagagggaaccatggaaaccccagcgcagcttctcttcctcctgctactctggctcccaga

SEQ ID NO: 297353 - DNA, 294 bp, Homo sapiens
  misc_feature: NA.36.46.E02.2.454.light.1.nb
caccaccggagaggttgtgttgacgcagtttccagacaccctgtctttgtctccaggagacagagccaccctctcctgcagggccagtcagagtatcagaagcgactacgtagcctggtaccggcagaaacctggccaggctcccagtctcctcatctatgatgcatccagtagggccgctggcatcccagacaggttcagtggcagtgggtctgggacagacttcacgctcaccatcagcagactggacctgaagattttgctagtctattactgtcagcagtatggtaatac

SEQ ID NO: 297354 - DNA, 90 bp, Homo sapiens
  misc_feature: NA.36.46.E02.3.454.light.1.nb
tatcactggagaaatagtgatgacgcagtctccagccaccctgtctgtgtctccaggggaaagagccaccctctcttgtagggccagtca

SEQ ID NO: 297355 - DNA, 273 bp, Homo sapiens
  misc_feature: NA.36.5.A05.2.454.light.1.nb
cagttcaccttctcacaatgaggctccctgctcagctcctggggctgctaatgctctgggtcccagtatcaagcagggatgttgtgatgactcagtctccagtctccctgcccgtcacccttggacagccggcctccatctcctgcaggtctagtcacagcctccttttcagtgatggaaacacctacttgaattggtttcaacagaggccaggccaatctccaaggcgcctaatttatcaggtttctaaccgggactcgtggggtcccggac

SEQ ID NO: 297356 - DNA, 357 bp, Homo sapiens
  misc_feature: NA.36.53.E09.1.454.light.1.nb
tgctcagttaggacccagagggaaccatggaagccccagctcagcttctcttcctcctgctactctggctcccagataccaccggggaagttgtgttgacacagtctccagccaccctgactttgtctccgggggaaagagccaccctctcctgcagggccagtcggagtgttttcagctacttaatgtggtaccaacagaaacctggccaggctcccaggctcctcatctatgatacatccaacagggccactggcgtcccagacaggttcagtggcagtgggtctgggacagacttcactctcaccatcagcagcctggacctgaagattctgctagtttatactgtcagcagcg

SEQ ID NO: 297357 - DNA, 264 bp, Homo sapiens
  misc_feature: NA.36.6.A06.1.454.light.1.nb
catccagatgacccagtctccatcctccctgtctgcatctgttggagacagagtcaccatcacttgccgggcaagtcagagcattagccactttttaaattggtatcagttcaaaccagggaaacgcccccaggctcctcatctacggtgcgtccagtttgcagagtgggtcccaacaaggttcagtggcagtggatcggggacagatttcattctcaccattaacagtctacaacctgaagtattttgctaacttactactgt

SEQ ID NO: 297358 - DNA, 306 bp, Homo sapiens
  misc_feature: NA.36.62.F07.2.454.light.1.nb
ctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtagttataactttgtctcctggtaccaacagcacccaggcagacgcccccaaatcatgatttatgaggtcagaaatcggcctcgaggggtttctgatcgcttctctggctccaagtctggcacacgg

SEQ ID NO: 297359 - DNA, 226 bp, Homo sapiens
  misc_feature: NA.36.63.F08.1.454.light.1.nb
cgcttctcaggctccagctctgggcctgagcggtgcctcaccatctccagcctccagcccgaagatgaggctgactatttctgtcagacgtgggcactggcattcatgccgtgttcggcggaggaacccgattgaccgtcctaggtcagcccaaggctgccccctcggtcactctcgttcccagccctcctcagacagcgtactgagcgggctggcaaggcgcata

SEQ ID NO: 297360 - DNA, 347 bp, Homo sapiens
  misc_feature: NA.36.66.F11.1.454.light.1.nb
taggacccagacggaaccatggaagccccagcgcagcttctcttcctcctgctactctggctcccagattccactggagaaatagtgatgacgcagtctccagccaccctgtctgtgtctccaggggaaagagccaccctctcctgcagggccaatcagagtattagcagcaacttagcctggtaccagcagaaacctggccaggctcccaggctcctcatctatggtgcatccaccagggccactgctatcccagccaggttcagtggcagtgggtctgggacagagttcactctcaccatcagcagcctgcagtctgaagattttgctagtttatactgtcagca

SEQ ID NO: 297361 - DNA, 253 bp, Homo sapiens
  misc_feature: NA.36.67.G01.2.454.light.1.nb
ctctctcagtcaggacacagcatggacatgagggtccctgctcagctcctgggactcctgctgctctggctcccagataccagatgtgacatccagatgacccagtttccatcctccctgtctgcatctgtaggagacagagtcaccatcacttggccgggcgagtcagggcattaacaatcatttagcctggtatcagcagaaaccagggaaagctcctaagctcctgatatatgctgtattcactgtgcaa

SEQ ID NO: 297362 - DNA, 112 bp, Homo sapiens
  misc_feature: NA.36.67.G01.3.454.light.1.nb
aagaggaagactgacggtccccaggagttcaggtgctgggcacagcggccctgggctgcctggtcaaggactacttccagacagcgtactgagcgggctggcaaggcgcata

SEQ ID NO: 297363 - DNA, 330 bp, Homo sapiens
  misc_feature: NA.36.7.A07.2.454.light.1.nb
cagtcaggacacagcatggacatgagggtccctgctcagctcctgggactcctgctgctctggctcccagataccagatgtgacatccagatgacccagtctccatcctccctgtctgcatctgtaggagacagagtcaccatctcttgtcgggcagtgaggacattgtcaattatttagcctggtatcagcagagaccagggagagttcctaagctcctgatctatgctgcctccatttgcagtcaggggtcccatctcggttcagtggcagtggatctgggacagatttcactctcaccatcagcagcctgcagcctgaagatgttgc

SEQ ID NO: 297364 - DNA, 243 bp, Homo sapiens
  misc_feature: NA.36.71.G05.1.454.light.1.nb
gctcagttaggacccagacggaaccatggaagccccagcgcagcttctcttcctcctgctactctggctcccagataccactggagaaatagtgatgacgcagtctccagccaccctgtctgtgtctccaggggaaaagccaccctctcctgcagggccagtcagagtgttaacaataacttagcctggtaccaacagacacctggccaggctcccaggctcctcatctatggtgcatccacc

SEQ ID NO: 297365 - DNA, 368 bp, Homo sapiens
  misc_feature: NA.36.79.H02.2.454.light.1.nb
gacccagtcaggacacagcatggacatgagggtccccgctcagctcctggggctcctgctgctctggctcccaggtgccaaaggtgacatccagatgacccagtctccttccaccctgtctgcatctgtaggagacagagtcaccatcacttgccgggccagtcagagtattagtcattggttggcctggtatcaacagaaaccagggaaagcccctaaggtcttgatctataaggcgtctactttggaaagtggggtcccatcacggttcagcggcagtggatctgggacagaattcactctcaccattagcagcctgcagcctgatgattttgcaacatattactgccagcaatataatacgtatt

SEQ ID NO: 297366 - DNA, 339 bp, Homo sapiens
  misc_feature: NA.36.8.A08.1.454.light.1.nb
ctcagtcaggacacagcatggacatgagggtccctgctcagctcctgggactcctgctgctctggctcccagataccagatgtgacatccagatgacccagtttccatcctccctgtctgcatctgtaggagacagagtcaccatctcttgccgggcaagtcaggcattaacaatcatttagcctggtatcagcagaaaccagggaaagttcctaagctcctgatatatgctgtattcactgtgcaatcgggggtcccatctcggttcagtggcagtggatatgggacagatttcactctcaccatcagcagcctgcagcctgaagatgttgcaactta

SEQ ID NO: 297367 - DNA, 351 bp, Homo sapiens
  misc_feature: NA.36.85.H08.2.454.light.1.nb
agttaggacccagagggaaccatggaagccccagctcagcttctcttcctcctgctactctggctcccagataccaccggagaaattgtgttgacacagtctccagccaccctatctttgtctccaggggaagagccaccctctcctgcagggccagccagagtgttagtcaaaacttgcctggtatcaaacaaaaagctggccaggctcccaggctcctcatctatgatgcttccaaaagggcccctggcatcccaaccaggttcagtgccagtgggtctgggacagacttcactctcaccatcagcagcctagacgcctgaagtattttgctactttattactgtcaac

SEQ ID NO: 297368 - DNA, 368 bp, Homo sapiens
  misc_feature: NA.36.86.H09.2.454.light.1.nb
tcaggaggcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatcgacccccaaaatcatgatttatgaggtcactcatcggccctcaggggtttctaatcgcttctctgcatccaagtctggcaacacggcctccctgaccatctctgggctccaggctgaggacgaggctaattatttctgctagttca

SEQ ID NO: 297369 - DNA, 358 bp, Homo sapiens
  misc_feature: NA.36.9.A09.2.454.light.1.nb
ctcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaacgtggggtcccattaagattcagcggcagtggatctggcacagatttcactctcaccatcagcagcctgcagcctagaagtattttgctaacttattactgtactacaagatt

SEQ ID NO: 297370 - DNA, 304 bp, Homo sapiens
  misc_feature: NA.37.1.A01.2.454.light.1.nb
atagtaacttagcctggtaccagcagaaacctgcccaggctcccaggctcctcatgtatggtgcatccaccagggccactggtatcccagccaggttcagtggcaggtgggactgggacagagttcagtctaaccatcagcagcctgcagtctgaagattttggagtttatttctgtcagcagtatagttcctggcctcggacgttcggcccagggaccaaggtggaaatcaaacgactgtggctgcaccatctgtcttcatcttcccgcatctgaatctacactactgagcgggctggcaagg

SEQ ID NO: 297371 - DNA, 425 bp, Homo sapiens
  misc_feature: NA.37.11.A11.1.454.light.1.nb
tgcagacccaggtcttcatttctctgttgctctggatctctggtgcctacggggacaccgtgatgacccagtctccagactccctggctgtgtctctgggcgagagggcctccatcaactgcaagtccagccagactgttttatacagctccaacaataagaactacttagcttggtatcagcagaaaccagggcagcctcctaaactgctcatttactgggcatctacccgggagtccggggtccctgaccgattcagtggcagcgggtctgggacagatttcactctcaccatcaacagcctgcaggctgaggatgtggcgtatttatactgtcagcagtattataatactcctcgacgttcggccaagggaccaaggtgaaatcaaacgactgtgctgcaccatctgtcttcatccttcccg

SEQ ID NO: 297372 - DNA, 454 bp, Homo sapiens
  misc_feature: NA.37.14.B03.1.454.light.1.nb
gaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaacccgcagtgacgttggtggttataactatgtctcttggtaccaacatcacccaggcaaagtccccaaactcatgatttatgaggtcactaaacggccctcaggggtctctaatcgcttctctggctccaagtctggcaacacggcctccctgaccatctctgggctccaggctgacgacgaggctcactattattgcagctcatatacaagcagcatcacttgggtgttcggcgggagggaccgacctgaccgtcttaggtcagcccaaggctcgcccctcggtcactctcgtccc

SEQ ID NO: 297373 - DNA, 224 bp, Homo sapiens
  misc_feature: NA.37.21.B10.1.454.light.1.nb
  modified_base (11)..(11): a, c, t, g, unknown or other
  misc_feature (11)..(11): n is a, c, g, or t
ctgacaggttnagtggcagtggatcaggcacagatttcacactgaagatcagcagagtggaggctgaggatgttggggtttattactgcatgcaaggtctacaaactcctcggatcaccttcggccaagggacacgactggagattaaacgaactgtggctgcaccatctgtcttcatcttcccgcatctgaatctacactactgagcgggctggcaaggcgca

SEQ ID NO: 297374 - DNA, 359 bp, Homo sapiens
  misc_feature: NA.37.22.B11.2.454.light.1.nb
ccagacggaaccatggaagccccagcgcagcttctcttcctcctgctactctggctcccagatatcactggagaaatagtgatgacgcagtctccagccaccctctctgtgtctccaggagaaagagcccaccctctcctgtagggccagtcagagtgttagctacaacttagcctggtaccagcagaaacctggccaggttcccaggctcatcatctatggtgcatccaccagggccactggtatcccagccacctttagtggcagtgggtctgggacagagttcactctcaccatcagcagcctgcagtctgaagtatttgctagtttattactgtacaacagtacaatgactggcc

SEQ ID NO: 297375 - DNA, 317 bp, Homo sapiens
  misc_feature: NA.37.23.C01.2.454.light.1.nb
gtctctctcagtcaggacacagcatggacatgagggtccctgctcagctcctgggactcctgctgctctggctcccaggtagcgggtgtgacattctgatgacccagtctccatcctcctgtctgcatctgttagagacagagtcaccatcgcttgccgggcagtcggacatccgcaattttgtagcctggtatcagcagagaccagggcaagttcctcaactcttgatctatgatgcatctcatttggagccaggggtctcatctcggttcagtggcagcggatcgtgggaccgctttcactctcaccatcaccag

SEQ ID NO: 297376 - DNA, 30 bp, Homo sapiens
  misc_feature: NA.37.26.C04.10.454.light.1.nb
ctcagctattaagtgggaatggtgatacca

SEQ ID NO: 297377 - DNA, 154 bp, Homo sapiens
  misc_feature: NA.37.26.C04.11.454.light.1.nb
aacaccctgtctctgcaaatgaacaacctgagagccgaggacacggccctatattactgtacgaaaatggcctacggatatgactactattgggactggtacttcgatctcgtggggccgtggcaccctggtcactgtctcctcagcctccacc

SEQ ID NO: 297378 - DNA, 165 bp, Homo sapiens
  misc_feature: NA.37.26.C04.13.454.light.1.nb
aacacactgtctctgcaaatgaacagcctgagagtcgaggacacggccttatattactgtgtgaagggacctctagccccttatagcagcggctggtcctggtactttgacgactggggccagggaaccctggtcaccgtctcctcagcctccaccaagggccca

SEQ ID NO: 297379 - DNA, 323 bp, Homo sapiens
  misc_feature: NA.37.30.C08.1.454.light.1.nb
ctcctgcagggccagtcagagtgttagcagcagctacttagcctggtaccagcagaaacctggccaggctcccaggctcctcatctatggttcatcctcaagggccactggcatccccgacaggttcagtggtcgtgggtctgggacagacttcactctcaccatcagcagactagagccggaagactctgcagtgtatttctgtcagcagtatggcagctcacctccgacgttcggccaagggaccaaggtggaaatcaaacgaactgtggctgcaccatctgtcttcatcttcccgcatctgaatctacactactgagcgg

SEQ ID NO: 297380 - DNA, 358 bp, Homo sapiens
  misc_feature: NA.37.33.C11.2.454.light.1.nb
tcagtcaggacacagcatggacatgagggtccccgctcagctcctggggctcctgctgctctggctcccaggagccaaatgtgacatccagatgacccagtctccttccaccctgtctgcatctgtaggagacagagtcaccatcacttgccgggccagtcggactattagtacctggttggcctggtatcaacagaaaccagggaaagcccctaaggtcctgatctatgatgcctccactttggaaagcgggtcccatcaaggttcagcggcagtgtatctgggacagaattcactctcaccatcagtagcctgcagcctgatgattttgctaacttattactgtcagcactataat

SEQ ID NO: 297381 - DNA, 384 bp, Homo sapiens
  misc_feature: NA.37.34.D01.2.454.light.1.nb
gtcagacccactcaggacacagcatggacatgagggtccccgctcagctcctggggctcctgctgctctggctcccaggtgccagatgtgccatccaaatgacccagtctccatcctccctgtctgcatctgtaggagacagagtcatcatcacttgccgggcaagtcagggcattagaaatgatttaggctggtatcagcagaaaccagggaaagcccctaagctcctcatctatggtgcatccagtttacaaactgggtcccattaagattcagcggcagtggatctggcacagatttcactctcaccatcagcagcctgcagcctgaagtattttgctaacttattactgtctacaagattacaattaccctcgtacgttc

SEQ ID NO: 297382 - DNA, 236 bp, Homo sapiens
  misc_feature: NA.37.36.D03.2.454.light.1.nb
tattgaaacttataaccttgtctcttggtaccaacagcacccaggcaaagcccccaaactcatgatttgtgaggacagtaagcggccctcaggggtttctaatcgcttctctggctccaagtctggcaacacggcctccctgacatctctgggctccaggctgaggacgaggctgattattactgctgctcatatgcaggtatcactcttatgtcttcggaactgggaccaggtca

SEQ ID NO: 297383 - DNA, 204 bp, Homo sapiens
  misc_feature: NA.37.36.D03.3.454.light.1.nb
cgttggtggttataactatgtctcttggtaccaacatcacccaggcaaagtccccaaactcatgatttatgaggtcactaaacggccctcagggtctctaatcgcttctctggctccaagtctggcaacacggcctccctgaccatctctgggctccaggctgacgacgaggctcactattattgcagctcatatacaagcagc

SEQ ID NO: 297384 - DNA, 219 bp, Homo sapiens
  misc_feature: NA.37.36.D03.4.454.light.1.nb
cgttggtggttataactatgtctcttggtaccaacatcacccaggcaaagtccccaaactcataatttatgaggtcactaaacggccctcagggtttctaatcgcttctctggctcaagtctggcaacacggcctcctgaccatctctgggctccaggctgacgacgaggctcactattattgcagctcatatacaagcagcagtcacgttgggtgttc

SEQ ID NO: 297385 - DNA, 329 bp, Homo sapiens
  misc_feature: NA.37.36.D03.5.454.light.1.nb
tcccaaccaggacacagcatggacatgagggtccctgctcagctcctggggctcctgctgctctggctctcaggtgccagatgtgacatccagatgacccagtctccatcccccctgtctgcatctgtaggagacagagtcaccatcacttgccaggcgagtcaggacattggcaactatttaaattggtatcagcagaaaccagggaaacgccccaagctcctggtctacgctgcatccaatttggaaacaggagtcccatcaaggttcagtggaagtggatctgggacagtattttactttcaccttcagcagcctgcagtctgaag

SEQ ID NO: 297386 - DNA, 337 bp, Homo sapiens
  misc_feature: NA.37.37.D04.2.454.light.1.nb
tgctcagttaggacccagacggaaccatggaagccccagcgcagcttctcttcctcctgctactctggctcccagataccactggagaaatagtgatgacgcagtctccagccaccctgtctgtgtctccaggggaaaagccaccctctcctgcagggccagtcagagtgttagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctagaagtatttt

SEQ ID NO: 297387 - DNA, 486 bp, Homo sapiens
  misc_feature: NA.37.38.D05.1.454.light.1.nb
caggaagcagcatcggaggtgcctcagccatggcatggatccctctcttcctcggcgtccttgcttactgcacaggatccgtggcctcctatgaactgactcagccaccctcagtgtccgtgtccccgggacagacagccaccatcacctgctctggagatgaattgggaaataaatatgcttgctggtatcagcagaagccgggccagtcccctgtgctggtcatctatcaagataagaagcgggcctcagggatccctgagcgattctctggctccaactccgggaacacagccaccctgaccatcagcgggacccaggctatggatgaggctgactattactgtcagacgtggacagcaatactgcacaacaggtcttcggaactgggaccagggtcatcgtcctaggtcagcccaaggcccaaccccactgtcactctcgttcccaccctcctcatctacactactgagcgggctggcaagg

SEQ ID NO: 297388 - DNA, 246 bp, Homo sapiens
  misc_feature: NA.37.38.D05.2.454.light.1.nb
cagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgccctggaaccagcagtgacgttggtcagcccaaggctcgccccctggtcactctcgttcccacctcctcatctacactactgagcgggctggcaaggcgc

SEQ ID NO: 297389 - DNA, 111 bp, Homo sapiens
  misc_feature: NA.37.38.D05.3.454.light.1.nb
tagggtcctaccactcccgccttgacgggctgccatctgccttccaaccccactgtcactctgttcccgccctcctcatctacactactgagcgggctggcaaggcgcata

SEQ ID NO: 297390 - DNA, 103 bp, Homo sapiens
  misc_feature: NA.37.43.D10.1.454.light.1.nb
tatgcgccttgccagcccgctcagtagtgtagatggaagtagtccttgaccaggcagcccagggccgctgtgctctcggaggtgctcctggagcagggcgcca

SEQ ID NO: 297391 - DNA, 330 bp, Homo sapiens
  misc_feature: NA.37.45.E01.1.454.light.1.nb
tgctcagttaggacccagagggaaccatggaagccccagctcagcttctcttcctcctgctactctggctcccagataccaccgcagaaattgtgttgacacagtctccagccaccctgtctttgtctccaggggagagagccaccctctcctgcagggccagtcagaatgttagcagtcacttagcctggtaccaacagagacctggccaggcccccaggctcctcatctatgctgcttccctcagggccactggcatcccagccaggttcagtggcagtgggtctgagacagacttcactctcaccatcagcagtctagagcctgaag

SEQ ID NO: 297392 - DNA, 316 bp, Homo sapiens
  misc_feature: NA.37.49.E05.1.454.light.1.nb
ctgctcagttaagacccagacggaaccatggaagccccagcgcagcttctcttcctcctgctactctggctcccagatatcactggaggaatagtgatgacgcagtcgccagccaccctgtctgtgtctccaggggaaagagccaccctctcctgcagggcctctcagagtgttagcggccacttagcctggtaccagcagaaacctggccaggctcccaggctcctcatctatgaggcatccatcaagggccactggtatcccagccaggttcagtggtcgtgggtctgggacagattcactctcaccatcgcag

SEQ ID NO: 297393 - DNA, 341 bp, Homo sapiens
  misc_feature: NA.37.5.A05.1.454.light.1.nb
  modified_base (337)..(337): a, c, t, g, unknown or other
  misc_feature (337)..(337): n is a, c, g, or t
ggcaggggcagcaagatggtgttgcagacccaggccttcatctctctgttgctctggatcactggtgcctacggggacatcgtgatgacccagtctccagactccctggctgtgtctctgggcgagagggccaccatcaactgcaagtccagccagactcttttgtcagcgtcgacaataagaactactttgcttggtaccaacagaaagcaggacagcctcctaagttgctcatttactcggcatccacccgggcatccggggtccctgaccgattcagcggcagcgggtctgggacagatttcactctcaccatcagcagcctgcaggctgaagntgtg

SEQ ID NO: 297394 - DNA, 165 bp, Homo sapiens
  misc_feature: NA.37.74.G08.1.454.light.1.nb
gcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtga

SEQ ID NO: 297395 - DNA, 46 bp, Homo sapiens
  misc_feature: NA.37.74.G08.2.454.light.1.nb
cgttggtgttaataatatgtctcttggtaccaacatcaccaacatc

SEQ ID NO: 297396 - DNA, 163 bp, Homo sapiens
  misc_feature: NA.37.74.G08.3.454.light.1.nb
acccaggcaaagtccccaaactcataatttatgaggtcactaaacggccctcaggagtttcaatcgcttctctggctccaagtctggcaacacggcctccctgaccatctctgggctccaacctgaggacgaggctcactattattgcagctcatatacaagc

SEQ ID NO: 297397 - DNA, 232 bp, Homo sapiens
  misc_feature: NA.37.74.G08.4.454.light.1.nb
tattgaaacttataaccttgtctcttggtaccaacagcacccaggcaaagccccaaactcatgatttgtgaggacagtaacggccctagggtttctaatcgcttctctggctccaagtctggcaacacggcctcctgacaatctctgggctccaggctgaggacgaggctgattattactgctgctcatatgcaggtatcactcttatgtcttcggaactgggaccaaggtc

SEQ ID NO: 297398 - DNA, 146 bp, Homo sapiens
  misc_feature: NA.37.74.G08.5.454.light.1.nb
caggcaaagtccccaaactcatgatttatgaggtcactaaacggccctcaggggtctctaatcgcttctctggctccaagtctggcaacacggcctccctgaccatctctgggctccaggctgacgacgaggctcactattattgc

SEQ ID NO: 297399 - DNA, 114 bp, Homo sapiens
  misc_feature: NA.37.77.G11.7.454.light.1.nb
gcgagagatcagacggagtatagcagcagctctgactactggggccacggaaccctggtcaccgtctcctcagcctccaccaagggcccatccggtccttccccctggccaccc

SEQ ID NO: 297400 - DNA, 53 bp, Homo sapiens
  misc_feature: NA.37.78.H01.1.454.light.1.nb
tctgggtctcctggacagtcgatcaccatcccctgcactggaaccagtagtga

SEQ ID NO: 297401 - DNA, 102 bp, Homo sapiens
  misc_feature: NA.37.78.H01.2.454.light.1.nb
cgttgatgattatgactatgtctcctggtttcaacaacacccagacaaagcccccaaactcatcatttttgaggtcactaatcggccctcaggaatttcttc

SEQ ID NO: 297402 - DNA, 226 bp, Homo sapiens
  misc_feature: NA.37.78.H01.3.454.light.1.nb
tcgcttctctggctccaagtctggcaacacggcctccctgaccatctctgggctccaggctgaggacgaggctgattattactgcagctcatatagaggcgaccacacttatgtcttcggaagtgggaccaaggtcgtcgtcctaagtcagcccaaggcccaaccccactgtcactctcgttcccgccctcctcatctacactactgagcggctggcaaggcgcat

SEQ ID NO: 297403 - DNA, 103 bp, Homo sapiens
  misc_feature: NA.37.78.H01.4.454.light.1.nb
tattgaaacttataaccttgtctcttggtaccaacatcacccaggcaaagtccccaaactcatgatttgatgaggacagtaagcggccctcaggggtctctaa

SEQ ID NO: 297404 - DNA, 499 bp, Homo sapiens
  misc_feature: NA.37.83.H06.1.454.light.1.nb
caggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgttttatacaactccaagaataagagttctttagcttggtaccagcagaaaccacgacagcctcctaagctgctcgtttactgggcctctacccgggaatccggggtccctgaacgattcagtggcggcgggtctgggacagatttcactctcaccatcagcagcctgcgggctgaagatgtggcggtttattactgtcagcagtattatgttactcctcacagttttggccaggggaccaagctggagatcgcacgaactgtggctgcaccatctgtcttcatcttcccgccatctgaatctacactactgagcgggctggcaaggcgcata

SEQ ID NO: 297405 - DNA, 252 bp, Homo sapiens
  misc_feature: NA.37.85.H08.1.454.light.1.nb
gatggtgcatccaccagggccactggcatcccagacaggttcagtggtagtgggtctgggacagacttcactctcaccatcagcagactggagcctgaagattttgcagtgtattactgtcagcagtatggtggctcacccgggtatgtttttggccaggggaccaagctggagatcagacgaactgtggctgcaccatctgtcttcatcttcccgccatctgaatctacactactgagcgggctggcaagg

SEQ ID NO: 297406 - DNA, 318 bp, Homo sapiens
  misc_feature: NA.37.86.H09.1.454.light.1.nb
tcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgc

SEQ ID NO: 297407 - DNA, 327 bp, Homo sapiens
  misc_feature: NA.38.1.A01.1.454.light.1.nb
  modified_base (131)..(131): a, c, t, g, unknown or other
  misc_feature (131)..(131): n is a, c, g, or t
gttaggacccagacggaaccatggaagccccagcgcagcttctcttcctcctgatactctggctcccagaaatcactggagaaatcgtgatgacgcagtctccagccaccctgtctgtgtctccagggganagacgccaccctctcctgcagggccagtcagagtgttagtaacaacctagcctggtaccatcagaaacctggccaggctcccagactcctcatctatgatgcatccaccagggccactggtcgtcccagccaggttcagtggcaggtgggtctgggacaggagttcactctcaccatcagcagcctgcagtctgaa

SEQ ID NO: 297408 - DNA, 308 bp, Homo sapiens
  misc_feature: NA.38.11.A11.1.454.light.1.nb
gacacagcatggacatgagggtcctcgctcagctcctggggctcctgctgctctgtttcccaggtgacagatgtgacatccagatgacccagtctccatcctcactgtctgcatctgtaggagacagagtcaccatcacttgcgggcgggcacggtattaacacctggttggcctggtatcagcagaaaccagggaaagcccctatgtccctaatctttgatgcatccactttgcaaactgggtcccatctaggttcagcgccagtggatcgtgggacagatttcactctcaccatcgacaacctgaa

SEQ ID NO: 297409 - DNA, 360 bp, Homo sapiens
  misc_feature: NA.38.13.B02.1.454.light.1.nb
gaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaacaacacccaggcaaagcccccaaactcatgatttatgaggtcactaatcggccctcaggggtttctaatcgcttctctggctccaagtctggcaacacggcctccctgaccatctctgggctccaggctgaggacgaggctgattattactgcagctc

SEQ ID NO: 297410 - DNA, 74 bp, Homo sapiens
  misc_feature: NA.38.13.B02.3.454.light.1.nb
agtagcaggaggaagagaagctgcgctggggtttccatggttcctctgggtcctaactgagcagctcttcctcc

SEQ ID NO: 297411 - DNA, 352 bp, Homo sapiens
  misc_feature: NA.38.2.A02.1.454.light.1.nb
tcatctggatgtgacatccagatgacccagtctccagcctccctgtcagcatctgtaggggacagggtcaccatcacttgccgggcaagtcagagaattagcacctatttaaattggtatcagcagaaagcagggaaagcccctaaaactcctgatctatgctgcatccaatttgcaaagtggggtcccttcaaggttcagtggcagtggatctgggacagatttcagtctcacatcagcagtctgcaacctgaagattttgcaacttactactgtcaacagagttacagtaccgttctcactttcggcgagggaccaaggtgagatcaaacgaactgtggctgcaccatct

SEQ ID NO: 297412 - DNA, 361 bp, Homo sapiens
  misc_feature: NA.38.22.B11.1.454.light.1.nb
gttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtactcccagccagggtcagtggcagtgggtctgggacagagttcactctcaccatcagcagcctgcagtctagaagattttgctagtttatttctgtcagctattacaatt

SEQ ID NO: 297413 - DNA, 365 bp, Homo sapiens
  misc_feature: NA.38.23.C01.2.454.light.1.nb
acaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctcatttattggtcatctactcgggtgtccgggtccctgaccgattcagcggcagcggatctgggacagatttcactctcaccatcagcagcctgcagactgaagatgtgctagtttatactgtcagc

SEQ ID NO: 297414 - DNA, 105 bp, Homo sapiens
  misc_feature: NA.38.25.C03.2.454.light.1.nb
agactgacggtccccaggagttcaggtgctgggcacagcggccctgggctgcctggtcaaggactacttccacgtgatcgactgagcgggctggcaaggcgcata

SEQ ID NO: 297415 - DNA, 398 bp, Homo sapiens
  misc_feature: NA.38.26.C04.1.454.light.1.nb
ctctggagaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtcttagcagcagctacttagcctggtaccagcagaaacctggccaggctcccaggctcctcatctacggtgcatccagcagggccactggcatcccagacaggttcagtggcagtgggtctgggaaagcttcactctctccatcagcagactggagcctgaagattttgcagtgtattactgtcagcagtatggtaactcaccattcactttcgg

SEQ ID NO: 297416 - DNA, 378 bp, Homo sapiens
  misc_feature: NA.38.27.C05.1.454.light.1.nb
cagttaggacccagagggaaccatggaaaccccagcgcagcttctcttcctcctgctactctggctcccagatacgaccggagaaagtgtgttgacgcagtctccaggcaccctgtctttgtctccaggggagagagccaccctctcctgcagggccagtcagactataggagcagctacttagcctggtaccagcaaaaacctggccaggctcccaggctcctcatttatggtgcgtccaccagggccactggcatcccagacagattcagtggcagtgcgtctgggacagacttcactctcgtgatcgacagactggacccaacagattttgctgtgtattactgtcaacactatgggtcttccggctgacgttcg

SEQ ID NO: 297417 - DNA, 334 bp, Homo sapiens
  misc_feature: NA.38.3.A03.1.454.light.1.nb
catctccaccatggcctgggctctgctgctcctcaccctcctcactcagggcacagggtcctgggcccaatctgccctgactcagcctgcctccgtgtctgggtctcctggacagtcggtcgccatctcctgcactggaaccagcagtgacattggtacttataaccatgtctcctggtaccaacatcacccagacaacggcccccaaatcataatttatgacgtcagtagtcggccctcaggggtttctgatcgcttctcaggctccaagtctggcaacacggcctccctgaccatctctgggctccgaggttgaggacgaggctgactatta

SEQ ID NO: 297418 - DNA, 380 bp, Homo sapiens
  misc_feature: NA.38.32.C10.1.454.light.1.nb
tcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccagcagtgacgttggtggttatgactatgtctcctggtaccaacaacaccccgccaaagcccccaaactcatgatttatgaggtcagtaatcggccctcggggtttctaatcggttctctggctcaagtctggcaacacggcctccctgaccatctctgggctccagcctgaggacgaggctgattattactgcagctcaatatactagcagcatca

SEQ ID NO: 297419 - DNA, 105 bp, Homo sapiens; identical to SEQ ID NO: 297414
  misc_feature: NA.38.33.C11.1.454.light.1.nb

SEQ ID NO: 297420 - DNA, 218 bp, Homo sapiens
  misc_feature: NA.38.36.D03.1.454.light.1.nb
tcggttcagtggcagtggatctgggacagatttcattctcaccatcagcagcctgcagcctgaagatgttgcaacttattactgtcaaaggtataaaagtgcccctcccactttcggcggagggaccaaggtggagatcaaacgaactgtggctgcaccatctgtcttcatcttcccgcatctgaacgtgatcgactgagcgggctggcaaggcgcat

SEQ ID NO: 297421 - DNA, 468 bp, Homo sapiens
  misc_feature: NA.38.38.D05.1.454.light.1.nb
tcctgggctctgctgctcctcaccctcctcactcagggcacagggtcctgggcccagtctgccctgactcagcctgcctccgtgtctgggtctcctggacagtcgatcaccatctcctgcactggaagcagtagtgacattggtggttataactatgtctcctggtaccaacaacacccaggcaaagcccccaaactcatcatttatgacgtcactcatcggccctcaggggtttctactcgcttctctggctccaagtttggcaacacggcctccctgaccatttctgggctccaggctgaggacgaggctgaattttattgctcctcatatacaggcagcagcaccccttatgtcttcggaactgggaccaaggtcaccgtcctacgtcagcccaaggccaaccccactgtcactctgttcccgccctcctcacgtgatcgactgagcgggctggcaaggcgcata

SEQ ID NO: 297422 - DNA, 473 bp, Homo sapiens
  misc_feature: NA.38.39.D06.1.454.light.1.nb
tgcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataaatatgtctcttggtaccaacatcaccaacatcacccaggcaaagtccccaaactcataatttatgaggtcactaaacggccctcaggagtttctaatcgcttctctggctccaagtctggcaacacggcctccctgaccatctctgggctccaacctgaggacgaggctcactattattgcagctcatatacaagcagcgtcacttgggtgttcggcggagggaccgacctgaccgtcttaggtcagcccaaggctcgcccctcggtcactctcgttcccccctcctcacgtgactcgactgagcgggctggcaaggcgc

SEQ ID NO: 297423 - DNA, 420 bp, Homo sapiens
  misc_feature: NA.38.5.A05.1.454.light.1.nb
gcagcgctctcaggacatctccaccatggcctgggctctgctgctcctcaccctcctcactcagggcacagggtcctgggcccagtctgccctggctcagcctgcctccgtgtctgggtctcctggacagtcgatcaccatctcctgcactggaaccagcagtgacgttggtggttataaatttgtctcctggtaccaacagcacccgggcaatcgcccccaaaatcatgatttatgaggtcactcatcggccctcaggggtttctaatcgcttctctgcatccaagtctggcaacacggcctccctgaccatctctgggctccaggctgaggacgaggcttaattatttctgctagttcatatacaaccagacaacactctgctagttcggcgaggaccaagctgaccgtctaagtcag

SEQ ID NO: 297424 - DNA, 128 bp, Homo sapiens
  misc_feature: NA.38.50.E06.1.454.light.1.nb
tatgcgccttgccagcccgctcagtcgatcacgttcagatggcgggaagatgaagacagatggtgcagccacagttcgtttggtctccagcttggtcccctggccaaagtgtacggtcttgtaccata

SEQ ID NO: 297425 - DNA, 320 bp, Homo sapiens
  misc_feature: NA.38.53.E09.2.454.light.1.nb
tcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagactgttagcagcagctacttagcctggtaccagcagaaacctggccaggctcccaggctcctcatctttggtcatccagcagggccatggcatcccagacaggttcagtggcagtgggtctgggacagacttcactctcaccatcaccagactgga

SEQ ID NO: 297426 - DNA, 298 bp, Homo sapiens
  misc_feature: NA.38.55.E11.1.454.light.1.nb
tggtaccagcagctcccaggaacagccccaaactcctcatttatgaccataataggcgaccctcagggattcctgaccgattctctggctccaagtctggcacgtcagccaccctgggcatcaccggcctccagactggggacgaggccgattattactgcggaacatgggataccagactgaatgcttgggtgctcggtggagggaccaggctgaccgtcctaggtcagcccaaggctgccccctggtcactctgttcccacctcctcacgtgatcgactgagcggctggcaaggcg

SEQ ID NO: 297427 - DNA, 105 bp, Homo sapiens; identical to SEQ ID NO: 297414
  misc_feature: NA.38.55.E11.2.454.light.1.nb

SEQ ID NO: 297428 - DNA, 381 bp, Homo sapiens
  misc_feature: NA.38.6.A06.1.454.light.1.nb
gtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaagctcctgatctatgctgcctcactttgcaaagtgggtcccatcaaggttcagcggcagtggatctgggacagatttcactctcaccatcagcagcctgcagcctgaagtattttgctaacttattactgtcaacagcttaatagttatctcactttcggcgaggaccaaggtcgagatcaaacgaactgtggctgcaccatctgtc

SEQ ID NO: 297429 - DNA, 223 bp, Homo sapiens
  misc_feature: NA.38.75.G09.1.454.light.1.nb
tctcaggaggcagcgctctcaggacatctccaccatggcctgggctctgctgctcctcaccctcctcactcagggcacagggtcctgggcccagtctgccctgactcagcctgcctccgtgtctgggtctcctggacagtggatcaccatctcctgcactggaaccagcagtgacgttggtggttatgactatgtctcctggtaccaacaacaccccgccaaa

SEQ ID NO: 297430 - DNA, 366 bp, Homo sapiens
  misc_feature: NA.39.1.A01.1.454.light.1.nb
caagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggctagtttattactgtcagctagtattatagtagt

SEQ ID NO: 297431 - DNA, 354 bp, Homo sapiens
  misc_feature: NA.39.11.A11.1.454.light.1.nb
gcagcgctctcaggacatctccaccatggcctgggctctgctgctcctcaccctcctcactcagggcacagggtcctgggcccagtctgccctgactcagcctgcctccgtgtctgggtctcctggacagtcgctcaccatctcctgcactggaaccagcagtgacgttggtgttacaactatgtctcctggtaccaacaacaccccggcaaacgcccccgaagtcatgatttatgacgtcactaatcggccctcagggtgtctaatcgcttctctggctccaagtctggcaacacggcctccctgaccatctctggctccaggctgaggacgaggctgattattactgcagct

SEQ ID NO: 297432 - DNA, 329 bp, Homo sapiens
  misc_feature: NA.39.14.B03.1.454.light.1.nb
gaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaagcagcagtgacgttggtggttataactatgtctcctggtaccaacagcacccaggcaaacgcccccaaactcatgatttatgaggtcagtaatcggccctcaggggtttctaatcgcttctctggctcaagtctggcaacacggcctcctgaccatctctgggctcaggct

SEQ ID NO: 297433 - DNA, 329 bp, Homo sapiens
  misc_feature: NA.39.16.B05.2.454.light.1.nb
cagcatcggaggtgcctcagccatggcatggatccctctcttcctcggcgtccttgcttactgcacaggatccgtggcctcctatgagctgtctcagccacgctcagtgtccgtgtccccaggacagacagccagcatcacctgctctggaaatacattaggagataaatatgcttgctggtatcagcagaagccaggccagtcccctgtgctgatcatctatcaagataccaagcggccctcagggatccctgagcgattctctggctccaactctgggaacacagccactctgaccatcagcgggacccaggctatggatgaagctg

SEQ ID NO: 297434 - DNA, 237 bp, Homo sapiens
  misc_feature: NA.39.2.A02.2.454.light.1.nb
tggggtccctcatcgcttctctggctccattcttgggaacaaagctgccctcaccatcacgggggcccaggcagaggatgaatgtgattattactgtgtgctgtatatgggtagtggcatttcgctattcggcggagggaccaagctgaccgtcctaggtcagcccaaggctgccccctggtcactctgttcccaccctcctcactagtgcgactgagcgggctggcaaggcgcata

SEQ ID NO: 297435 - DNA, 91 bp, Homo sapiens
  misc_feature: NA.39.21.B10.2.454.light.1.nb
atggctaccaggtcagcccaaggccaaccccactgtcactctgttcccaccctcctcactagtgcgactgagcgggctggcaaggcgcata

SEQ ID NO: 297436 - DNA, 344 bp, Homo sapiens
  misc_feature: NA.39.24.C02.1.454.light.1.nb
ctcagtcaggacacagcatggacatgagggtccccgctcagctcctggggctcctgctactctggctccgaggtgccagatgtgacatccagatgatgcagtctccatcctccctgtctgcatctgtcggggacagagtcaccatcacttgccgggccagtcagaccattacctcctatttaagttggtatcagcagaaaccaggaaaagcccctaaactcctgatctatgctgcgtccactttgcaagatgggtcccatcaaggttcagtgctagtggatatgggacagatttcactctcaccatcacaggtctgcaacgtgatgattttgctaacttactac

SEQ ID NO: 297437 - DNA, 384 bp, Homo sapiens
  misc_feature: NA.39.27.C05.1.454.light.1.nb
gactcagtcaggacacagcatggacatgagggtccccgctcagctcctggggctcctgctgctctggctcccaggtgccaaatgtgacatccagatgacccagtctccttccaccctgtctgcatctgttggagacagagtcaccatcacttgccgggccagtcagagtattagtagctggttggcctggtatcagcagaaaccagggaaagcccctaagctcctgatgtatgatgcctccagtttgaaaagtggggtcccatcaaggttccgcggcagtggatctgggacagaattcactctcaccatcagcagcctgcagcctgatgattttgctaacttattactgccaacagtataatagttattcgtactactttggcc

SEQ ID NO: 297438 - DNA, 129 bp, Homo sapiens
  misc_feature: NA.39.28.C06.1.454.light.1.nb
gttgctggaggtcacggtcaccacgctgctgagggagtagagtcctgaggactgtagcacagcggccctgggctgcctggtcaaggactacttccactagtgcgactgagcgggctggcaaggcgcata

SEQ ID NO: 297439 - DNA, 423 bp, Homo sapiens
  misc_feature: NA.39.31.C09.1.454.light.1.nb
agatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttacacaggtccaacaataagaattacttcgcttggtaccagcagaaaccaggacagcctcctaagttgctcatttactgggcatctacccgggagtccggggtccctgaccgattcagcggcagcgggtctgagacagatttcactctcaccatcagcagcctgcaggctgaagatgtggcagtttattactgtcagcagtattatagtagtcctcagacttttggccggggaccaagctggagatcaaacgaactgtggctgcaccatctgt

SEQ ID NO: 297440 - DNA, 249 bp, Homo sapiens
  misc_feature: NA.39.36.D03.1.454.light.1.nb
aggactcctcagttcaccttctcacaatgaggctccctgctcagctcctggggctgctaatgctctgggtctctggatccagtggggatattgtgatgactcagtctccactctccctgcccgtcacccctggagacgccggcctccatctcctgcaggtctagtcagagcctcctgcatagtaatggatacaacttatttggattggtacctgcagaagccgagggcagtctcacaactcctgatcta

SEQ ID NO: 297441 - DNA, 321 bp, Homo sapiens
  misc_feature: NA.39.37.D04.2.454.light.1.nb
  modified_base (142)..(142): a, c, t, g, unknown or other
  misc_feature (142)..(142): n is a, c, g, or t
agctgctcagttaggacccagagggaaccatggaaaccccagcgcagcttctcttcctcctgctactctggctcccagataccaccggagaaattttgttgacgcagtctccaggcaccctgtgtttgtctccaggggaaanagccaccctctcctgcagggccagtcagtttgtcccaacaacttcttagcctggtaccagcagaaacctggccaggctcccaggctcctcatctatgatacatccaccagggccactggcatcccagacaggttcagtggtgttgggtctgggacagacttcactctcaccatcagcag

SEQ ID NO: 297442 - DNA, 382 bp, Homo sapiens
  misc_feature: NA.39.39.D06.1.454.light.1.nb
ctcaggaggcagcgctctcaggacatctccaccatggcctgggctctgctgctcctcaccctcctcactcagggcacagggtcctgggcccagtctggcctgacacagcctgcctccgtgtctgagactcctggacagtcgatcaccatctcctgcactggaaccagcagtgacgttggtgcttataattatgtctcctggttccaacagcattcaggcagcgcccgaaactcttaatttatgaggtctttcgtcggccctcagggtttctagtcgcttctccggctccaagtctggcaacacggcctccctgaccatctctagactccaggctgaggacgaggctgactattattgcagctcatatactgaagtcaatggt

SEQ ID NO: 297443 - DNA, 217 bp, Homo sapiens
  misc_feature: NA.39.40.D07.1.454.light.1.nb
actgctcagttaggacccagacggaaccatggaagccccagcgcagcttctcttcctcctgctactctggctcccagattccactggagaaatagtgatgacgcagtctccagccaccctgtctgtgtctccgaggggaaagagtcaccctctcctgcagggccagtcagagtgttagcagcaacttagcctggtaccagcagaaacctggccaggc

SEQ ID NO: 297444 - DNA, 364 bp, Homo sapiens
  misc_feature: NA.39.46.E02.1.454.light.1.nb
aaagcaaaccccagctgggaagcctgagaacacttagccttcatgagtgtccccaccatggcctggatgatgcttctcctcggactccttgcttatggatcaggagtggattctcagactgtggtgacccaggagccctcgttctcagtgtaccctggagggacagtcacactcacttgtggcttgagctctggctcagtctctagtacttactaccccagctggtaccagcagaccccaggccaggctccacgcacgctcatctacagcacaaacattcgctcctctggggtccctcatcgcttctctggctccattcttgggaacaaagctgccctcaccatccgacggggcccaggcagag

SEQ ID NO: 297445 - DNA, 361 bp, Homo sapiens
  misc_feature: NA.39.50.E06.1.454.light.1.nb
tgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagactattagcagcaacttagcctggtaccagcaaaaacctggccagactcccaggctcctcatgtatggtgcgtccaccagggccactggtatcccagccaggttcagtggcagtgggtctgggacagagttcagtctcaccatcagcagcctgcagtctgaagtattttgtactttattactgtcagcagtatg

SEQ ID NO: 297446 - DNA, 487 bp, Homo sapiens
  misc_feature: NA.39.53.E09.2.454.light.1.nb
gtctctctcagtcagggcacagcatggacatgagggtccctgctcagctcctgggactcctgctgctctggctcccagataccagatgtgacatccagatgacccagtctccatcctccctgtctgcatctgtaggagacagagtcaccatcacttgccgggcgagtcagggcattaggcattatttagcctggtatcaacagcacccggggaaggttcctagactcctgatctatgatgcatccaatttagaaccaggggtcccatctcgattcagtggcggtgggtctgggacagatttcactctcaccatcagcagcctgctgcctgaagatgctgcaacttattactgtcaaaagtatgacagtgtcccgtggacgttcggcccagggaccaaggtggaaatcaaacgaactgtggctgcaccatctgtcttcatcttcccgcatctgaactagtgcgactgagcgggctggcaaggcgcata

SEQ ID NO: 297447 - DNA, 232 bp, Homo sapiens
  misc_feature: NA.39.54.E10.1.454.light.1.nb
atccctgagcgcttctcaggctccagctctgggctgagcgccacctcaccatctccagcctccagtctgaggatgaggctgactattactgtcagacctggggcactggcattcatgtggtattcggcggagggaccaagctgaccgtcctgggtcagcccaaggctgccccctggtcactctgttcccgccctcctcactagtgcgactgagcgggctggcaaggcgcata

SEQ ID NO: 297448 - DNA, 335 bp, Homo sapiens
  misc_feature: NA.39.6.A06.1.454.light.1.nb
catctggatgtcacatttggcacctgggagccagagcagcaggagccccaggtgccaaatgtgacatccagatgacccagtctccttccaccctgtctgcatctgtaggagacagagtcaccatcacttgccgggccagtcagagtattagtagctggttggcctggtatcagcagaaaccagggaaagtcccaaacctcctaatttataaggcgtcgactttagaaagtggggtcccatcaaggttcagcggcagtggatctgggacagaattcagtctcaccatcagcagcctgcagcctgaagattttgcaacttattactgccaacagtat

SEQ ID NO: 297449 - DNA, 333 bp, Homo sapiens
  misc_feature: NA.39.60.F05.1.454.light.1.nb
ggaagcagcactggtggtgcctcagccatggcctggaccgttctcctcctcggcctcctctctcactgcacaggctctgtgacctcctatgtcttgactcagccaccctcggtgtcagtggccccaggacagacggccaggattacctgtgggggaaacataattggaagtaatagtgtgcactggtaccagcagaagtcaggccaggcccctgtgctggtcgtctatgatgatagcgaccggccctcagggatccctgagcgattctctggctccaactctgggaacacggccaccctgaccatcagcagggtcgaaggtcggggatggagg

SEQ ID NO: 297450 - DNA, 325 bp, Homo sapiens
  misc_feature: NA.39.72.G06.1.454.light.1.nb
gctcagttaggacccagagggaaccatggaaaccccagcgcagcttctcttcctcctgctactctggctcccagataccaccggagaatttgtgttgacgcagtctccaggcaccctgtctttgtctccaggggatagagccaccctctcctgcagggccagtcagagtgttagcacctccttagcctggtaccagcagaaatttggccaggctcccaggctcctcatctttgattcatccagcagggccactggcatcccagacaggttcagtggcagtgggtctgggacagacttcagtctcaccatcagcagactggagcct

SEQ ID NO: 297451 - DNA, 266 bp, Homo sapiens
  misc_feature: NA.39.74.G08.1.454.light.1.nb
agtcaggacacagcatggacatgagggtccctgctcagctcctgggactcctgctgctctggctcccagatgccggatgtgacatccagatgacccagtctccatcctccctggctgtatctgtaggagacagagtcaccatcacttgtcgggcgagtcaggacattagcaattattagcctggtatcagcagagacctggcaaagttcctaagctcctgatcaatgctgcgtccgccttacaatcaggtcgtcccgtctcggttc

SEQ ID NO: 297452 - DNA, 253 bp, Homo sapiens
  misc_feature: NA.39.77.G11.1.454.light.1.nb
caggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctactggtaccaagcaacaccaggcacagcccccaaactcatcatttatgagtcagtaatc

SEQ ID NO: 297453 - DNA, 263 bp, Homo sapiens
  misc_feature: NA.39.81.H04.2.454.light.1.nb
ctcagttcaccttctcacaatgaggctccctgctcagctcctggggctgctaatgctctgggtcccaggatccagtggggatgttgtgatgactcagtctccagtctccctgcccgtcacccttggacagccggcctccatctcctgcaggtctagtcaaagcctcgtatacattgatggaaacacctacttgaattggtttcagcagagccaggccaatctccaaggcgacctaatttataaggtttctaaccgggactcgt

SEQ ID NO: 297454 - DNA, 276 bp, Homo sapiens
  misc_feature: NA.39.83.H06.1.454.light.1.nb
ctcagtcaggacacagcatggacatgagggtccctgctcagctcctgggactcctgctgctctggctcccagataccagatgtgacatccagatcgacccagtctccatcctccctgtctgcatctgtaggagacagagtcatcatcacttgccgggcgagtcagggcattaccaattatttagcctggtatcagcagaaaccaggaaaggtcttaagctcctgatctatgctgcatccactttgcaatcaggggtcccatctcggttcagtggca

SEQ ID NO: 297455 - DNA, 378 bp, Homo sapiens
  misc_feature: NA.39.85.H08.2.454.light.1.nb
gcaggcaggggcagcaagatggtgttgcagacccaggtcttcatttctctgttgctctggatctctgttactacaggtgcctacggggacatcgtgatgacccagtctccagactccctggctgtgtctctgggcgagagggccacgatcaactgcaagtccagccggagtgtttatacaactccaagaataagagttctttagcttggtaccagcagaaaccacgacagcctcctaagctgctcgtttactgggcctctacccgggaatccggggtcctgaacgattcagtggcggcgggtctgggacagatttcactctcaccatcagcagcctgcggctgaagatgtggtcggtttattactgtcagtcagtatt

SEQ ID NO: 297456 - DNA, 502 bp, Homo sapiens
  misc_feature: NA.39.86.H09.1.454.light.1.nb
ctcaggaggcagcgctctcaggacatctccaccatggcctgggctctgctgctcctcaccctcctcactcagggcacagggtcctgggcccagtctgccctgactcaggctgcctccgtgtctgggtctctaggacagtcgatcaccatctcctgcactggaaccagcagtgacgttgggggttatgactatgtctcctggtaccagcaatatccaggcacacgcccccaaactcatcatttatgaggtcagtaatcggccctcaggggtttctaatcgcttctctggctccaagtctggcaacacggcctccctgaccatctctgggctccaggctgaggacgaggctgattattactgcagctcatttgcaatcagtgaggcttatgtcttcggaagtgggaccaaggtcatcgtcctaggtcagcccaaggccaaccccactgtcactctgttcccgccctcctcactagtgcgactgagcgggctggcaaggcgcata

SEQ ID NO: 297457 - DNA, 319 bp, Homo sapiens
  misc_feature: NA.39.87.H10.2.454.light.1.nb
agacccactcaggacacagcatggacatgagggtccccgctcagctcctggggcttctgctgctctggctcccaggtcgccagatgtgccatccagttgacccagtctccatcctccctgtctgcatctgtaggagacagagtcaccatcacttgccgggcaagtcagggcaattaaaaatgatttagcctggtatcagcagaaaccagggaaactcctaaggtcctgatctatgatgcctcagtttggaaagtgggtccatcaaggttcagcggcagtggatctgggacagatttcactctcaccatcaccagcctgc

SEQ ID NO: 297458 - DNA, 109 bp, Homo sapiens
  misc_feature: NA.39.88.H11.1.454.light.1.nb
cggcggagggaccaagctgaccgtcctaggtcagcccaaggctgccccctcggtcactctgttcccgccctcctcactagtgcgactgagcgggctggcaaggcgcata

SEQ ID NO: 297459 - DNA, 347 bp, Homo sapiens
  misc_feature: NA.39.9.A09.1.454.light.1.nb
tgctctggaagcacctccaacattgggattaattatgtatcctggtaccagcaactcccaggtacagcccccaaactcctcatttatgacgatgataagcgactctctgggattcctgaccgattctctggctccaagtctggcacgtcagccaccctgggctcaccggactccagtctggggacgaggccgattattactgcgcagcatgggatacctccctgagtggtggggtgttcggcggagggaccaagctgaccgtcctaggtcagcccaaggctcgccccctcggtcactctcgttcccgccctcctcactagtcgcgactgagcgggctggcaaggcgc

SEQ ID NO: 297460 - DNA, 364 bp, Homo sapiens
  misc_feature: NA.3.1.A01.1.454.light.1.nb
cacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtgggtcccaccaacgttcagcggcagtggatctgggacagagttcactctcaccatcagcagcctgcagcctgacgatgtggcaacttattactgccaacagtatgatagttattggacgttcgg

SEQ ID NO: 297461 - DNA, 211 bp, Homo sapiens
  misc_feature: NA.3.10.A10.1.454.light.1.nb
  modified_base (171)..(171): a, c, t, g, unknown or other
  misc_feature (171)..(171): n is a, c, g, or t
gttagggacccagacggaaccatggaagccccagcgcagcttctcttcctcctgctactctggctcccagatgccactggagaaatagtgatggcgcagtctccagccaccctgtctgtgtctccgaggggaaagcccaccctctcctgcagggccagtcagtctgtttanaacacttagcctggtaccaacagagacctggccaggctcc

SEQ ID NO: 297462 - DNA, 351 bp, Homo sapiens
  misc_feature: NA.3.12.B01.1.454.light.1.nb
gctcagttaggacccagacggaaccatggaagccccagcgcagcttctcttcctcctgctactctggctcccagatatcactggagaaacagtgctgacgcagtctccagccaccctgtctgtgtctccaggggaaaagccaccctctcctgcagggccagtcagagtgttagtagcaacttagcctggtaccagcatattcttggccaggctcccaggctcctcatctatggtgcatccacccgggccactggtactcccagccaggttcagtggcagtgggtctcggacagagttcactctcaccatcagcagcctgcagtctgaagactctgcagtttatactgtcag

SEQ ID NO: 297463 - DNA, 115 bp, Homo sapiens
  misc_feature: NA.3.12.B01.2.454.light.1.nb
tcgatttagtagtgtagatcccgcggaatctacactactaaatcgagcaccggtcgtgctgcctggtcaaggactacttccgagtgcgtctctgagcgggctggcaaggcgcata

SEQ ID NO: 297464 - DNA, 324 bp, Homo sapiens
  misc_feature: NA.3.14.B03.1.454.light.1.nb
tcagttaggacccagacggaaccatggaagccccagcgcagcttctcttcctcctgctactctggctcccagacaccactggagaaatagtgatgacgcagtctccagccaccctgtctgtgtctccaggggaaaagccaccatctcctgcagggccagtcagactattagaagcaacttagcctggtaccagcagaaacctggccaggctcccaggctcctcatctatggtgcatccaccagggccactggtatcccagccaggttcagtggcaggtgggtctgggacagagttcactctcaccatcagcagcctgcagtctg

SEQ ID NO: 297465 - DNA, 100 bp, Homo sapiens
  misc_feature: NA.3.15.B04.1.454.light.1.nb
tcgatttagtagtgtagattccgcgggctggcaaggcgcatagctgcctggtcaaggactacttccgagtgcgtctctgagcgggctggcaaggcgcata

SEQ ID NO: 297466 - DNA, 191 bp, Homo sapiens
  misc_feature: NA.3.16.B05.1.454.light.1.nb
ctcaggaggcagcgctctcgggacgtctccaccatggcctgggctctgctattcctcaccctcctcactcagggcacgagggtcctgggcccagtctgccctgactcagcctgcctccgtgtctgggtctcctggacagtcgatcatcgccatctcctgcactggaaccagcctagtgacgttggtggtta

SEQ ID NO: 297467 - DNA, 282 bp, Homo sapiens
  misc_feature: NA.3.17.B06.1.454.light.1.nb
  modified_base (210)..(210): a, c, t, g, unknown or other
  misc_feature (210)..(210): n is a, c, g, or t
ctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaancccctaagctcctgatctatgctgcatccactttgcatggtgggtcccatcaagtcttcagtggcagtggat

SEQ ID NO: 297468 - DNA, 211 bp, Homo sapiens
  misc_feature: NA.3.18.B07.1.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacag

SEQ ID NO: 297469 - DNA, 325 bp, Homo sapiens
  misc_feature: NA.3.19.B08.1.454.light.1.nb
tcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaaggttcagtgcagtggatctgggacagatttcactctcaccatcagtagtctacaacctgaagtatttt

SEQ ID NO: 297470 - DNA, 78 bp, Homo sapiens
  misc_feature: NA.3.2.A02.1.454.light.1.nb
gctcagttaggacccagacggaaccatggaagccccagcgcagcttctcctcctcctgctactctggctcccagatac

SEQ ID NO: 297471 - DNA, 328 bp, Homo sapiens
  misc_feature: NA.3.23.C01.2.454.light.1.nb
ctcagttaggacccagagggaaccatggaaaccccagcgcagcttctcttcctcctgctactctggctcccagatacccccggagaaattcttttgacgcagtctccaggcaccctgtctttgtctccaggggagagagccaccctctcctgcagggccagtccgagtgtcagcagcaaccacttagcctggtaccagcagagacctggccaggctcccaggctcctcatccatggtgcatccaacagggccactggcatcccagacaggttcagtggcaggtgggtctggaacagacttcactctcaccatcagcagactggagcct

SEQ ID NO: 297472 - DNA, 503 bp, Homo sapiens
  misc_feature: NA.3.28.C06.1.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtgttataactatgtctcctggtatcaacagcacccaggcaaagcccccaaactcataatttatgatgtcagtaatcggcctcagggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaaccccactgtcactctgttcccgccctcctcgagtgcgtctctgagcgggctggcaaggcgcata

SEQ ID NO: 297473 - DNA, 325 bp, Homo sapiens
  misc_feature: NA.3.3.A03.1.454.light.1.nb
taggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtatcaacagaaacctggccaggctcccaggctcctcatctatgatgcatccaacagggccactggcatcccagccaggttcagtggcagtgggtctgggacagacttcactctcaccatcagtagcctagagcctagaagta

SEQ ID NO: 297474 - DNA, 253 bp, Homo sapiens
  misc_feature: NA.3.3.A03.2.454.light.1.nb
tcaggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagccgcccctca

SEQ ID NO: 297475 - DNA, 370 bp, Homo sapiens
  misc_feature: NA.3.33.C11.1.454.light.1.nb
actcagtcaggacacagcatggacatgagggtccccgctcagctcctggggctcctgctgctctggctcccaggtgccaaatgtgacatccagatgacccagtctccctccaccctgtctgcatctgtaggagacggagtcaccatcacttgccgggccagtcagagtattagtacctggttggcctggtatcagcagaagccagggaaagcccctaacctcctgatctatgatgcctccagtttggcaagtggggtcccatcaaggttcagcggcagtggatctgggacagaattcactctcaccatcagcagcctgcagcctgatgattttgctaactttattactgaccaactagtaataatacccg

SEQ ID NO: 297476 - DNA, 373 bp, Homo sapiens
  misc_feature: NA.3.34.D01.1.454.light.1.nb
caggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattggcaaagctatatgcttactggtaccagcagaagccaggccaggcccctgtggtggtgatatataaagaccgtgagaggccctcagggatccctgagcgaatctctggctccagctcagggacaacagtcacgttgaccatcagtggagtccaggcagaagacgaggctgactatcactgtacaaatagcagacagcaagtggaaccc

SEQ ID NO: 297477 - DNA, 402 bp, Homo sapiens
  misc_feature: NA.3.35.D02.1.454.light.1.nb
gactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccagggg

SEQ ID NO: 297478 - DNA, 92 bp, Homo sapiens
  misc_feature: NA.3.35.D02.3.454.light.1.nb
gtcaccgtcctaggtcagcccaaggccaacccactgtcactctgttcccaccctcctcgagtgcgtctctgagcgggctggcaaggcgcata

SEQ ID NO: 297479 - DNA, 327 bp, Homo sapiens
  misc_feature: NA.3.4.A04.2.454.light.1.nb
agttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactcgtggggtcccagacagattcagcggcagtgggtcaggcactgatttcacactagaaatcagcagggtgg

SEQ ID NO: 297480 - DNA, 55 bp, Homo sapiens
  misc_feature: NA.3.4.A04.3.454.light.1.nb
tgttcagtgattgatcaccgaatctggaaacaccggcgacgttccacgtgctggg

SEQ ID NO: 297481 - DNA, 306 bp, Homo sapiens
  misc_feature: NA.3.46.E02.1.454.light.1.nb
  modified_base (139)..(139): a, c, t, g, unknown or other
  misc_feature (139)..(139): n is a, c, g, or t
ctcagttaggacccagacggaaccatggaagccccagcgcagcttctcctcctcctgctactctggctcccagataccactggagaagtagttctgatgcagtctccaggcaccctgtctgtgtctccgaggggaaagngccacgctctcctgtagggccagtcagagtgtcagacataatttaggctggtaccaacagaaacctggccaggctcccaggctcctcattcatggtgcatctaacgagggccatggcattccagccaggttcagtggcagtggatagtgggacagacttcactctca

SEQ ID NO: 297482 - DNA, 360 bp, Homo sapiens
  misc_feature: NA.3.48.E04.1.454.light.1.nb
caggaagcagcatcggaggtgcctcagccatggcatggatccctctcttcctcggcgtccttgcttactgcacaggatccgtggcctcctatgagctgactcagccaccctcagtgtccgtgtccccagggcagacagccaccgtcacctgctctggagataatttgggatcaaaatatgcttcctggtttcagcagactccaggccagtcccctgtgctggtcatctttcaagataccaagcgcccctcagggactccctgagcgattctctggctccaactctgggaacacagccactctgaccatcagcgggacccaggctatggatgaggctgactattactgtcaggcgtgggac

SEQ ID NO: 297483 - DNA, 278 bp, Homo sapiens
  misc_feature: NA.3.50.E06.1.454.light.1.nb
tctcagtcaggacacagcatggacatgagggtccccgctcagctcctggggctcctgctactctggctccgaggtgccagatgtgacatccagatgacccagtctccatcctccctgtctgcatctgtaggggacagagtcaccatcacttgccgggcaagtcagagtattagcaggtatttaaattggtatcagacaaaaaccagggaaacgccctaaatttgatctatgctgcatccagtttgacaaagtgggtcccatcaaggttcaatggcagt

SEQ ID NO: 297484 - DNA, 93 bp, Homo sapiens
  misc_feature: NA.3.53.E09.1.454.light.1.nb
gtcaccgtcctaggtcagcccaaggccaaccccactgtcactctgttcccgccctcctcgagtgcgtctctgagcgggctggcaaggcgcata

SEQ ID NO: 297485 - DNA, 93 bp, Homo sapiens
  misc_feature: NA.3.55.E11.1.454.light.1.nb
gtcaccgtcctaggtcagcccaaggccaaccccactgtcactctgttcccaccctcctcgagtgcgtctctgagcgggctggcaaggcgcata

SEQ ID NO: 297486 - DNA, 401 bp, Homo sapiens
  misc_feature: NA.3.61.F06.1.454.light.1.nb
tcaggaagcagcatcggaggtgcctcagccatggcatggatccctctcttcctcggcgtccttgcttactgcacaggctccggggcctcctatcaactgactcagccaccctccgtgtccgtctccccaggacggacagccgtcatcacctgctctgcaaacgacttgggagagagatatgtttcctggtatctccagaggccaggccactcccctattctagtcctctatcaaaataggaagcgcccctcagggatccctgagcgcttttctggctccaagtctggggacacagccactctgactctcaccggggcccaggccatcgatgagggagactattactgtcaggcgtgggacagcacgactgcagtcttcggcggagggaccaagctgaccgt

SEQ ID NO: 297487 - DNA, 93 bp, Homo sapiens; identical to SEQ ID NO: 297484
  misc_feature: NA.3.87.H10.1.454.light.1.nb

SEQ ID NO: 297488 - DNA, 231 bp, Homo sapiens
  misc_feature: NA.40.1.A01.1.454.light.1.nb
tttagacgtctcatcagggttcagtggaagtggatctgggacagatcctactttcaccatcagcagcctgcagccagaagatattgcgacatatttctgtcaggtgtatgaaagtctccctgttttggccaggggaccaaggtggagatcaaacgaactgtggctgcaccatctgtcttcatcttcccgccatctgaagtcgctagactgagcgggctggcaaggcgcata

SEQ ID NO: 297489 - DNA, 223 bp, Homo sapiens
  misc_feature: NA.40.1.A01.2.454.light.1.nb
tctggctccagctcaggaaacacagcttccttgaccatcactggggctcaggcggaagatgaggctgactattactgtaactcccgggacaccagtggtaacagtcggggagtgttcggcggagggaccaagctgaccgtcctaggtcagcccaaggatgccccctggtcactctgttcccgcctcctcagtcgctagactgagcgggctggcaaggcgcata

SEQ ID NO: 297490 - DNA, 362 bp, Homo sapiens
  misc_feature: NA.40.11.A11.1.454.light.1.nb
ggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatcccggggtccctgaccgattcagtggcagcgggtctgggacagatttcactctgaccatcagcagcctgcaggctgaagtgtggctagtttatactgtacaac

SEQ ID NO: 297491 - DNA, 310 bp, Homo sapiens
  misc_feature: NA.40.12.B01.1.454.light.1.nb
gcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaacgcccccaaactcatgatttctgacgtcagtaagcggccctcgaggggtccctgatcgcttctctggctccaagtctggcaacacggcctccctga

SEQ ID NO: 297492 - DNA, 221 bp, Homo sapiens
  misc_feature: NA.40.16.B05.2.454.light.1.nb
gcttctctggctccaagtctggcaacacggcctccctgaccatctctgggctccaggctgaggatgaggctgattattactgctgctcatttgcaggtagtttttgggtgttcggcggagggaccaagctgaccgtcctaggtcagcccaaggctgccccctcggtcactctgttcccaccctcctcagtcgctagactgagcgggctggcaaggcgcata

SEQ ID NO: 297493 - DNA, 321 bp, Homo sapiens
  misc_feature: NA.40.2.A02.1.454.light.1.nb
caggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaacgcccctcagctcctgatctatactgcatccactttacaaagtgagtcccatcaaggttcagcggcagtggatctggcacagtatttcactctcaccatcagcagcctgcagcctgaa

SEQ ID NO: 297494 - DNA, 363 bp, Homo sapiens
  misc_feature: NA.40.23.C01.1.454.light.1.nb
tgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcaggtgggtctgggacagacttcactctcaccatcagcgctagagcctgaagactttgactagtttattactgtcagcagcgtacc

SEQ ID NO: 297495 - DNA, 301 bp, Homo sapiens
  misc_feature: NA.40.27.C05.2.454.light.1.nb
agacaggattcaggccaatctccagcatggccggcttccctctcctcctcaccctcctcactcactgtgcagggtcctgggcccagtctgtgctgactcagccaccctcagcgtctgacgacccccgggagcaggttaccgtctcttgttctggaagcagctccaacatcggaatattctgtatactggtaccagtgcctcccaggaaccggcccccaaacttctcgtctatagggattatcagcggcccttaggggtccctgaccgattctctggctccaggtctggcacctcagcctcc

SEQ ID NO: 297496 - DNA, 360 bp, Homo sapiens
  misc_feature: NA.40.34.D01.1.454.light.1.nb
acattctgtagggccactgtcttctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccacactttaatctatgaggataacaaaagactctctggggtccctgatcggttctctggctccatcgacagctcctccaattctgcctccctcaccatctctggactgaagactgaggacgaggctgattattactgtcagagttatgatgacacc

SEQ ID NO: 297497 - DNA, 63 bp, Homo sapiens
  misc_feature: NA.40.35.D02.1.454.light.1.nb
tatgcgccttgccagcccgctcagtctagcgactggaagtagtccttgaccaggcagcccagg

SEQ ID NO: 297498 - DNA, 500 bp, Homo sapiens
  misc_feature: NA.40.36.D03.1.454.light.1.nb
caggcaggcaggggcagcaagatggtgttgcagacccaggtcttcatttctctgttgctctggatctctggtgcctggcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggctagtttattactgtcaactaatattattatactccgccgacgttcggccgggggaccaacgtggaaatcaaacgaactgtggctgcaccatctgtcttcatcttcccgccatctgaagtcgctagactgagcgggctggcaaggcgcata

SEQ ID NO: 297499 - DNA, 385 bp, Homo sapiens
  misc_feature: NA.40.39.D06.1.454.light.1.nb
atgggtttgattcagattacatgggtgacttttctgttgtatttccaatctcagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagtattttgctagtgtattactgtcagcagtatggtagctcaccgatcaccttcggccaagggacacgactggag

SEQ ID NO: 297500 - DNA, 344 bp, Homo sapiens
  misc_feature: NA.40.42.D09.1.454.light.1.nb
tggggtgggaggagagacccctctcctgctcccctcctcactttctgcacagtctctgaggcctcctatgagctgacacagccaccctcggtgtcagtgtccccaggacaaacggccaggatcacctgctctggagaagcattgaccaaaaaaattgcttattggtaccaacagaagtcaggccaggcccctgtgctggtcatctatgaggacaacaaacgaccctccgagactccctgagagattctctggctccagctcagggacaatcggccaccttggctctcaggtggggcccaggtggaggatggaaggctgactactactgttactcagtggacagc

SEQ ID NO: 297501 - DNA, 343 bp, Homo sapiens
  misc_feature: NA.40.43.D10.1.454.light.1.nb
taggacccagagggaaccatggaagccccagctcagcttctcttcctcctgctactctggctcccagaaaacaccggagaaattctgttgacacagtctccaggcaccctgtctttgtctccgaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgctactttattactg

SEQ ID NO: 297502 - DNA, 292 bp, Homo sapiens
  misc_feature: NA.40.47.E03.1.454.light.1.nb
ctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtgttacaactatgtctcctggtaccaacaatacccaggcaaacgcccccaaaactcctagatttatgaggtcagtaagcggccctcaggggtccctgatcgcttctctggctc

SEQ ID NO: 297503 - DNA, 252 bp, Homo sapiens
  misc_feature: NA.40.53.E09.1.454.light.1.nb
ctgtgggtagagaagacaggactcaggacaatctccagcatggccagcttccctctcctcctcaccctcctcactcactgtgcagggtcctgggcccagtctgtgctgactcagccaccctcagcgtctcgggacccccggtcagagggtcaccatctcttgttctggaagcagatccaacatcggaagtaatactgtaaactggtaccagcagctccaggaaccgcccccaaactcctcatctatgataat

SEQ ID NO: 297504 - DNA, 315 bp, Homo sapiens
  misc_feature: NA.40.54.E10.1.454.light.1.nb
ccaggaggcagaactctgggtgtctcaccatggcctggatccctctacttctccccctcctcactctctgcacaggctctgaggcctcctatgagctgacacagcccaccctcggtgtcagtcgtccccaggacagacggccagcatcacctgctctggagattcattgtacaaagcaatatgcttattggtaccagcagaaaccaggccaggcccctgtggtggtgctatataaagacactgagaggccctcagggacccctgagcgattctctggctccgaggtcagggacaacagtcacgttgaccatcagt

SEQ ID NO: 297505 - DNA, 329 bp, Homo sapiens
  misc_feature: NA.40.56.F01.1.454.light.1.nb
agacccagtcaggacacagcatggacatgagggtccccgctcagctcctggggctcctgctgctctggctcccaggtgccaattgtgacatccagatgacccagtctccctccaccctgtctgcctctattggagacagggtcaacatcacttgccgggccagtcggaggatttatacctgattggcctggtatcagcagaaaccagggaaagcccctgacctcctgatctttaaggcgtctactttggagacatgggtcccatcaaggttcagcggcagtggatccgagacagaattcactctcaccatcagcagcctgcagccggat

SEQ ID NO: 297506 - DNA, 96 bp, Homo sapiens
  misc_feature: NA.40.56.F01.2.454.light.1.nb
gcgtcagcactatttctccagtggtatctgggagccagagtagcaggaggaagagaagctgcgctggggcttccatggttccgtctgggtcctaac

SEQ ID NO: 297507 - DNA, 352 bp, Homo sapiens
  misc_feature: NA.40.57.F02.1.454.light.1.nb
caggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcgaggggtcgctgatcgcttctctggctccaagtctggcgacacggcctccctgaccatctctgggctccagactgaggatgaggctactta

SEQ ID NO: 297508 - DNA, 313 bp, Homo sapiens
  misc_feature: NA.40.63.F08.1.454.light.1.nb
aggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatctgagacagatttcagtcttactatcagcaatctgcaac

SEQ ID NO: 297509 - DNA, 437 bp, Homo sapiens
  misc_feature: NA.40.67.G01.1.454.light.1.nb
ctgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccacgtggcgtcccggccaggttcagtggcagtggtctgggacagccttcactctcaccatcagcagcctggagcccgaagattttgcggtttattactgtcagcagcgtgccgactcggcccctacgttcggcggagggaccaaggtggacatcaaacgactgtggctgcaccatctgtcttcatc

SEQ ID NO: 297510 - DNA, 243 bp, Homo sapiens
  misc_feature: NA.40.69.G03.1.454.light.1.nb
actgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggcctcccaggcctcctcatctctggtgcc

SEQ ID NO: 297511 - DNA, 353 bp, Homo sapiens
  misc_feature: NA.40.77.G11.1.454.light.1.nb
gacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtgggtcccatccaggttcagcggcagtggatctgggacagaattcgctctcaccatcagcagcctgcagcctgatgattttgctaacttattactgccaac

SEQ ID NO: 297512 - DNA, 239 bp, Homo sapiens
  misc_feature: NA.40.80.H03.1.454.light.1.nb
  modified_base (138)..(138): a, c, t, g, unknown or other
  misc_feature (138)..(138): n is a, c, g, or t
gctcagttaggacccagagggaaccatggaagccccagctcagcttctcttcctcctgctactctggctcccagataccgccggagaaattgtgttgacacagtctccagccaccctgtctttatctccaggggaaangccatcctctcctgcagggccagtcagaatattgatacatacttagcctggtaccagcagaaacctggcctggctccagggtcctcatccatgatgcctcc

SEQ ID NO: 297513 - DNA, 448 bp, Homo sapiens
  misc_feature: NA.40.81.H04.1.454.light.1.nb
tgtttctcgtagtctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaaggtggaaatcaagcgaactgtggctgcaccatctgtcttcatcttcccgccatctgaa

SEQ ID NO: 297514 - DNA, 255 bp, Homo sapiens
  misc_feature: NA.40.83.H06.2.454.light.1.nb
ttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctc

SEQ ID NO: 297515 - DNA, 324 bp, Homo sapiens
  misc_feature: NA.40.84.H07.1.454.light.1.nb
  modified_base (133)..(133): a, c, t, g, unknown or other
  misc_feature (133)..(133): n is a, c, g, or t
gttaggacccagacggaaccatggaagccccagcgcagcttctcttcctcctgctactctggctcccagataccactggagaaatagtgctgacgcagtctccagccaccctgtctgtgtctccaggggaaanggcaccctctcctgcagggcagtcagagtgttgccaccaacttagcctggtaccagcagaaacctggccagcctccaggcctcctcatctatcgtgcatcccaccagggccactggtactcccagccaggttcagtggcagtgggtctgggacagacttcactctcaccatcagcagcctgcagtctgaag

SEQ ID NO: 297516 - DNA, 184 bp, Homo sapiens
  misc_feature: NA.40.86.H09.1.454.light.1.nb
ttcactctcaccatcaccagcctgcaggctgaagatgtggcggtttattactgtcaacaatattctggtcaatctcattctttcggcggagggaccaaggtggagatcagacgaactgtggctgcaccatctgtcttcatcttcccgccatctgaagtcgctagactgagcgggctggcaaggc

SEQ ID NO: 297517 - DNA, 316 bp, Homo sapiens
  misc_feature: NA.40.87.H10.1.454.light.1.nb
  modified_base (129)..(129): a, c, t, g, unknown or other
  misc_feature (129)..(129): n is a, c, g, or t
agacaggattcaggacaatctccagcatggccggcttccctctcctcctcaccctcctcactcactgtgcagggtcctgggcccagtctgtgctgactcagccaccctcagcgtctgggacccccgggnagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgg

SEQ ID NO: 297518 - DNA, 362 bp, Homo sapiens
  misc_feature: NA.40.9.A09.1.454.light.1.nb
aggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctctttactgggcgtcttcccgggagtccggggtccctgaccgattcagtgccagcgggtctgggacagacttcactctcaccatcagcgcctgcaggctgaagatgtggctagtttattactgtcagcac

SEQ ID NO: 297519 - DNA, 216 bp, Homo sapiens
  misc_feature: NA.41.1.A01.1.454.light.1.nb
tcagtggcagtggatctgcgacagatttcaccctcaccatcaatagcctggaagctgaagatgctgcaacgtattactgtcatcagagtagtagtttacctcggcacttttggccaggggaccaagctggagatcaaacgaactgtggctgcaccatctgtcttcatcttcccgccatctgatatatactgtctgagcgggctggcaaggcgcata

SEQ ID NO: 297520 - DNA, 301 bp, Homo sapiens
  misc_feature: NA.41.16.B05.1.454.light.1.nb
taggacccagacggaaccatggaagccccagcgcagcttctcttcctcctgctactctggctcccagataccactggagacatagtgatgacgcagtctccagccaccctgtctgtgtctccgaggggagacagccaccctctcctgcagggccagtcagagtgttagtaacaacttagcatggtaccagcagaaacctggccaggctcccaggcctcctcatctatcgtgcgtccaccagggcaactggtactcccagccaggttcagtggcgttgggtctgggacagagttcactctca

SEQ ID NO: 297521 - DNA, 252 bp, Homo sapiens
  misc_feature: NA.41.17.B06.1.454.light.1.nb
cagcgctctcgggacgtctccaccatggcctgggctctgctgctcctcactctcctcacccaggacacagggtcctgggcccagtctgccctgactcagcctgcctccgtgtctgggtctgcctggacagtcggtcaccatctcctgcactggaccagcagtgacattggtggttataactatgtctcctggtatcaacaacatccaggcaaagcccccaaactcatacttttgagtccagtgagcggccgt

SEQ ID NO: 297522 - DNA, 426 bp, Homo sapiens
  misc_feature: NA.41.19.B08.1.454.light.1.nb
gcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggcctcagggtttctaatcgcttctctggctccaagtccggcgacacggcctccctgaccatctccggcctccaggcggaggacgagggtgattatttctgcagctcatttacaaccagccacaccttgctcttcggactgggaccacggtcatcgtcctaggtcagcccaaggccaa

SEQ ID NO: 297523 - DNA, 304 bp, Homo sapiens
  misc_feature: NA.41.2.A02.2.454.light.1.nb
aggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggccaggaaagcccctcaactcctgatctatgctgcgtccattttgcaaagtggggtcccatcaaggttcagtggcagtggatcgtgggacagatttcactctcaccatcagc

SEQ ID NO: 297524 - DNA, 172 bp, Homo sapiens
  misc_feature: NA.41.2.A02.3.454.light.1.nb
ggcagcgctctcgggacgtctccaccatggcctgggctctgctattcctcaccctcctcactcagggcacagggtcctgggcccagtctgccctgactcagcctgcctccgtgtctggttctcctggacagtcgatcaccatctcctgcactgggtccagcaatgacattgg

SEQ ID NO: 297525 - DNA, 85 bp, Homo sapiens
  misc_feature: NA.41.20.B09.1.454.light.1.nb
aatcaaacgaactgtggctgcaccatctgtcttcatcttcccgccatctgaatagtatagactgagcgggctggcaaggcgcata

SEQ ID NO: 297526 - DNA, 365 bp, Homo sapiens
  misc_feature: NA.41.23.C01.1.454.light.1.nb
ccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaacgaaaaagggggagaggcccctaaggtcctcgtctctcgtgaaaccagactggaaggtagagtcccgtcaggttcagtgccagtccaggtggtgggccggagtccactctcaccattagcgacctgcggcctgaagattctgcaacttatttctgtcagcagtatcatagt

SEQ ID NO: 297527 - DNA, 62 bp, Homo sapiens
  misc_feature: NA.41.24.C02.1.454.light.1.nb
tatgcgccttgccagcccgctcagtctatactatgaggagggcgggaacaggaacacgctag

SEQ ID NO: 297528 - DNA, 413 bp, Homo sapiens
  misc_feature: NA.41.25.C03.1.454.light.1.nb
agcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtagtattaagttggacgagggaccagggtcgtaccgtcgtaggtca

SEQ ID NO: 297529 - DNA, 124 bp, Homo sapiens
  misc_feature: NA.41.25.C03.3.454.light.1.nb
tgtgggcacaagaggcagcactcaggacaatctccagcatggcctggtctcctctcctcctcactctcctcgctcactgcacagggtcctgggcccactctgtgctgacgcagcccgccctcag

SEQ ID NO: 297530 - DNA, 246 bp, Homo sapiens
  misc_feature: NA.41.27.C05.1.454.light.1.nb
aagaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcacgtggagccagcggtaatattcttagtcttaactttgtctcctggtatcaacatcatccagtaaacgcccccaaatcatcatctatgagcct

SEQ ID NO: 297531 - DNA, 353 bp, Homo sapiens
  misc_feature: NA.41.34.D01.1.454.light.1.nb
gtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaacgcccctaaattcctgatctatcaggcatctaatttggaaagtggggtcccatcaaggtttagcggcagtggatcgtgggacagaattcactctcacgatcagcggcctgcagcctgatgatgtcgcaacttattactgaccaacacta

SEQ ID NO: 297532 - DNA, 257 bp, Homo sapiens
  misc_feature: NA.41.36.D03.3.454.light.1.nb
ctggggaggaactgctcagttaggacccagagggaaccatggaagccccagctcagcttctcttcctcctgctactctggctcccagactaccaccggaaaaattgtgttgacacagtctccaggcaccctgtctctgtctccgaggggagacagccaccctctcctgcagggccagtaggagtgtcagtaagtacttaggctggtaccaacagaaacctggccaggcctcccaggctcctcatccatgatgcatcc

SEQ ID NO: 297533 - DNA, 61 bp, Homo sapiens
  misc_feature: NA.41.41.D08.1.454.light.1.nb
tatgcgccttgccagcccgctcagtctatactatgaggagggcgggaacaggaacacgcta

SEQ ID NO: 297534 - DNA, 352 bp, Homo sapiens
  misc_feature: NA.41.42.D09.1.454.light.1.nb
  modified_base (137)..(137): a, c, t, g, unknown or other
  misc_feature (137)..(137): n is a, c, g, or t
  modified_base (256)..(256): a, c, t, g, unknown or other
  misc_feature (256)..(256): n is a, c, g, or t
ctcagttaggacccagacggaaccatggaagccccagcgcagcttctcttcctcctgctactctggctcccagatgtcactggagaaatagtgatgacgcagtctccagccaccctgtctgtgtctccaggggaaanagccaccctctcctgcagggccagtcagagtcttagcggcaccttagcctggtaccagcagaaacctggccaggctcccaggctcctcatctatggtacatccaccagggtcactggtnttccagccaggttcagtggcagtgggtccggacagagttcactctcaccatcagcagcctgcagtctgaagtattttgcgtatttattactgtcac

SEQ ID NO: 297535 - DNA, 345 bp, Homo sapiens
  misc_feature: NA.41.45.E01.1.454.light.1.nb
ggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgt

SEQ ID NO: 297536 - DNA, 205 bp, Homo sapiens
  misc_feature: NA.41.53.E09.1.454.light.1.nb
aggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaac

SEQ ID NO: 297537 - DNA, 343 bp, Homo sapiens
  misc_feature: NA.41.59.F04.1.454.light.1.nb
  modified_base (180)..(180): a, c, t, g, unknown or other
  misc_feature (180)..(180): n is a, c, g, or t
  modified_base (210)..(210): a, c, t, g, unknown or other
  misc_feature (210)..(210): n is a, c, g, or t
cagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggngctgttgcctggtttcaacaaaaagggggngaggcccctaaggtcctcgtctctcgtgaaaccagactggaagtagagtcccgtccaggttcagtgccagtccaggtggtgggccggagtccactctcacattagcgacctgcggcctgaagtattctgctaa

SEQ ID NO: 297538 - DNA, 333 bp, Homo sapiens
  misc_feature: NA.41.6.A06.1.454.light.1.nb
caacacaatttctccgagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagta

SEQ ID NO: 297539 - DNA, 95 bp, Homo sapiens
  misc_feature: NA.41.60.F05.1.454.light.1.nb
caggttcagtggcagtgggtcctgggacagagttcactctcaccatcagcggcctgcagtctgaggattttgcagtttattactgtcagcagtat

SEQ ID NO: 297540 - DNA, 58 bp, Homo sapiens
  misc_feature: NA.41.62.F07.1.454.light.1.nb
tatgcgccttgccagcccgctcagtctatactatgaggaggcggaacagaaacacgtc

SEQ ID NO: 297541 - DNA, 218 bp, Homo sapiens
  misc_feature: NA.41.65.F10.1.454.light.1.nb
tgctcagttaggacccagacggaaccatggaagccccagcgcagcttctcttcctcctgctactctggctcccagataccactggagaaatagtgatgacgcagtctccagccaccctgtctgtgtctccgaggggaaagagccaccctctcctgcagggccagtcagagtgttagcagcacttagcctggtaccagcagaaatcctggccaggctcc

SEQ ID NO: 297542 - DNA, 86 bp, Homo sapiens
  misc_feature: NA.41.70.G04.1.454.light.1.nb
aaatcaaacgaactgtggctgcaccatctgtcttcatcttcccgccatctgaatagtatagactgagcgggctggcaaggcgcata

SEQ ID NO: 297543 - DNA, 331 bp, Homo sapiens
  misc_feature: NA.41.71.G05.1.454.light.1.nb
ccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcacctcaccatcggcagcctgcagcctgaagatatcg

SEQ ID NO: 297544 - DNA, 211 bp, Homo sapiens
  misc_feature: NA.41.73.G07.1.454.light.1.nb
taggacccagagggaaccatggaagccccagctcagcttctcttcctcctgctactctggctcccagattccaccggcgaaattgtgttgacacaatctccagccaccctgtctttgtctccgggggaacagccaccctctctgcagggccggccagactgttgacgacgacttagcctggtaccaacagaagcctggccaggctcccaga

SEQ ID NO: 297545 - DNA, 428 bp, Homo sapiens
  misc_feature: NA.41.75.G09.1.454.light.1.nb
tcaggacacagcatggacatgagagtcctcgctcagctcctggggctcctgctgctctgtttccccggtgccaggtgtgacatcgagatgacccagtctccgtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgacttattactgccaacaattattcttttttatccgtactagttttggccaggggaccaagctggagatacaaaggactgtgctgcaccatctgtcttc

SEQ ID NO: 297546 - DNA, 161 bp, Homo sapiens
  misc_feature: NA.41.80.H03.1.454.light.1.nb
tccaaacaaagcaacaacaagtacgcggccagcagctacctgagcctgacgcctgagcagtggaagtcccacaaaagctacagctgccaggtcacgcatgaagggagcaccgtggagaagacagtggcccctacagaatgttcataggttctcaaccctca

SEQ ID NO: 297547 - DNA, 317 bp, Homo sapiens
  misc_feature: NA.41.81.H04.1.454.light.1.nb
tcaggacacagcatggacatgagggtccccgctcagctcctggggctcctgctgctctggctcccaggcgccagatgtgccatccagatgacccagtctccatcctcactgtctgcatctgtaggagacagagtcaccattacttgccgggcaagtcagggcattagaaatgatttagcctggtatcggcagaaaccaggaaaagcccctcagctcctcatctgtactgcatccactttacaaagtgggtcccatcaaggttcagcggcagtggatctggcacagatttcactctcaccatcagcagcctgcagcct

SEQ ID NO: 297548 - DNA, 112 bp, Homo sapiens
  misc_feature: NA.41.89.I01.1.454.light.1.nb
tgttcggcggagggaccaagctgaccgtcctaggtcagcccaaggctgccccctggtcactctgttcccgccctcctcatagtatagactgagcgggctggcaaggcgcata

SEQ ID NO: 297549 - DNA, 199 bp, Homo sapiens
  misc_feature: NA.41.9.A09.1.454.light.1.nb
aggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttggcagcagcgtagcctggttccagcagaaacctgg

SEQ ID NO: 297550 - DNA, 349 bp, Homo sapiens
  misc_feature: NA.42.10.A10.1.454.light.1.nb
  modified_base (131)..(131): a, c, t, g, unknown or other
  misc_feature (131)..(131): n is a, c, g, or t
taggacccagagggaaccatggaagtcccagctcagcttctcttcctcctgctactctggctcccagatagtaccggagagattgtgttgacacagtatccagccaccctgtctttgtctccaggggaaangccaccctctcctgttgggccagtcagagtattaacaactacttagcctggtaccagcagagacctggccaggctcccaggctcctcatttatgatgcatccaacagggccactggcatcccagccaggttcagtggcagtgggtctgggacagacttcactctcaccatcagcagattagagcctagaagtattttgctagtttactattgtcagca

SEQ ID NO: 297551 - DNA, 60 bp, Homo sapiens
  misc_feature: NA.42.13.B02.1.454.light.1.nb
tatgcgccttgccagccgctcagtgacgtatgtggaagtagtccttgaccaggcagctat

SEQ ID NO: 297552 - DNA, 327 bp, Homo sapiens
  misc_feature: NA.42.15.B04.1.454.light.1.nb
gtgggcacaagaggcagcactcaggacaatctccagcatggcctggtctcctctcctcctcactctcctcgctcactgcacaggctcctgggcccagtctgtgctgacgcagccgccctcagtgtctggggccccagggcagagggtcatcatttctgcacgtggggatggttccaacatcggggctaggttttgatgtacactggtaccagcagcttccagaaacagccccaagctcttcatctttggtaacaataatcggccctcaggggtccctggccgattctctgcctccaagtccggcacctcacgcctccctggccatca

SEQ ID NO: 297553 - DNA, 324 bp, Homo sapiens
  misc_feature: NA.42.2.A02.2.454.light.1.nb
caggacacagcttggacatgagggtccctgctcagctcctgggactcctgctgctctggctcccagataccagatgtgacatccagatgacccagtctccttcctccctgtctgcatctgtaggagacagaatcaccatcacttgccgggcagtcaggtcattggcgatttttagcctggtatcagcaaaaacctggcacagttcctaagctcctcatctttcctgcttctactttgcaatcagggtcccatctcgcttcagcggcggtggctcgtgggacagatttcactctcaccatcagcagcctgcagcctgaagatgtt

SEQ ID NO: 297554 - DNA, 404 bp, Homo sapiens
  misc_feature: NA.42.23.C01.1.454.light.1.nb
caacaggcaggcaggggcagcaagatggtgttgcagacccaggtcttcatttctctgttgctctggatctctggtgcctccggggacatcgtgatgacccagtctccagactccctggctgtgtctgtgggcgagagggccaccctcaactgcaagtccagccagagtcttacctacgacttcgacaataagtcctacttagcttggtatcagcagaaacccggacagcctcctaagctgctcatttactggtcttctacccgggaatccggggtccctgaccgattcactggcagcgggtctgggacagacttcactctcaccatcagcagcgttcagactgaagatgtggccgtctatttctgtcagcaatattactctagtttttttcctcggtccctggg

SEQ ID NO: 297555 - DNA, 379 bp, Homo sapiens
  misc_feature: NA.42.25.C03.1.454.light.1.nb
gctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgtagggccagtcagagtgtcagcacctacttagcctggtaccaacagaaacctggccaggctcccaggctcctcatctatagtgcttccaacagggccactgacatcccagccaggttcagaggcagtgggtctgggacagacttcactctcaccatcagcagcctggacgcctgaagatattgctagtttattactgtcagcagcgtagcagctggcctcggctcg

SEQ ID NO: 297556 - DNA, 114 bp, Homo sapiens
  misc_feature: NA.42.28.C06.1.454.light.1.nb
  modified_base (50)..(50): a, c, t, g, unknown or other
  misc_feature (50)..(50): n is a, c, g, or t
tctggggagtctgcaccatggcctggaccccactcctcctcctcttcccnctcctcctccactgcacaggtctctctcccagcctgtcgctgactcaatcatcctctgcctctg

SEQ ID NO: 297557 - DNA, 329 bp, Homo sapiens
  misc_feature: NA.42.33.C11.1.454.light.1.nb
gacccactcaggacacagcatggacatgagggtccccgctcagctccgtggggctcctgctgctctggctcccaggtgccagatgtgccatccagatgacccagtctccatcctccctgtctgcgtctgtcggagacagagtcaccattatttgccgggcaagtcagggcattagaaatgatttaggctggtatcagcagaagccagggaaagcccctaagctcctgatctatggtgcatccaatttacagattggggtcccacaggttcagcgccagtggctctggcgcagatttcactctcaccatcaacagcctgcagcctgaagt

SEQ ID NO: 297558 - DNA, 347 bp, Homo sapiens
  misc_feature: NA.42.37.D04.2.454.light.1.nb
tgtgttgacgcagccgccctcaatgtctgcggccccaggacagaaggtcaccatctcctgctctggaagcagctccaacattggaggtaattatgtctcctggtaccagcagctcccaagaacagcccccaaaacttctcatttatgacaatgataagcggccctcagggattcctgaccgattctctggctccaagtctggcacgtctgccaccctggccatcaccggactccagactggagacgaggccgattattactgcggaacgtgggataccagcctgagtgcggggctagttcggcggagggaccaagctgaccgtctaggtcagcccaaggctgcccct

SEQ ID NO: 297559 - DNA, 347 bp, Homo sapiens
  misc_feature: NA.42.37.D04.3.454.light.1.nb
ggtcccttccaatatcagcaccatggcctggactcctctctttctgttcctcctcacttgctgcccagggtccaatgctcagactgtggtcactcaggagccctcactgactgtgtcccccggagggacagtcactctcacatgtgctttattgactggaccagtcaccagttcttaccatccaaactggttccagcaaagacctggacacggccccacggcgttagtttatggtgcgactaacaagcactcctggacccctgcccggttttcaggctccctcgtcggggcaaagctgccctgactctgtccggtgttcagcctgaggacgaggctgactattactg

SEQ ID NO: 297560 - DNA, 311 bp, Homo sapiens
  misc_feature: NA.42.38.D05.1.454.light.1.nb
tgtgggcacaagaggcagcactcaggacaagctccagcatggcctggtctcctctcctcctcactctcctcgctcactgcacagggtcctgggcccagtctgtactgacgcagccgccctcagtgtctggggccccagggcagagggtcaccatctcctgcactgggaacaatttcaacatcggggcacgttatgatgttcactggtatcagcaacttccaggaacagccccaagctcctcatctatggtaataataatcggccctcacggggtccctgaccgattctctgtctccaggtctggcacctca

SEQ ID NO: 297561 - DNA, 335 bp, Homo sapiens
  misc_feature: NA.42.39.D06.1.454.light.1.nb
tcaggaagcagagcctggagcatctccactatggcctgggctccactacttctcaccctcctcgctcactgcacaggttcttgggccaattttatgctgactcagccccactctgtgtcggggtctccggggaagacggtaaccctctcctgcacccgcagcagtggcagcattgccaacaactatgtgcagtggttgcagcagcgcccgggcagttcccccaccactgtgatctatgaggataatcaaagacccctcgtggggtccctgatcggttctctggctccatcgacagttcctccaactctgccctccctcaccatctctggactgaa

SEQ ID NO: 297562 - DNA, 334 bp, Homo sapiens
  misc_feature: NA.42.45.E01.1.454.light.1.nb
cctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaagtctagtcaaagcctcgtgaacggtgatggaaacacctacttgaattggtttcagcagaggccaggccaatctccaaggcgcctaatttataaggtttctaaccgggactctggggtcccagacaggttcagcggcagtgggtcaggcactgatttcacactgaaaatcagcagggtggaggc

SEQ ID NO: 297563 - DNA, 311 bp, Homo sapiens
  misc_feature: NA.42.52.E08.1.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcagtaatcggcctcagggtttcaatcgcttctctggctccaagtctggcaacacggcctccctga

SEQ ID NO: 297564 - DNA, 334 bp, Homo sapiens
  misc_feature: NA.42.58.F03.1.454.light.1.nb
cccagtcaggacacagcatggacatgagggtccccgctcagctcctggggctcctgctgctctggctcccaggtgccagatgtgacatccagatgacccagtctccttccaccctgtctgcatctgttggagacacagtcatcatcacttgccgggcagtcagagtgttggaggctggttggcctggtatcagacaaaaaccgagggaaacgcccctaaactcctagatttcaaggcatctactttagaaggtcgagtcccatcaaggttcagcgcaatagatttgggacagaattcactctcaccatcagcagcctgcagcctgatgtatttt

SEQ ID NO: 297565 - DNA, 346 bp, Homo sapiens
  misc_feature: NA.42.81.H04.1.454.light.1.nb
gagggaaccatggaaaccccagcgcagcttctcttcctcctgctactctggctcccagataccaccggagaaattgtgttgacgcagtctccaggcatcctgtctttgtctccaggggaaagagccaccctctcctgcagggccagtcagggtgttgacagcaactacttagcctggtaccagcagaaacctggccaggctcccaggctcctcatctatgctgcatccaccagggccactgacatcccagacaggttcattggcgctgggtctgggacagacttcactctcaccatcgagacactggagcctgatgattttgcagtgtatcactgtcagcagtatg

SEQ ID NO: 297566 - DNA, 379 bp, Homo sapiens
  misc_feature: NA.42.86.H09.1.454.light.1.nb
gtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtcttagtcgg

SEQ ID NO: 297567 - DNA, 151 bp, Homo sapiens
  misc_feature: NA.43.11.A11.1.454.light.1.nb
ctcaggaagcagcatcggaggtgcctcagccatggcatggatccctctcttcctcggcgtccttgcttactgcacaggatccgtggccgcctatgagttgactcagccaccctcagtgtccgtcgtccccgaaggacacgaccacgccagc

SEQ ID NO: 297568 - DNA, 367 bp, Homo sapiens
  misc_feature: NA.43.14.B03.1.454.light.1.nb
gaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatac

SEQ ID NO: 297569 - DNA, 323 bp, Homo sapiens
  misc_feature: NA.43.19.B08.1.454.light.1.nb
agcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccacctggccatcagcagggtcgaaggccgggat

SEQ ID NO: 297570 - DNA, 221 bp, Homo sapiens
  misc_feature: NA.43.22.B11.2.454.light.1.nb
tctggctccaagtctggcacgtcagccaccctgggcatcaccggactccagactggggacgaggccgattattactgcggaacatgggacagcagcctgaatacttgggtgttcggcggagggaccaggctgaccgtcctaagtcagcccaaggctgccccctcggtcactctgttcccacctcctcactactcacactgagcgggctggcaaggcgcata

SEQ ID NO: 297571 - DNA, 231 bp, Homo sapiens
  misc_feature: NA.43.23.C01.2.454.light.1.nb
caggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactga

SEQ ID NO: 297572 - DNA, 366 bp, Homo sapiens
  misc_feature: NA.43.33.C11.1.454.light.1.nb
gtctctctcagtcaggacacagcatggacatgagggtccctgctcagctcctgggactcctgctgctctggctcccagattccagatgtgacatccagatgacccagtcgccagcctccctgtctgcaagtgtgggagacagagtctaccctttttgccgggcgagtcggcccattgacgactgtttggcctggtatcgcgtgagaccagggcaacctcctcaacttctgatataccgttcatcgctgttgcacgttgggtcccacctcggttcagtggcaacggctctgagacagtatttttctctcgtcatcactggtctacagtctgacgacggcgcaatgtacttctgtcaacactatcgcc

SEQ ID NO: 297573 - DNA, 498 bp, Homo sapiens
  misc_feature: NA.43.34.D01.1.454.light.1.nb
caagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaatcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgccctcctcactactcacactgagcgggctggcaaggcgcata

SEQ ID NO: 297574 - DNA, 327 bp, Homo sapiens
  misc_feature: NA.43.42.D09.1.454.light.1.nb
gctcagttaggacccagagggaaccatggaaaccccagcgcagcttctcttcctcctgctactctggctcccagactaccaccggagaaattgtgttgacgcagtctccaggcaccctgtctttgtctccaggggaaaggccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcc

SEQ ID NO: 297575 - DNA, 250 bp, Homo sapiens
  misc_feature: NA.43.5.A05.2.454.light.1.nb
ccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccacggccccccggacactgatttatgatacaagcaacaaactttcc

SEQ ID NO: 297576 - DNA, 353 bp, Homo sapiens
  misc_feature: NA.43.55.E11.1.454.light.1.nb
agacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaacgcccctaggttcctgatctataaggcatctaatttagaaagtgggtacccattaaggttcagcggcagtggatcgtgggacagagtttactctcaccatcagcagcctgcagcctgatgattttgactaacttattactg

SEQ ID NO: 297577 - DNA, 390 bp, Homo sapiens
  misc_feature: NA.43.59.F04.1.454.light.1.nb
ggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaacgcccccaaactcttgatttatgatgtcacttatcggccctcagggtttctatcgcttctctggctccaagtctggcaacacggcctccctgaccatctctgggctccagctgaggacgaggctgat

SEQ ID NO: 297578 - DNA, 361 bp, Homo sapiens
  misc_feature: NA.43.6.A06.1.454.light.1.nb
ggcaggggcagcaagatgatgctgcagacccaaatcttcatttctctgctgctctggatctctggtgtccccggagacatcgtcttgacccaggcacccgcctcactgagcctgtctctgggcgagagggccgtcatcacctgctcgtccaaccagggtctttcatacaacttatatgaatatttggcctggttccagcagaggcccggccgctctccaagacttctcctgtctggggcttgtcatcgggaagccggagtccctgaccgcttctctggcggcggctctggaagaaacttcactctcaccatctctgccctggagactgatgacgtggctacttattactgtcaacagtgtt

SEQ ID NO: 297579 - DNA, 332 bp, Homo sapiens
  misc_feature: NA.43.60.F05.1.454.light.1.nb
cactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagtattttg

SEQ ID NO: 297580 - DNA, 380 bp, Homo sapiens
  misc_feature: NA.43.69.G03.1.454.light.1.nb
gtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggctaatttgttattggtaccagcagaagccagccaggcccctgtgttggtgatgtataaagacagtgagaggccctcagggatccctgagcgattctctggcgccagctcaggaacagtagtcacgttgaccatcagtggagtccaggcagaagacgaggctgactattattgtacaagcagtagacagcagtgtccttagtcggt

SEQ ID NO: 297581 - DNA, 403 bp, Homo sapiens
  misc_feature: NA.43.71.G05.1.454.light.1.nb
accatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcacactgagcggctggcaaggcg

SEQ ID NO: 297582 - DNA, 346 bp, Homo sapiens
  misc_feature: NA.43.72.G06.1.454.light.1.nb
caggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcggaccaggctatggatgaggctgacttttactgtc

SEQ ID NO: 297583 - DNA, 345 bp, Homo sapiens
  misc_feature: NA.43.73.G07.1.454.light.1.nb
agcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccgaagggggatggcatccctgatcggttctcagtcttgggctcaggcctgactcggtccctgaccatcaacaacatccaggaagaggatgacagt

SEQ ID NO: 297584 - DNA, 239 bp, Homo sapiens
  misc_feature: NA.43.77.G11.1.454.light.1.nb
tgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcacgcccccaaact

SEQ ID NO: 297585 - DNA, 286 bp, Homo sapiens
  misc_feature: NA.43.79.H02.2.454.light.1.nb
gctgtggtagagaagacaggattcaggacaatctccagcatggccggcttccctctcctcctcaccctcctcactcactgtgcagggtcctgggcccagtctgtgctgactcagtcaccctcagcgtctgggacccccgggagagggtcaccatctcttgttctggaagcagctccaacatcggaagtaattatgtatattggtaccagcagctcccaagaaccggcccccaaattcctcatctataggaataatcagcgccctcaggggtccctgaccgattctc

SEQ ID NO: 297586 - DNA, 365 bp, Homo sapiens
  misc_feature: NA.43.86.H09.1.454.light.1.nb
caggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattactg

SEQ ID NO: 297587 - DNA, 277 bp, Homo sapiens
  misc_feature: NA.43.87.H10.1.454.light.1.nb
ctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccaggccaccctcccaaactcctatcctacaggaataacaaccggccctcagggatctcagagagattatctgcatccaggtcaggaaacacagcctccctagacc

SEQ ID NO: 297588 - DNA, 188 bp, Homo sapiens
  misc_feature: NA.44.1.A01.1.454.light.1.nb
tggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaacagtataagagttattctcagag

SEQ ID NO: 297589 - DNA, 106 bp, Homo sapiens
  misc_feature: NA.44.1.A01.3.454.light.1.nb
cagtggcagtggatctgcgacagatttcaccctcaccatcaatagcctggaagctgaagatgctgcaacgtattactgtcatcagagtagtagtttacctcggcac

SEQ ID NO: 297590 - DNA, 200 bp, Homo sapiens
  misc_feature: NA.44.1.A01.6.454.light.1.nb
cctcaccctcctcactcagggcacagggtcctgggcccagtctgccctgactcagcctgcctccgtgtctgggtcacctggacagtcgatcaccatctcctgcattggaaccagcagtgacattggtagttataactatgtctcctggtaccaacaacacccaggcaaacgcccccaaatcatgattcatgatgtcagta

SEQ ID NO: 297591 - DNA, 345 bp, Homo sapiens
  misc_feature: NA.44.10.A10.1.454.light.1.nb
cagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtccctggccgtttttcggcctccagttctgaccacgcggcctccctgaccatcaccaaactccggcctgaggatgaggctgactac

SEQ ID NO: 297592 - DNA, 335 bp, Homo sapiens
  misc_feature: NA.44.10.A10.2.454.light.1.nb
tcctgcagggccagtcagaatattggcgccgactacttagcctggtaccagcagagacctggccagcctcccaggctcctcatccacggtgcatccaacagggccactggcgtccctgacaggttcagtggcagtgggtctgggacagacttcactctcaccatcagcagcctggagcctgaagattttgtgatgtattactgtcatttccatggtcccttactcgaacttttggccaggggaccaaactggaaatcaaacgaactgtggctgcaccatctgtcttcatcttcccgcatctgatatatactgtctgagcgggctggcaaggcgca

SEQ ID NO: 297593 - DNA, 321 bp, Homo sapiens
  misc_feature: NA.44.10.A10.3.454.light.1.nb
gacacagcatggacatgagggtccccgctcagctcctggggctcctgctactctggctccgaggtgccagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatcgtgggacagatttcactctcaccatccagtctgcaacctgaagattt

SEQ ID NO: 297594 - DNA, 323 bp, Homo sapiens
  misc_feature: NA.44.10.A10.4.454.light.1.nb
taggacccagacggaaccatggaagccccagcgcagcttctcttcctcctgctactctggctcccagataccactggagaaatagtgatgacgcggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtggcagtgggtctgggacagagttcactctcaccatcagcagcctgcagtctgaag

SEQ ID NO: 297595 - DNA, 164 bp, Homo sapiens
  misc_feature: NA.44.10.A10.6.454.light.1.nb
taggacccagacggaaccatggaagccccagcgcagcttctcttcctcctgctactctggctcccagataccaccggagaaattgtgttgacgcagtctccaggcaccctgtctttgtctccaggggaagagccaccctctcctgcagggccagtcagagtgtt

SEQ ID NO: 297596 - DNA, 299 bp, Homo sapiens
  misc_feature: NA.44.11.A11.1.454.light.1.nb
taggacccagacggaaccatggaagccccagcgcagcttctcttcctcctgctactctggctcccagacaccactggagaaatagtgatgacgcagtctccagccaccctgtctctgtctccgaggggaaagagccaccctctcctgcagggccagtcagagtgttggcagcagcgtagcctggttccagcagaaacctggccagactcccaggctcctcatctataccacatccaccagggccactggtactcccagccagattcagtgcactgggtctgggacagagttcactctca

SEQ ID NO: 297597 - DNA, 243 bp, Homo sapiens
  misc_feature: NA.44.11.A11.2.454.light.1.nb
  modified_base (185)..(185): a, c, t, g, unknown or other
  misc_feature (185)..(185): n is a, c, g, or t
ggcgaaattgtgttgacacaatctccagccaccctgtctttgtctccgggggaacgagccaccctctcttgcagggccgccagactgttgacgacgacttagcctggtaccaacagaagcctggccaggctcccagactcctcatctatgatacttctagtagggcctctggcatcccagcccgnttcagtgcaggtgggtctgggacagacttcactctcaccatcaccagcctagacgcct

SEQ ID NO: 297598 - DNA, 204 bp, Homo sapiens
  misc_feature: NA.44.11.A11.3.454.light.1.nb
ctgatctatagggcgtctaacttggaaagtggggtcccctcgagattcagcgcaagtggttccgggacaatattcactctcaccatcaacagcctgcagcctgaagacactgcaacttattactgccaacactatgatggttcttctccgtactacttttggccaggggacgaagctggagatcaaacgactgtggctgcacca

SEQ ID NO: 297599 - DNA, 183 bp, Homo sapiens
  misc_feature: NA.44.11.A11.4.454.light.1.nb
  modified_base (171)..(171): a, c, t, g, unknown or other
  misc_feature (171)..(171): n is a, c, g, or t
gcgctctcgggacgtctccaccatggcctgggctctgctgctcctcactctcctcactcaggacacagggtcctgggcccagtctgccctgactcagcctgcctccgtgtctggttctcctggacagtcgatcacctctcctgcactgggtccagcaatgacagttggganatataaccttgt

SEQ ID NO: 297600 - DNA, 355 bp, Homo sapiens
  misc_feature: NA.44.12.B01.4.454.light.1.nb
tcctggaaggtgttggtaccagagggtcaccatctcctgcactgggagcagatccaacatcgggacagattctgatgtccactggtaccaacaccttccaggaacagcccccaaatcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgcctcctctata

SEQ ID NO: 297601 - DNA, 316 bp, Homo sapiens
  misc_feature: NA.44.12.B01.5.454.light.1.nb
agcagagcctggagcatctccactatggcctgggctccactacttctcaccctcctcgctcactgcacaggttcttgggccaattttatgctgactccaccccccctctgtgtcggagtctccggggaagacggtaaccatctcctgcacccgcagcactggcagcattgccagcaactttgtgcagtggtaccagcagcgcccgggcagtgcccccacactgtgatctatgaggatacccaacgaccctcgtggggtcccctgatcggttctctggctccatcgacagctcctccaactctcgccctccctcacc

SEQ ID NO: 297602 - DNA, 259 bp, Homo sapiens
  misc_feature: NA.44.17.B06.2.454.light.1.nb
cagcgctctcgggacgtctccaccatggcctgggctctgctgctcctcactctcctcactcaggacacagggtcctgggcccagtctgccctgactcagcctgcctccgtgtctgggtatcctggacagtcgatcaccttctcctgcactggactcagcagtgaggctcaacttcttaatgtcgcctcctggtatcaacaacatcccggacaaaccccccaaactcttgattcatgaaatctctaagcggccctctggg

SEQ ID NO: 297603 - DNA, 319 bp, Homo sapiens
  misc_feature: NA.44.18.B07.1.454.light.1.nb
  modified_base (313)..(313): a, c, t, g, unknown or other
  misc_feature (313)..(313): n is a, c, g, or t
ggtagactgggtcatctagatgtgacatccagatgacccagtctcccttcctccctgtctgcttctataggagactagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgcaacttactactgtcaacagagttatactgccccgttnactttt

SEQ ID NO: 297604 - DNA, 275 bp, Homo sapiens
  misc_feature: NA.44.19.B08.2.454.light.1.nb
attcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggcacaaacgcccccaaactcatgattcatgatgtcagtaatcggccctaggggtttctggtcgcttctctggctcaagtctggcaacacggcctccctgaccatctct

SEQ ID NO: 297605 - DNA, 196 bp, Homo sapiens
  misc_feature: NA.44.19.B08.3.454.light.1.nb
  modified_base (134)..(134): a, c, t, g, unknown or other
  misc_feature (134)..(134): n is a, c, g, or t
gctcctcactctcctcactcaggacacagggtcctgggcccagtctgccctgactcagcctgcctccgtgtctggttctcctggacagtcgatcaccatctcctgcacgtgggtccagcaatgacagttggganatataaccttgtctcctggtatcaacaacatccaggcaaacgccccaaactcatacttttga

SEQ ID NO: 297606 - DNA, 307 bp, Homo sapiens
  misc_feature: NA.44.2.A02.1.454.light.1.nb
aggacacagcatgcacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggaactctttaaattggtatcagcagaggccagggaaagcccctcaactcctgatctatgctgcgtccattttgcaaagtgggtccatcaaggttcagtgcagtgatctgggacagatttcactctcaccatcagcagtctgc

SEQ ID NO: 297607 - DNA, 254 bp, Homo sapiens
  misc_feature: NA.44.2.A02.2.454.light.1.nb
aggcagcgctctcgggacgtctccaccatggcctgggctctgctattcctcaccctcctcactcagggcacagggtcctgggcccagtctgccctgactcagcctgcctccgtgtctgggtcacctggacagtcgatcaccatctcctgcattggaaccagcagtgacattggtggttataactatgtctcctggtaccaacaacacccaggcaaagcccccaaactcatgattcatgatgtcagtaatcggcc

SEQ ID NO: 297608 - DNA, 308 bp, Homo sapiens
  misc_feature: NA.44.21.B10.1.454.light.1.nb
gcagcgctctcaggacgtcaccaccatggcctgggctctgctcctcctcaccctcctcactcagggcacagggtcctgggcccagtctgccctgactcagcctccctccgcgtccgggtctcttggacagtcagtcaccatctcctgcactggaaccagcagtgacattggtggttataactttgtctcctggtaccaacaccacccaggcaaagcccccaaattcatcatttatgatgtcagtaagcggccctcaggggtttctgatcgcttctctggctccaagtctggcaacacggcctccctga

SEQ ID NO: 297609 - DNA, 35 bp, Homo sapiens
  misc_feature: NA.44.23.C01.1.454.light.1.nb
accctcatgtccatgctgtcccctgacagggtctg

SEQ ID NO: 297610 - DNA, 340 bp, Homo sapiens
  misc_feature: NA.44.23.C01.2.454.light.1.nb
  modified_base (297)..(297): a, c, t, g, unknown or other
  misc_feature (297)..(297): n is a, c, g, or t
ccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcgggctgttgcctggtttcaacgaaaagggggaaggcccctaaggtcctcgtctctcgtgaaaccagactggaaggtagagtcccgtcaggttcagtgccagtccaggtggtgggccggagtccactctcaccattagcgacctgcggcctgaagnttctgctaacttatttctgtcagcagtatcatagtgccccgtt

SEQ ID NO: 297611 - DNA, 201 bp, Homo sapiens
  misc_feature: NA.44.23.C01.3.454.light.1.nb
ccccgctcagctcctggggctcctgctgctctggctcccaggttcgagatgtgacatcgagatgacccagtctccgtcctcactgtctgcgtctattggggacagagtcaccatcacttgccgggcgagtgccgacattaggactttttggccttggtttcagcaggagcctggcaaagcccctaagtccctgatcttttc

SEQ ID NO: 297612 - DNA, 45 bp, Homo sapiens
  misc_feature: NA.44.25.C03.1.454.light.1.nb
acacctcccccgtgcccaaggtgcccagagcccaaatcttgtgac

SEQ ID NO: 297613 - DNA, 96 bp, Homo sapiens
  misc_feature: NA.44.25.C03.12.454.light.1.nb
gtctccactcccgccttgacggggctgctatctgcctccctggccatcactgggctccaggctgaggacgaggctgactatttctgctcctcatat

SEQ ID NO: 297614 - DNA, 10 bp, Homo sapiens
  misc_feature: NA.44.25.C03.5.454.light.1.nb
tatatactgt

SEQ ID NO: 297615 - DNA, 24 bp, Homo sapiens
  misc_feature: NA.44.25.C03.6.454.light.1.nb
tatgcgccttgccagcccgctcag

SEQ ID NO: 297616 - DNA, 19 bp, Homo sapiens
  misc_feature: NA.44.25.C03.8.454.light.1.nb
gtcacaagatttgggctct

SEQ ID NO: 297617 - DNA, 508 bp, Homo sapiens
  misc_feature: NA.44.25.C03.9.454.light.1.nb
tgtgggcacaagaggcagcactcaggacaatctccagcatggcctggtctcctctcctcctcactctcctcgctcactgcacagggtcctgggcccactctgtgctgacgcagccgccctcagtgtctggggccccgggcagagggtcaccatctcctgcactgggagcagatccaacatcgggacagattctgatgtccactggtaccaacaccttccaggaacacgcccccaaactcctcatctttggtaacaactatcggccctcaggggtccctgaccgattctctggctccaagtctggcacctcagcctccctggccatcactgggctccaggctgaagatgagggtgattattactgccagtcctatgacagcagcctcagtggttgggtgttcggcggagggaccaagctgaccgtcctgggtcagcccaaggctgccccctggtcactctgttcccgccctcctctatatactgtctgagcgggctggcaaggcgcata

SEQ ID NO: 297618 - DNA, 481 bp, Homo sapiens
  misc_feature: NA.44.26.C04.1.454.light.1.nb
cccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtagttggttggcctggtatcagcagaaaccagggaaagcccctaaactcctgatctataaggcatctagtttggaaagtgggtcccatcaaggttcagcggcagtggatctgggacagaattcgctctcaccatcagcagcctgcagcctgatgattttgcaacttattactgccaacagtataagagttattctcagagttttggccaagggacacgactggagattaaacgaactgtggctgcaccatctgtcttcatcttcccgccatctgatatatactgtctgagcgggctggcaaggcgcata

SEQ ID NO: 297619 - DNA, 57 bp, Homo sapiens
  misc_feature: NA.44.27.C05.1.454.light.1.nb
caagaggcagcgctctcgggacgtctccaccatggcctgggctctgctgctcctcac

SEQ ID NO: 297620 - DNA, 102 bp, Homo sapiens
  misc_feature: NA.44.27.C05.2.454.light.1.nb
tctcctcacccaggacacagggtcctgggcccagtctgccctgactcagcctgcctccgtgtctgggtcgcctggacagtcggtcaccatctcctgcactgg

SEQ ID NO: 297621 - DNA, 215 bp, Homo sapiens
  misc_feature: NA.44.27.C05.3.454.light.1.nb
agccagcggtaatattcttagtcttaactttgtctcctggtatcaacatcatccaggtaaagcccccaaactcatcatctatgaggcctataagaggccctcaggggtttctaatcgcttcactgcctcaagtccggcaacacggcctccctgacaatctctgggctccaggctgaggacgaggctgattattattgttgctcagatgttcgtcg

SEQ ID NO: 297622 - DNA, 125 bp, Homo sapiens
  misc_feature: NA.44.27.C05.4.454.light.1.nb
aaccagcagtgacattggtgttataactatgtctcctggtaccaacaacaccaggacaaacgcccccaaactcatgattcatgatgtcagtaatccggccctcgacggggtccctgaccgtattc

SEQ ID NO: 297623 - DNA, 180 bp, Homo sapiens
  misc_feature: NA.44.27.C05.5.454.light.1.nb
ctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcacgaccccagaaacacgcccccaaactcatta

SEQ ID NO: 297624 - DNA, 267 bp, Homo sapiens
  misc_feature: NA.44.27.C05.7.454.light.1.nb
gggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggacctgtcaccagtggtctacttttccctactggctccaacagaagcctggccaacgccccccaggacactaatttatgatataactattagacagtcctggacacct

SEQ ID NO: 297625 - DNA, 212 bp, Homo sapiens
  misc_feature: NA.44.27.C05.8.454.light.1.nb
  modified_base (163)..(163): a, c, t, g, unknown or other
  misc_feature (163)..(163): n is a, c, g, or t
  modified_base (173)..(173): a, c, t, g, unknown or other
  misc_feature (173)..(173): n is a, c, g, or t
aagaggcagcactcaggacaatctccagcatggcctggtctcctctcctcctcactctcctcgctcactgcacagggtcctgggcccactctgtgctgacgcagccgccctcagtgtcgtggggcccccggggcaggagggtcaccatctcctgcactgggancagatccaanatcgggacagattctgatgtccactggtaccaacacctt

SEQ ID NO: 297626 - DNA, 87 bp, Homo sapiens
  misc_feature: NA.44.27.C05.9.454.light.1.nb
gactgacggtcctgccacagcggccctgggctgcctggtcaaggactacttcctatatactgtctgagcgggctggcaaggcgcata

SEQ ID NO: 297627 - DNA, 448 bp, Homo sapiens
  misc_feature: NA.44.3.A03.1.454.light.1.nb
gcagcactctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagtctctatcatggtacgcagtggtcccgggccgagcccccaaagtcctcttttacgacgtcctttcgcgggcttcggcagtccctggccgtttttcggcctccagttctgaccacgcggcctccctgaccatcaccaaactccggcctgaggatgaggctgactacttttgttgtgcatatttcgattcactcaaatatgtcttcggaagtgggacccgcgtcagcgtcctgcgtcacgcccaaggcccaaccccactcgtcactctg

SEQ ID NO: 297628 - DNA, 219 bp, Homo sapiens
  misc_feature: NA.44.3.A03.2.454.light.1.nb
gaactgctcagttaggacccagacggaaccatggaagccccagcgcagcttctcttcctcctgctactctggctcccagacaccactggagaaatagtgatgacgcagtctccagccaccctgtctctgtctccgaggggaaagccaccctctcctgcagggccagtcagagtgttggcagcagcgtagcctggtccagcagaacctggccagactccc

SEQ ID NO: 297629 - DNA, 87 bp, Homo sapiens
  misc_feature: NA.44.30.C08.2.454.light.1.nb
tatgcgccttgccagcccgctcagacagtatatatcagatggcgggaagatgaagacagatggtgcagccacagttcgtttgatttc

SEQ ID NO: 297630 - DNA, 319 bp, Homo sapiens
  misc_feature: NA.44.33.C11.1.454.light.1.nb
tcagcttcagctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggagtccaatatcggatcttatcctgtcaactggtatcggggactcccaggcacggcccccgactccttatctatgctactaatcagcggccctcgacggggtccctgcccgattctctggctccaagtctggcactaca

SEQ ID NO: 297631 - DNA, 245 bp, Homo sapiens
  misc_feature: NA.44.33.C11.2.454.light.1.nb
aagaggcagcgctctcgggacgtctccaccatggcctgggctctgctgctcctcactctcctcactcaggacacagggtcctgggcccagtctgccctgactcagcctgcctccgtgtctggttctcctggacagtcggtcaccatctcctgcactggagccagcggtcagcccaaggctgccccctggtcactctgttcccaccctcctctatatactgtctgagcgggctggcaaggcgcata

SEQ ID NO: 297632 - DNA, 322 bp, Homo sapiens
  misc_feature: NA.44.34.D01.1.454.light.1.nb
ctctctcagtcaggacacagcatggacatgagggtccctgctcagctcctgggactcctgctgctctggctcccagatactagatgtgacttccagatgacccagtctccatcctccctgtctgcatctgtgggaacagagtcaccatcacttgccgggcgagtcaggccattagcaattatttagcctggtatcagcagaaaccagggaaacctcctaacctcctgatctttgctgcatccactttgcaatcaggggtcccatctcggttcagcggcagtggatctgggacagatttctctctcaccatcagcagcctgca

SEQ ID NO: 297633 - DNA, 342 bp, Homo sapiens
  misc_feature: NA.44.36.D03.1.454.light.1.nb
  modified_base (152)..(152): a, c, t, g, unknown or other
  misc_feature (152)..(152): n is a, c, g, or t
ctggggaggaactgctcagttaggacccagacggaaccatggaagccccagcgcagcttctcttcctcctgctactctggctcccagataccactggagaaatagtgatgacgcggtctccagccaccctgtctgtgtctccgaggggaaangcccaccctctcctgcagggccagtcagagtgttagcagcaacttagcctcgtaccagcagaaatctggccaggcctcccaggcctcctcatctatggtgcatccaccagggccactggtactcccagccaggttcagtggcaggtgggtctgggacagagttcactctcacatcagcagcctgcagtct

SEQ ID NO: 297634 - DNA, 135 bp, Homo sapiens
  misc_feature: NA.44.36.D03.6.454.light.1.nb
cttcagctgtgagcgcagaaggcaggactcgggacaatcttcatcatgacctgctcccctctcctcctcacccttctcattcactgcacagggtcctgggcccagtctgtgttgacgcagccgccctcagtcgtc

SEQ ID NO: 297635 - DNA, 91 bp, Homo sapiens
  misc_feature: NA.44.36.D03.7.454.light.1.nb
gcttcagctgtgggcacaagaggcagcactcaggacaatctccagcatggcctggtctcctctcctcctcactctcctcgctcactgcacg

SEQ ID NO: 297636 - DNA, 75 bp, Homo sapiens
  misc_feature: NA.44.37.D04.1.454.light.1.nb
tgctcagttaggacccagagggaaccatggaagccccagctcagcttctcttcctcctgctactctggctcccag

SEQ ID NO: 297637 - DNA, 411 bp, Homo sapiens
  misc_feature: NA.44.37.D04.2.454.light.1.nb
agatcaccggagatattgtgttgacacagtctccaggcaccctgtctttgtctccgaggggagagagccaccctctcctgtagggccagtcggagtgttgctaagtacctagcctggtaccaacagaaacctggccaggctcccaggctcctcatctatgatgcatccaacagggtcactggcaccccagacaggttcagtggcagtgggtctgggacagacttcactctcaccgtcagcaatgtacagcctgaagattttgcagtttattactgtcagcagcgttcctccaggccgctcactttcggcggggggaccaaggtggagatcagacgaactgtggctgcaccatctgtcttcatcttcccgccatctgatatatactgtctgagcgggctggcaaggcgcata

SEQ ID NO: 297638 - DNA, 139 bp, Homo sapiens
  misc_feature: NA.44.37.D04.3.454.light.1.nb
  modified_base (65)..(65): a, c, t, g, unknown or other
  misc_feature (65)..(65): n is a, c, g, or t
ataccactggagaaatagtgatgacgcagtctccagccaccctgtctgtgtctccaggggaaagngccaccctctcctgcagggccagtcagagtgttaggcagcagcgtagcctggtaccagcagaaacctggccaga

SEQ ID NO: 297639 - DNA, 238 bp, Homo sapiens
  misc_feature: NA.44.38.D05.2.454.light.1.nb
aaggaagcagcactggtggtgcctcagccatggcctggacctttctcctcctcggcctcctctctcactgcacaggctctgtgacctcctatgtgctgactcagccaccctcagtgtcagtggccccaggaaagacggccaggattacctgtgggggaaacaacattaggaagtaaaagtgtgcactggtaccagcagaagccaggccaggcccctgtgctggtcatctattatgata

SEQ ID NO: 297640 - DNA, 126 bp, Homo sapiens
  misc_feature: NA.44.38.D05.7.454.light.1.nb
agtgatcatcgggtgttcggcggagggaccaagctgaccgtcctaggtcagcccaaggctgccccctcggtcactctgttcccgccctcctctatatactgtctgagcgggctggcaaggcgcata

SEQ ID NO: 297641 - DNA, 12 bp, Homo sapiens
  misc_feature: NA.44.39.D06.1.454.light.1.nb
gctgcctcctga

SEQ ID NO: 297642 - DNA, 325 bp, Homo sapiens
  misc_feature: NA.44.39.D06.2.454.light.1.nb
actctcgggacgtctccaccatggcctgggctctactcctcctcagcctcctcactcagggcacagggtcctggggactgtctaccctgactcagccgccctcagtgtccgggactcctggtcagtcggtcaccatcttctgttcttccagcgacaattccactggccctttaaagctctatcatggtacgcagtggtcccgggccgagcccccaaagtcctcttttacgacgtcctttcgcgggcttcggcagtccctggccgtttttcggcctccagttctcgaccacgcggcctccctgaccatcaccaaactccggcctga

SEQ ID NO: 297643 - DNA, 363 bp, Homo sapiens
  misc_feature: NA.44.39.D06.4.454.light.1.nb
gcaggcaggggcagcaagatggtgttgcagacccaggtcttcatttctctgttgctctggatctctggtgcctgcggggacatcgcgatgagccagtctccagactccctggctgtgtctctgggcgagagggccaccgtcaactgcaactccagccaaagtgtcttttatcgtccccaatagtaagaactatttagcctggtaccaacagaaaccgggacagtctcctaaattactcttttattgggcatctactcgggagtccgggtccctgaccgattcagtggcggcgggtctgggacacatttcactctcaccatcagtagcctgcaggctgaagacgtggcagtttattattgtcaa

SEQ ID NO: 297644 - DNA, 182 bp, Homo sapiens
  misc_feature: NA.44.39.D06.6.454.light.1.nb
tcaggaggcagcactctcgggacgtctccaccatggcctgggctctgctattcctcaccctcctcactcagggcacagggtcctgggcccagtctgccctgactcagcctgcctccgtgtctgggtcatcctggacagtcgatcaccatctcctgcactgggtccagcaatgacagttggga

SEQ ID NO: 297645 - DNA, 169 bp, Homo sapiens
  misc_feature: NA.44.39.D06.7.454.light.1.nb
ggctgacgatgaggctgattattactgcagctccgatggaggcacctatgatttgcttttcggcggagggaccagactgaccgtcctaggtcagcccaaggctgccccctcggtcactctgttcccgccctcctctatatactgtctgagcgggctggcaaggcgcata

SEQ ID NO: 297646 - DNA, 165 bp, Homo sapiens
  misc_feature: NA.44.39.D06.8.454.light.1.nb
  modified_base (127)..(127): a, c, t, g, unknown or other
  misc_feature (127)..(127): n is a, c, g, or t
caggaggcagcgctctcgggacgtctccaccatggcctgggctctgctgctcctcactctcctcacccaggacacagggtcctgggcccagtctgccctgactcagcctgcctccgtgtctgggtcncctggacagtcgatcaccttctcctgcactggagccag

SEQ ID NO: 297647 - DNA, 313 bp, Homo sapiens
  misc_feature: NA.44.41.D08.1.454.light.1.nb
gctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctcccaggctcctcatctatgatgcatccaatagggccgcgggcatcccagccaggttcagtggcagtggtctgagacagacttcactctcaccatcagcg

SEQ ID NO: 297648 - DNA, 157 bp, Homo sapiens
  misc_feature: NA.44.42.D09.2.454.light.1.nb
agaggcagcgctctcgggacgtctccaccatggcctgggctctgctgctcctcactctcctcactcaggacacagggtcctgggcccagtctgccctgactcagcctgcctccgtgtctggttctcctggacagtcgatcaccatctcctgcactgg

SEQ ID NO: 297649 - DNA, 87 bp, Homo sapiens
  misc_feature: NA.44.42.D09.3.454.light.1.nb
tatgcgccttgccagcccgctcagacagtatatatcagatggcgggaagatgaagacagatggtgcagccacagttcgcttaatctc

SEQ ID NO: 297650 - DNA, 309 bp, Homo sapiens
  misc_feature: NA.44.43.D10.2.454.light.1.nb
  modified_base (127)..(127): a, c, t, g, unknown or other
  misc_feature (127)..(127): n is a, c, g, or t
gacccagagggaaccatggaagccccagctcagcttctcttcctcctgctactctggctcccagataccaccggagagattgtgttgacgcagtctccagccacctgtctttgtctccaggggaaanagccaccctctcctgcagggccagtcagagtgttagcagctacttagcctggtaccaacagaaacctggccaggctcccaggctcctcatctatggtgcatccaacagggccactggcatcccagccaggttcagtggcagtggtctgggacagacttcactctcaccatcagcagcctaga

SEQ ID NO: 297651 - DNA, 302 bp, Homo sapiens
  misc_feature: NA.44.45.E01.2.454.light.1.nb
tctcagttcatcttctcaccatgaggctccctgctcagctcctgggctgctaatgctctggatccctggacccagtgcagatgttgtgctgacccagactcccctctctctgtccgtcacccctggacagccggcctccatcgtcctgcaagtctagtcagacgcctcctgcatagtgatggaaagacatatttgtactggtacctgcagaggtcaggccagtctccgcagctcctcatctatgattctttcaagcgcctctctggagtgccagataggttcagtggcaggcgggtcgggac

SEQ ID NO: 297652 - DNA, 303 bp, Homo sapiens
  misc_feature: NA.44.46.E02.6.454.light.1.nb
  modified_base (139)..(139): a, c, t, g, unknown or other
  misc_feature (139)..(139): n is a, c, g, or t
gctcagttaggacccagagggaaccatggaagccccagctcagcttctcttcctcctgctactctggctcccagataccaccggggaaattgtgttgacacaatctccagccaccctgtctttgtctccgaggggaaangccaccctctcctgcagggccagtcagagtgttaggaactacttagcctggtatcaacagacacctggccaggctcccaggctcctcatctatgatgcatccaatagggccgcgggcatcccagccaggttcagtggcagtgggtctgagacagacttcactct

SEQ ID NO: 297653 - DNA, 272 bp, Homo sapiens
  misc_feature: NA.44.50.E06.1.454.light.1.nb
cctggggaggaactgctcagttaggacccagagggaaccatggaagccccagctcagcttctcttcctcctgctactctggctcccagataccaccggggaaattgtgttgacacaatctccagccaccctgtctttgtctccaggggaaagagccaccctctcctgcagggccagtcagagtgttaggaactacttagcctggtatcaacagacacctggccaggctcccaggctcctcatctatgatgcatccaatagggccgcgggcac

SEQ ID NO: 297654 - DNA, 192 bp, Homo sapiens
  misc_feature: NA.44.53.E09.1.454.light.1.nb
agaggcagcgctctcgggacgtctccaccatggcctgggctctgctgctcctcactctcctcacccaggacacagggtcctgggcccagtctgccctgactcagcctgcctccgtgtctgggtcgcctggacagtcggtcaccatctcctgcactggagccagcggtaatattcttagtcttaactttgtct

SEQ ID NO: 297655 - DNA, 162 bp, Homo sapiens
  misc_feature: NA.44.53.E09.2.454.light.1.nb
gaggccgactattactgtcaggtgtgggatagtagtagtgatcatcgggtgttcggcggagggaccaagctgaccgtcctaggtcagcccaaggctgccccctcggtcactctgttcccgccctcctctatatactgtctgagcgggctggcaaggcgcata

SEQ ID NO: 297656 - DNA, 343 bp, Homo sapiens
  misc_feature: NA.44.55.E11.2.454.light.1.nb
ctgtgggtagagaagacaggactcaggacgatctccagcatggccagcttccctctcctcctcaccctcctcactcactgtgcagggtcctgggcccagtctgtgatgtctcagccaccctcagcgtctgggacccccgggcagggggtcaccatctcttgttctggaaggaagtccaatatcggatcttatcctgtcaactggtatcggggactcccaggcaccggccccccgactccttatctatgctactaatcagcggccctcacggggtccctgcccgattctctggctccaagtctggcactacaggctacctggccatccttgatctccagtctga

SEQ ID NO: 297657 - DNA, 124 bp, Homo sapiens
  misc_feature: NA.44.55.E11.3.454.light.1.nb
ttggtggtggggttttcggcggagggaccaagctgaccgtcctaagtcagcccaaggctgccccctggtcactctgttcccaccctcctctatatactgtctgagcgggctggcaaggcgcata

SEQ ID NO: 297658 - DNA, 177 bp, Homo sapiens
  misc_feature: NA.44.56.F01.2.454.light.1.nb
cacaagaggcagcgctctcgggacgtctccaccatggcctgggctctgctgctcctcactctcctgactcaggacacagggacctgggcccagtccgccctgactcagccagcctccgtgtctgggtctcctggacagtcgctcaccctctcctgcactggaactaatactgatgtt

SEQ ID NO: 297659 - DNA, 125 bp, Homo sapiens
  misc_feature: NA.44.57.F02.1.454.light.1.nb
ttggtggtggggttttcggcggagggacccgactgaccgtcctaagtcagcccaaggctgccccctcggtcactctgttcccgccctcctctatatactgtctgagcgggctggcaaggcgcata

SEQ ID NO: 297660 - DNA, 370 bp, Homo sapiens
  misc_feature: NA.44.59.F04.1.454.light.1.nb
tcagaccctgtcaggggacagcatggacatgagggtccccgctcagctcctggggctcctgctgctctggctcccaggttcgagatgtgacatcgagatgacccagtctccttccttcctgtcttcttctgttggaggcagcgtcaccatcacttgccgggcgagtcaggtcgttttcggtgctgttgcctggtttcaaacgaaaaaggggggacggcccctaaggtcctcgtctctcgtgaaaccagactggaaggtagagtcccgtccaggttcagtgccagtccaggtggtgggccggagtccactctcaccattagcgacctgcggcctgaagattctgcaacttatttctgtcagcagtatcata

SEQ ID NO: 297661 - DNA, 248 bp, Homo sapiens
  misc_feature: NA.44.59.F04.2.454.light.1.nb
ctgtggtagagaagacaggattcaggacaatctccagcatggccggcttccctctcctcctcaccctcctcactcactgtgcagggtcctgggcccagtctgtgctgactcagccatcctcagcgtctgggacccccgggagacggtcacgatcttttgtctggaagtaggtccaacatcggaagtaattacgtatactggtatcggcaattcacaggagcggtccccagacccctcatctataggga

SEQ ID NO: 297662 - DNA, 217 bp, Homo sapiens
  misc_feature: NA.44.6.A06.1.454.light.1.nb
caggttcagtggcagtgggtctgggacagacttcactctcaccgtcagcaatgtacagcctgaagattttgcagtttattactgtcagcagcgttcctccaggccgctcactttcggcgggggaccaaggtggagatcagacgaactgtggctgcaccatctgtcttcatcttccgcatctgatatatactgtctgagcgggctggcaaggcgcata

SEQ ID NO: 297663 - DNA, 337 bp, Homo sapiens
  misc_feature: NA.44.60.F05.2.454.light.1.nb
ctgcagggccagtcagagtgttgccaaaaactacttagtctggttccagcagaaacctggccagactcccaggctcctcatctatggtgcatccagcagggcctctggcatcccggacaggttcagtggcagtgggtctgggacagacttcactctcaccatcagcagactggagcctgaagattttgcagtttattactgtcagcagtatgcttactcacctctgacgttcggccaagggaccaaggtggaaatcaaacgaactgtggctgcaccatctgtcttcatcttcccgccatctgatatatactgtctgagcgggctggcaaggcgcata

SEQ ID NO: 297664 - DNA, 134 bp, Homo sapiens
  misc_feature: NA.44.60.F05.3.454.light.1.nb
ccagcagaaatctggccagactcccaggctcctcatctatacatccaccagggccactggtatcccagccagattcagtggcactgggtctgggacagagttcactctcaccatcagcagcctgcagtctgaag

SEQ ID NO: 297665 - DNA, 156 bp, Homo sapiens
  misc_feature: NA.44.61.F06.2.454.light.1.nb
gaggcagcgctctcgggacgtctccaccatggcctgggctctgctgctcctcactctcctcactcaggacacagggtcctgggcccagtctgccctgactcagcctgcctccgtgtctgggtcgcctggacagtcggtcaccatctcctgcactgg

SEQ ID NO: 297666 - DNA, 87 bp, Homo sapiens; identical to SEQ ID NO: 297649
  misc_feature: NA.44.62.F07.1.454.light.1.nb

SEQ ID NO: 297667 - DNA, 172 bp, Homo sapiens
  misc_feature: NA.44.63.F08.1.454.light.1.nb
agcgctctcgggacgtctccaccatggcctgggctctgctgctcctcactctcctcactcaggacacagggtcctgggcccagtctgccctgactcagcctgcctccgtgtctggttcctggacagtcgatcaccatctcctgcactgggtccagcaatgactagttgggat

SEQ ID NO: 297668 - DNA, 226 bp, Homo sapiens
  misc_feature: NA.44.64.F09.1.454.light.1.nb
  modified_base (119)..(119): a, c, t, g, unknown or other
  misc_feature (119)..(119): n is a, c, g, or t
caggacaatctccagcatggccggcttccctctcctcctcaccctcctcactcactgtgcagggtcctgggcccagtctgtgctgactcagccatcctcagcgtctgggacccccgggnagacggtcacgatcttttgtctggaagtaggtccaacatcggaataattacgtatactggtatcggcaattcacaggagcggtccccagacccctcatctataggga

SEQ ID NO: 297669 - DNA, 27 bp, Homo sapiens
  misc_feature: NA.44.65.F10.2.454.light.1.nb
ataccactggagaaatagtgatgacgc

SEQ ID NO: 297670 - DNA, 283 bp, Homo sapiens
  misc_feature: NA.44.65.F10.3.454.light.1.nb
agtctccagccaccctgtctgtgtctccaggggaaagagccaccctctcctgcagggccagtcagagtgttaccagcaacttagcctggtaccaccagaaacctgggcaggctcccaggctcctcatctatggaacatccaccagggccactggtactcccaccaggttcagtggcagtgggtccggacagagttcactctcaccatcagcggcctgcagtctgaggtattttgctagtttattactgtcagcagtataataactgcctctctacgtttcggg

SEQ ID NO: 297671 - DNA, 262 bp, Homo sapiens
  misc_feature: NA.44.65.F10.4.454.light.1.nb
ggtctccagccaccctgtctgtgtctccaggggaaagagccaccctctcctgcagggccagtcagagtgttagcagcaacttagcctcgtaccagcagaaatctggccaggctcccaggctcctcatctatggtgcatccaccagggccactggtactcccagccaggttcagtggcagtgggtctgggacagagttcactctcaccatcagcagcctgcagtctgaagtatttgctagtttattactgtcagctagtataa

SEQ ID NO: 297672 - DNA, 55 bp, Homo sapiens
  misc_feature: NA.44.65.F10.5.454.light.1.nb
ataccaccggggaaattgtgttgacacaatctccagccaccctgtctttgtctcc

SEQ ID NO: 297673 - DNA, 191 bp, Homo sapiens
  misc_feature: NA.44.65.F10.6.454.light.1.nb
gggggaacagccaccctctcttgcagggccggccagactgttgacgacgacttagcctggtaccaacagaagcctggccaggctcccagactcctcatctatgatacttctagtagggcctctggcatcccagcccgcttcagtggcagtgggtctgggacagacttcactctcaccatcaccagcctaga

SEQ ID NO: 297674 - DNA, 116 bp, Homo sapiens
  misc_feature: NA.44.65.F10.7.454.light.1.nb
  modified_base (9)..(9): a, c, t, g, unknown or other
  misc_feature (9)..(9): n is a, c, g, or t
aggggaaangccaccctctcctgcagggccagtcagagtgttaggaactacttagcctggtatcaacagacaccgtggccaggctcccaggctcctcatctatgatgcatccaagt

SEQ ID NO: 297675 - DNA, 179 bp, Homo sapiens
  misc_feature: NA.44.65.F10.8.454.light.1.nb
agatcaccggagatattgtgttgacacagtctccaggcaccctgtctttgtctccgaggggagagagccaccctctcctggtagggccagtcggagtgttgctaagtacctagcctggtaccaacagaaacctggccaggctcccaggctcctcatctatgatgcatccaacagggtca

SEQ ID NO: 297676 - DNA, 160 bp, Homo sapiens
  misc_feature: NA.44.65.F10.9.454.light.1.nb
attccaccggcgaaattgtgttgacacaatctccagccaccctgtctttgctccgggggaacagccaccctctcttgcagggccggccagactgttgacgacgacttagcctggtaccaacagaccacctggccaggctcccagactcctcatctatgat

SEQ ID NO: 297677 - DNA, 215 bp, Homo sapiens
  misc_feature: NA.44.68.G02.1.454.light.1.nb
gactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgg

SEQ ID NO: 297678 - DNA, 368 bp, Homo sapiens
  misc_feature: NA.44.69.G03.1.454.light.1.nb
agactgggtcatctagatgtgacatccagatgacccagtctccttcctccctgtctgcttctataggagacagagtcgccatcacttgccgggcaagtcagaccattaacagctatttaaattggtatcagcagagaccagggaaagcccctgaactcctgatctctgctgcctccactctgcaaggtggagtctcttcaaggttcagtggcagtggatctgggacagatttcactctcaccatctccagtctgcaacctgaagattttgcaactttactactgtcaacagagttatactgtccccgttctacttttggtcggggaccaagctggagatcaaacgactgtgctgcaccatctgtcttc

SEQ ID NO: 297679 - DNA, 372 bp, Homo sapiens
  misc_feature: NA.44.70.G04.1.454.light.1.nb
gactcctcagttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctattactgcatccaagttctacaa

SEQ ID NO: 297680 - DNA, 87 bp, Homo sapiens
  misc_feature: NA.44.70.G04.5.454.light.1.nb
tatgcgccttgccagcccgctcagacagtatatatcagatggcgggaagatgaagacagatggtgcagccacagttcgctttgattt

SEQ ID NO: 297681 - DNA, 362 bp, Homo sapiens
  misc_feature: NA.44.71.G05.1.454.light.1.nb
aggaggcagctctctcggaatatctccaccatggcctgggctctgctcctcctcaccctcctcactcagggcacaggatcctgggctcagtctgccctggctcagcctccctccgtgtccgggtctcctggacagtcagtcaccatctcctgcactggaaccaacagtgacgtcggtcgttttgaccgtgtctcctggtaccagcagaccccagaaacagcccccaaactcattatttatgcggtcaatgttcgcccttcggtgtccctgagcgcttctctgggtccaagtctggcaacacggcctccctgaccatctctgggctccaggctgaggacgaggctgattattactgcagctca

SEQ ID NO: 297682 - DNA, 159 bp, Homo sapiens
  misc_feature: NA.44.73.G07.1.454.light.1.nb
  modified_base (120)..(120): a, c, t, g, unknown or other
  misc_feature (120)..(120): n is a, c, g, or t
cagcgctctcgggacgtctccaccatggcctgggctctgctcctcctcaccctcctcactcaggacacagggtcctgggcccagtctgccctgactcagcctgcctccgtgtctgggtcncctggacagtcggtcaccatctcctgcactggagccagc

SEQ ID NO: 297683 - DNA, 137 bp, Homo sapiens
  misc_feature: NA.44.73.G07.3.454.light.1.nb
ctggctccaagtctggcaacacggcctccctgaccgtctctgggctccaggctgacgatgaggctgattattactgcagctccgatggaggcacctatgatttgcttttcggcggagggaccagactgaccgtccta

SEQ ID NO: 297684 - DNA, 363 bp, Homo sapiens
  misc_feature: NA.44.73.G07.4.454.light.1.nb
taggacccagagggaaccatggaagccccagctcagcttctcttcctcctgctactctggctcccagattccaccggcgaaattgtgttgacacaatctccagccaccctgtctttgtctccgggggaacagccaccctctcttgcagggccggccagactgttgacgacgacttagcctggtaccaacagaagcctggccaggctcccagactcctcatctatgatacttctagtagggcctctggcatcccagcccgcttcagtggcaggtgggtctgggacagacttcactctcaccatcaccagcctagacgcctgaagtattttgctagtttattactgtctacaccgtaagagtgcc

SEQ ID NO: 297685 - DNA, 348 bp, Homo sapiens
  misc_feature: NA.44.73.G07.6.454.light.1.nb
gttcaccttctcacaatgaggctccctgctcagctcctggggctgctaatgctctgggtctcagggtccagtggagatattataatgactcagtctcccctctccctggccgtcacccctggagagccggcctccatctcctgtaggtctagtgagagtcttggaggtcagaacatctatgtggactggtacttgcagaagaccgggcagtctccacaactcctgatctatttgggttccactcgggcctccggggtctctgacaggttcagtgccagtgcatcacacacagatttcacactgcacatcagcagagtggaggctgacgatgttggggtctattactgc

SEQ ID NO: 297686 - DNA, 155 bp, Homo sapiens
  misc_feature: NA.44.73.G07.7.454.light.1.nb
  modified_base (62)..(62): a, c, t, g, unknown or other
  misc_feature (62)..(62): n is a, c, g, or t
accactggagaaatagtgatgacgcggtctccagccaccctgtctgtgtctccaggggaaanagccaccctctcctgcagggccagtcagagtgttagcagcaacttgcctcgtaccagcagaaatctggccaggctcccaggcctcctcatcta

SEQ ID NO: 297687 - DNA, 323 bp, Homo sapiens
  misc_feature: NA.44.74.G08.1.454.light.1.nb
gcaccatggcctggactcctctctttctgttcctcctcacttgctgcccagggtccaattctcagcctgtggtgactcaggagccctcactgactgtgtccccaggagacacagtcactctcacctgtgcctccagcactggagcggtcaacagtgatttttatgcaaactggttccagcagaaacctggacaaccacccagggccctgatttatggtacacgcatcagacattcctggacccctgcccggttctcaggctccctccgtgggggcatagctgtcctgatcctgtctgacgtacggcctgaggacgaggctgac

SEQ ID NO: 297688 - DNA, 221 bp, Homo sapiens
  misc_feature: NA.44.74.G08.3.454.light.1.nb
agcagagttctggggtgtctccaccatggcctggacccctctctggctcactctcctcactctttgcatagggtctgtagtttcttctgggctgactcaggagtctgctgtgtctgtggccttgggacagacagtcaagatcacatgccacggagacagcctcagagggcactatgcaagctggtaccaacagaagccgggacaggcccctctacttgtca

SEQ ID NO: 297689 - DNA, 369 bp, Homo sapiens
  misc_feature: NA.44.75.G09.2.454.light.1.nb
gtcctcactgtctgcgtctattggggacagagtcaccatcacttgccgggcgagtgccgacattaggacttttttggcctggtttcagcaggagcctggcaaagcccctaagtccctgatcttttctggatccactttgaagagtggagtcccagccaggttcagcggcagtggttctgggacacatttcactctcaccatcagcagcctgcagcctggagatttcgcgtacttattactgaccaacaattattcttttttatccgttactagttttggccaggggaccaagctggagatcaaaggactgtggctgcaccatctgtcttcatcttcccgcatctgatatatactgtctgagcgggctgg

SEQ ID NO: 297690 - DNA, 224 bp, Homo sapiens
  misc_feature: NA.44.75.G09.3.454.light.1.nb
ttccttcctgtcttcttctgttggaggcagcgtcaccatcacttgccgggcgagtcaggtcgttttcggtgctgttgcctggtttcaacgaaaaagggggagaggcccctaaggtcctcgtctctcgtgaaaccagactggaaggtagagtcccgtcaggttcagtgccagtccaggtggtgggccggagtccactctcaccattagcgacctgcggcctgaag

SEQ ID NO: 297691 - DNA, 292 bp, Homo sapiens
  misc_feature: NA.44.75.G09.4.454.light.1.nb
cagcgctctcaggacgtcaccaccatggcctgggctctgctcctcctcaccctcctcactcaggacacagggtcctgggcccagtctgccctgactcagcctccctccgcgtccgggtctgtcggtcagtcagtcaccatctcctgcactggaaccagcagtgacattggtggttataactttgtctcctggtaccaacacacccaggcaaagcccccaaattcatcatttatgatgtcagtaagcggccctcaggggtccctgactcgcttctctggctccaagtctggca

SEQ ID NO: 297692 - DNA, 220 bp, Homo sapiens
  misc_feature: NA.44.75.G09.5.454.light.1.nb
ccctgtctgcttctataggagacagagtcgccatcacttgccgggcaagtcagaccattaacagctatttaaattggtatcagcagagaccagggaaagcccctgaactcctgatctctgctgcctccactctgcaaggtgagtctcttcaaggttcagtggcagtggatctgggacagatttcactctcaccatctccagtctgcaacctgaagatttt

SEQ ID NO: 297693 - DNA, 167 bp, Homo sapiens
  misc_feature: NA.44.75.G09.6.454.light.1.nb
cctggtatcagcagaaaccagggaatgcccctaaggtcctgatctataaggcgtctagtttagaaagtggggtcccatcaaggttcagcggcagtggatctgggacagaattcactctcaccatcagcagcctgcagcctgatgattttgcaacttattactgccaa

SEQ ID NO: 297694 - DNA, 258 bp, Homo sapiens
  misc_feature: NA.44.76.G10.1.454.light.1.nb
taggacccagacggaaccatggaagccccagcgcagcttctcttcctcctgctactctggctcccagacaccactggagaaatagtgatgacgcagtctccagccaccctgtctctgtctccgaggggaaagagccaccctctcctgcagggccagtcagagtgttggcagcagcgtagcctggttccagcagaaacctggccagactcccaggctcctcatctataccacactccaccagggccactggtactccca

SEQ ID NO: 297695 - DNA, 124 bp, Homo sapiens
  misc_feature: NA.44.78.H01.2.454.light.1.nb
ttggtggtggggttttcggcggagggacccgactgaccgtcctaagtcagcccaaggctgcccctcggtcactctgttcccaccctcctctatatactgtctgagcgggctggcaaggcgcata

SEQ ID NO: 297696 - DNA, 314 bp, Homo sapiens
  misc_feature: NA.44.8.A08.1.454.light.1.nb
cgacgacttagcctggtaccaacagaagcctggccaggctcccagactcctcatctatgatacttctagtagggcctctggcatcccagcccgcttcagtggcagtgggtctgggacagacttcactctcaccatcaccagcctagagcctgaagattttgcagtttattactgtctacaccgtaagaagtggcctccaatattcactttcggcctgggaccaaagtggatatcaaacgaactgtggctgcaccatctgtcttcatcttcccgcatctgatatatactgtctgagcgggctggcaaggcgcata

SEQ ID NO: 297697 - DNA, 121 bp, Homo sapiens
  misc_feature: NA.44.83.H06.2.454.light.1.nb
tggactgctattcggcggagggaccaagctgaccgtcctaagtcagcccaaggctgccccctcggtcactctgttcccaccctcctctatatactgtctgagcgggctggcaaggcgcata

SEQ ID NO: 297698 - DNA, 67 bp, Homo sapiens
  misc_feature: NA.44.84.H07.2.454.light.1.nb
tggtgagtctctgtgttcagtgctgatcaccgaatggaaacaccgccgacttctagtgctgggctcc

SEQ ID NO: 297699 - DNA, 321 bp, Homo sapiens
  misc_feature: NA.44.85.H08.1.454.light.1.nb
ctcagtcaggacacagcatggacatgagggtccctgctcagctcctgggactcctgctgctctggctcccagataccagatgtgacatccagatgacccagtctccatcctccctgtctgcatctgtgggagacagagtcaccatcacttgccgggcgagtcagggcattagcaattatttagcctggtatcagcagaaaccagggaaagctcctaagctcctgatctatgaaacatccattttgcaatcagggtcccatctcgttcagcggcagtggatctgggacagatttcactctcaccgtcagcagcctgcagcct

SEQ ID NO: 297700 - DNA, 228 bp, Homo sapiens
  misc_feature: NA.44.85.H08.3.454.light.1.nb
gaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctat

SEQ ID NO: 297701 - DNA, 124 bp, Homo sapiens
  misc_feature: NA.44.86.H09.3.454.light.1.nb
ttggtggtggggttttcggcggagggacccgactgaccgtcctaagtcagcccaaggctgcccctcggtcactctgttcccgccctcctctatatactgtctgagcgggctggcaaggcgcata

SEQ ID NO: 297702 - DNA, 281 bp, Homo sapiens
  misc_feature: NA.44.9.A09.2.454.light.1.nb
aggacccagagggaaccatggaaaccccagcgcagcttctcttcctcctgctactctggctcccagataccaccggagaaattgtgttgacgcagtctccaggcaccctgtctttgtctccgaggggaaagagccaccctctcctgcagggccagtcagagtgttgacaccaccaccagcttcttagcctggtaccagcagaacgcctggccaggctcccaggctcctcatatacgatgcatccagcaaggccgctggcatcccagacaggttcagtggca

SEQ ID NO: 297703 - DNA, 376 bp, Homo sapiens
  misc_feature: NA.45.15.B04.1.454.light.1.nb
ggcaggcaggggcagcaagatggtgttgcagacccaggtcttcatttctctgttgctctggatctctggtgcctacggggacatcgtgatgacccagtctccagactccctgactgtgtctctgggcgagagggccaccatcaactgcaggtccagccagagtgtttttacggccccaatagtaagaactacttagcttggtaccagcagaagccagggcagcctcctagcctgctcttttactgggcctctacccgggagtccggggtccctgaccgattcagtggcagcgggtctggggcagatttcactctcaccatcagcagcctgcagcctagaagatgtcgcagtttactactgtcagcaatattatgag

SEQ ID NO: 297704 - DNA, 376 bp, Homo sapiens
  misc_feature: NA.45.19.B08.1.454.light.1.nb
taggacccagacggaaccatggaagccccagcgcagcttctcttcctcctgctactctggctcccagataccactggagaaatagtggtgacgcagtctccaggcaccctgtctgtgtctccaggggagagagtcaccctctcctgcacggccagtcaaagtgttcgcaccggatacttagcctggtaccagcagagacctggccagcctcccaggctcctcatctatggtgcatcctccagggcctctggtcgtccccgcaggttcagtggcagtgggtctgggacagagttcactctcaccatcagcagcctgcagtctgaagtatttgcgtatttattattgtctgctattataatagctggccctggacgtt

SEQ ID NO: 297705 - DNA, 198 bp, Homo sapiens
  misc_feature: NA.45.19.B08.3.454.light.1.nb
  modified_base (140)..(140): a, c, t, g, unknown or other
  misc_feature (140)..(140): n is a, c, g, or t
  modified_base (145)..(145): a, c, t, g, unknown or other
  misc_feature (145)..(145): n is a, c, g, or t
ccggaaaaattgtgttgacacagtctccagccattctgtctctctctccaggggagacagccaccctctcatgcagggccagtcagagtattagaacatacttggcctggtatcaatacaagcctggccagggtccccgntcctnatctatgatgcttccagcagggccatggcatcccagccaggttcagtggcggt

SEQ ID NO: 297706 - DNA, 83 bp, Homo sapiens
  misc_feature: NA.45.20.B09.1.454.light.1.nb
tcaggaggcagcgctctcgggacgtctccaccatggcctgggctctgctattcctcaccctcctcactcagggcacagggtcc

SEQ ID NO: 297707 - DNA, 121 bp, Homo sapiens
  misc_feature: NA.45.25.C03.1.454.light.1.nb
tatgcgccttgccagcccgctcagacgcgatcgatcagatggcgggaagatgaagacagatggtgcagccacagttcgtttgatttccaccttggtcccttggccgaacgtcttgagggta

SEQ ID NO: 297708 - DNA, 320 bp, Homo sapiens
  misc_feature: NA.45.34.D01.2.454.light.1.nb
cagacccactcaggacacagcatggacatgagggtccccgctcagctcctggggctcctgctgctctggctcccaggtgccagatgtgccatccagatgacccagtctccattctccctgtctgcatctgtaggagacagagttaccataacttgccgggcaagtcaggatattagaaatgagttaggctggtatcagcagagaccagggggacccccccaatcctagtctatggtgcttccaggttacaaagtgggtccatcaaggttcagtggcggtgggtctggcacagaattcactctcaccatcagccgcctgca

SEQ ID NO: 297709 - DNA, 75 bp, Homo sapiens; identical to SEQ ID NO: 297636
  misc_feature: NA.45.35.D02.1.454.light.1.nb

SEQ ID NO: 297710 - DNA, 409 bp, Homo sapiens
  misc_feature: NA.45.35.D02.2.454.light.1.nb
agacctccggagaaattgtcttgacacagtctccagccattctgtctctctctccaggggacacagccaccctctcatgcagggccagtcagagtattagaacatacttggcctggtatcaatacaagcctggccagggtccccggctcctcatctatgatgcttccagcagggccactggcatcccagccaggttcagtggcggtgggtttgcacagacttcactctcacaatcagcagcctccaacctgaagattttgcagtctattactgtcaacagcgtacagattggccgctcactttcggcggagggaccaaggtggagatcaaacgaactgtggctgcaccatctgtcttcatcttcccgccatctgatcgatcgcgtctgagcgggctggcaaggcgcata

SEQ ID NO: 297711 - DNA, 278 bp, Homo sapiens
  misc_feature: NA.45.35.D02.3.454.light.1.nb
ataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatcgaacagggccactggcatcccagccaggttcagtggcagtgggtctgggacagacttcactctcaccgtcagcagcctggacgcctgatgattttgctagtttacttctgtc

SEQ ID NO: 297712 - DNA, 163 bp, Homo sapiens
  misc_feature: NA.45.35.D02.4.454.light.1.nb
ataccactggagaaatagtggtgacgcagtctccaggcaccctgtctgtgtctccaggggagagagtcaccctctcctgcacggccagtcaaagtgtcgcaccggatacttagcctggtaccagcagagacctggccagccctccaggctcctcatctatggt

SEQ ID NO: 297713 - DNA, 89 bp, Homo sapiens
  misc_feature: NA.45.36.D03.3.454.light.1.nb
cacgggggaggtgtgtcacaagatttgggctctgggcaccgtgggcatgggggagtgtgtcacaagatttgggctctgggcaccttggg

SEQ ID NO: 297714 - DNA, 18 bp, Homo sapiens
  misc_feature: NA.45.36.D03.5.454.light.1.nb
gctcagttaggacccaga

SEQ ID NO: 297715 - DNA, 308 bp, Homo sapiens
  misc_feature: NA.45.36.D03.6.454.light.1.nb
  modified_base (256)..(256): a, c, t, g, unknown or other
  misc_feature (256)..(256): n is a, c, g, or t
gggaaccatggaagccccagctcagcttctcttcctcctgctactctggctcccagataccaccggaaaaattgtgttgacacagtctccaggcaccctgtctctgtctccaggggagacagccaccctctcctgcagggccagtaggagtgtcagtaagtacttaggctggtaccaacagaaacctggccaggctcccaggctcctcatccatgatgcatccaacagggtccctggcgtcccagacaggttccgnggcaggtgggtctgggacagagttcactctcaccgtcagcagcctggagcct

SEQ ID NO: 297716 - DNA, 121 bp, Homo sapiens
  misc_feature: NA.45.36.D03.8.454.light.1.nb
  modified_base (58)..(58): a, c, t, g, unknown or other
  misc_feature (58)..(58): n is a, c, g, or t
attggagaaatactgatgacgcagtttccagccaccctgtctgtgtctccaggggaanagccaccctctcctgcctgggccagtcagagtgttacgcaaccacttagcctggtaccagcag

SEQ ID NO: 297717 - DNA, 384 bp, Homo sapiens
  misc_feature: NA.45.37.D04.1.454.light.1.nb
acaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttagacagctccaacaataagaactacttagcttggtaccagcagaaaccaggtcagcctcctaagctgctcatttactgggcatctacccgggaatccggggtcctgaccgattcagtggcagcgggtctgggacagatttcactctcaccatcagcagcctgcaggctgaagatgtggcagtttattgctgtcagcaatattattatattcct

SEQ ID NO: 297718 - DNA, 80 bp, Homo sapiens
  misc_feature: NA.45.38.D05.1.454.light.1.nb
cacaagaggcagcgctctcgggacgtctccaccatggcctgggctctgctgctcctcactctcctcactcaggacacagg

SEQ ID NO: 297719 - DNA, 420 bp, Homo sapiens
  misc_feature: NA.45.38.D05.2.454.light.1.nb
atcgtgggccctttctgccctgactcagcctgcctccgtgtctgggtctcctggacagtcgatcaccatggcctgcactggaaccaacagtgatgttgggagttttagttttgtctcctggtaccaacaacaccccggcgaagcccccaaactaatcatttatagggacactaagcggccctcgggggtttcaagtcgcttctctggctccaagtctggcaacacggcctccctgacaatctctgggctccaggctcaggacgaggctgattatttctgttgctcatatgcagggaccagcacttgggtgttcggcggagggaccaggttgaccgtcctaggtcagcccaaggctgcccctcggtcactctgttcccaccctcctctcgatcgcgtctgagcgggctggcaaggcgcata

SEQ ID NO: 297720 - DNA, 149 bp, Homo sapiens
  misc_feature: NA.45.38.D05.3.454.light.1.nb
gtcctgggcccagtctgccctgactcagcctgcctccgtgtctgggtctcctggacagtcgatcaccatctcctgcactggaaccagcagtgactgttggattataacttgtctcctggtaccaacaacacccaggcaaacgcccccaa

SEQ ID NO: 297721 - DNA, 198 bp, Homo sapiens
  misc_feature: NA.45.42.D09.2.454.light.1.nb
gctcagttaggacccagacggaaccatggaagccccagcgcagcttctcttcctcctgctactctggctcccagattccacgggagaaatagtgatgacgcagtctccagccaccctgtctgtgtctccgaggggaaagtccaccctctcctgcagggccagccaggagtgtcagcagcgacttagcctggtaccagc

SEQ ID NO: 297722 - DNA, 355 bp, Homo sapiens
  misc_feature: NA.45.45.E01.1.454.light.1.nb
ctcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcctatacagggatggaaacactcacttgaattggtttcaacagaggccaggccaatctccaaggcgcctaatttataaggtttctaaccgggactctggggtcccagacagattcagcggcagtgggtcaggcactgatttcacactgaaaattagtagggtggaggctgaggatggttggagttta

SEQ ID NO: 297723 - DNA, 318 bp, Homo sapiens
  misc_feature: NA.45.5.A05.2.454.light.1.nb
taggtgctgtccttgctgtcctgctctgtgacactctcctggggctgctaatgctctggatccctggatttagtacggacattgcggtgacccagactccactctccctgtccgtcacccctgggcagtcggccgccatctcctgcacgtctagtcggagcctcttacatacaaatggaaagacttatttgtactggtacctgcagaggccaggccagtcgccgcagctcctagtccagcaggcttccagccggttccctggagtgtcagacaggttcagtggacacggatcagacacatctttcactctagaaatca

SEQ ID NO: 297724 - DNA, 278 bp, Homo sapiens
  misc_feature: NA.45.53.E09.2.454.light.1.nb
aggactcctcagttcaccttctcacaatgaggctccctgctcagctcctggggctgctaatgctctgggtctctggttccagtggggatattgtgatgactcagtctccactctccctgtccgtcacccctggagagccggcctccatctcctgcagggctagtcagacgcctcctgcatagtaatggatacaactatgtgattggttcctgcagaagccagggcagtctcacagctcctgatctatctgggatctattcggccctcggggtcctgac

SEQ ID NO: 297725 - DNA, 71 bp, Homo sapiens
  misc_feature: NA.45.58.F03.2.454.light.1.nb
tcagcttctcttcctcctgctactctggctcccagagacctccggaaaaattgtgttgacacagtctccag

SEQ ID NO: 297726 - DNA, 177 bp, Homo sapiens
  misc_feature: NA.45.58.F03.3.454.light.1.nb
  modified_base (26)..(26): a, c, t, g, unknown or other
  misc_feature (26)..(26): n is a, c, g, or t
ccattctgtctctctctccagggganacagccaccctctcatgcagggccagtcagagtatagaacatacttggcctggtatcaatacaagcctggccagggtccccggctcctcatctatgatgcttccagcagggccatggcatcccagccagttcagtggcggtgggtttgcac

SEQ ID NO: 297727 - DNA, 194 bp, Homo sapiens
  misc_feature: NA.45.58.F03.4.454.light.1.nb
gcggcttctcttcctcctgctactctggctcccagataccactggagaaatagtgatgacgcagtctccagtcaccctgtctgtgtctccgaggggagacggccaccctctcctgcagggccagtcagtatgttagcaccaattagcctggtaccaacagagacctgcccaggctcccaaactcctcatctctg

SEQ ID NO: 297728 - DNA, 104 bp, Homo sapiens
  misc_feature: NA.45.58.F03.5.454.light.1.nb
caccctgtctctgtctccaggggagacagccaccctctcctgcagggccagtaggagtgtcagtaagtacttaggctggtaccaacgagaaacctggccaggcc

SEQ ID NO: 297729 - DNA, 204 bp, Homo sapiens
  misc_feature: NA.45.60.F05.2.454.light.1.nb
cttgtctccaggggaaagagccaccctctcctgcagggccagtcagactattactggcagctacttagcctggtaccagcagaaacctggccagggtcccaggctcctcatctattatgcatccaacagggccactggcatcccagacaggttcagtggcagtgggtctgggacagacttcactctcaccatcagcagactgga

SEQ ID NO: 297730 - DNA, 121 bp, Homo sapiens
  misc_feature: NA.45.60.F05.3.454.light.1.nb
tctgtctccaggggagacagccaccctctcctgcagggccagtaggagtgtcagtaagtacttaggctggtaccaacagaaacctggccaggctcccaggctcctcatccatgatgcatcc

SEQ ID NO: 297731 - DNA, 210 bp, Homo sapiens
  misc_feature: NA.45.62.F07.1.454.light.1.nb
aagaggcagcgctctcgggacgtctccaccatggcctgggctctgctgctcctcactctcctcacgtcaggacacagggtcctgggcccagtctgccctgactcagcctgcctccgtgtctgggtctcctggacagtcgatcaccatctcctgcactggaaccagcagtgatgttggattataaccttgtctcctggtaccaacagcacc

SEQ ID NO: 297732 - DNA, 412 bp, Homo sapiens
  misc_feature: NA.45.67.G01.2.454.light.1.nb
  modified_base (363)..(363): a, c, t, g, unknown or other
  misc_feature (363)..(363): n is a, c, g, or t
  modified_base (384)..(384): a, c, t, g, unknown or other
  misc_feature (384)..(384): n is a, c, g, or t
agctgtgagcgcagaaggcaggactcgggacaatcttcatcatgacctgctcccctctcctcctcacccttctcattctctgcacagggtcgtgggcccaacctgaattgacgcagccgccctcggtgtctgcggccccaggacagaccgttaaaatctcctgcactggggccgactccaacgttggcgctaatttcgtgtcgtggtaccagcagttcccaggggaagcccccagactcctcgtttatgacaataacaggcgaccctcaggtattcctgcccgattctctgcctccaagtctggcgcgtcagccaccctgaccatccaccggactccagacagcggacgaggccgatattacngcggaacgtgggatgtccgtntagtttgcggtgttcggcggagggccag

SEQ ID NO: 297733 - DNA, 348 bp, Homo sapiens
  misc_feature: NA.45.68.G02.1.454.light.1.nb
  modified_base (317)..(317): a, c, t, g, unknown or other
  misc_feature (317)..(317): n is a, c, g, or t
actgacaagtcaaggcaggaagatgttgccatcacaactcattgggtttctgctgctctgggttccagcctccaggggtgaaattgtgctgactcagtctccagactttcagtctgtgactccaaaggagaaactcaccatctcctgccgggccagtcagagtattggtattagcttacactggtaccagcagaagccaggtcagtctccaatgctcctcatcgagtatgctgcccagtccatctctcgggtcccctcgaggttcagtggcagtggatctgggacagatttcaccctcaccatcaatagcctggaanctgaagatgctgcaacgtattactgtcatca

SEQ ID NO: 297734 - DNA, 207 bp, Homo sapiens
  misc_feature: NA.45.69.G03.2.454.light.1.nb
tctctctcagtcaggacacagcatggacatgagggtccctgctcagctcctgggactcctgctgctctggctcccagataccagatgtgacctccagatgacccagtctccatcctacgtgtctgcctctgttggagacagagtcaccatcacttgccgggcgagtcaggacattgacaattatgtaggctggtatcagacaaaaac

SEQ ID NO: 297735 - DNA, 253 bp, Homo sapiens
  misc_feature: NA.45.70.G04.1.454.light.1.nb
  modified_base (240)..(240): a, c, t, g, unknown or other
  misc_feature (240)..(240): n is a, c, g, or t
aggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgcactggaaccagcagtgacgttggttattataactatgtctcctggtaccaacaacacccaggcaaacgcccccaaatcatgatttangatgtcagtaatc

SEQ ID NO: 297736 - DNA, 91 bp, Homo sapiens
  misc_feature: NA.45.72.G06.1.454.light.1.nb
ggggaggaactgctcagttaggacccagacggaaccatggaagccccagcgcagcttctcttcctcctgctactctggctcccagaaacca

SEQ ID NO: 297737 - DNA, 246 bp, Homo sapiens
  misc_feature: NA.45.72.G06.2.454.light.1.nb
ttggagaaatactgatgacgcagtttccagccaccctgtctgtgtctccgaggggaaagagccaccctctcctgctgggccagtcagagtgttagcaaccacttagcctggtaccagcagaaacctggccaggctcccagactcctcatttatggttcttctaccagggccgctggtactcccagccaggttcagtgccagtggtctgggacagagttcactctcaccatcagcagcctgcagtct

SEQ ID NO: 297738 - DNA, 130 bp, Homo sapiens
  misc_feature: NA.45.72.G06.3.454.light.1.nb
ccggagaaattgtgttgacacagtctccagccaccctgtctctcgtctccaggggaacagccaccctctcctgcagggccagtcagagtattagaacatacttggcctggtatcaatacaagcctggcca

SEQ ID NO: 297739 - DNA, 155 bp, Homo sapiens
  misc_feature: NA.45.75.G09.4.454.light.1.nb
aggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactgg

SEQ ID NO: 297740 - DNA, 153 bp, Homo sapiens
  misc_feature: NA.45.75.G09.5.454.light.1.nb
atccagcggtgacgttactgttttaagatgtctcctggtatcagcaacacccaggcaaagcccccaaactcatcatttatgatgtcaataatcggccctcaggggtttctcatcgcttctctggctccaagtctggcaatacggcctccctga

SEQ ID NO: 297741 - DNA, 149 bp, Homo sapiens
  misc_feature: NA.45.75.G09.6.454.light.1.nb
  modified_base (81)..(81): a, c, t, g, unknown or other
  misc_feature (81)..(81): n is a, c, g, or t
  modified_base (141)..(141): a, c, t, g, unknown or other
  misc_feature (141)..(141): n is a, c, g, or t
aaccagcagtgatgttgggattataaccttgtctcctggtaccaacagcacccaggcaaagcccccaaactcatgatttangaggcagtaagcggccctgaggggtttctaatcgcttctctggctccaagtctggcaacncggcctcc

SEQ ID NO: 297742 - DNA, 377 bp, Homo sapiens
  misc_feature: NA.45.78.H01.2.454.light.1.nb
gacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagagtattagtaactggttggcctggtatcagcagaaaccagggaaagcccctaagctcctgctctataaggcatctagtttagaaagtggggtcccatcaaggttcagcggcagtggatctgggacagaattcactctcaccatcagcagcctgcagcctgatgattttgctaacttattactgccaacagtatgatagttattcgacgttc

SEQ ID NO: 297743 - DNA, 78 bp, Homo sapiens
  misc_feature: NA.45.79.H02.1.454.light.1.nb
caagaggcagcgctctcgggacgtctccaccatggcctgggctctgctgctcctcactctcctcactcaggacacagg

SEQ ID NO: 297744 - DNA, 104 bp, Homo sapiens
  misc_feature: NA.45.79.H02.2.454.light.1.nb
gtcctgggcccagtctgccctgactcagcctgcctccgtgtctgggtctcctggacagtcgatcaccatctcctgcactggaaccagcagtgatgttgggagtt

SEQ ID NO: 297745 - DNA, 196 bp, Homo sapiens
  misc_feature: NA.45.79.H02.3.454.light.1.nb
ataaccttgtctcctggtaccaacagcacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgctgctcatatgcaggtagtag

SEQ ID NO: 297746 - DNA, 149 bp, Homo sapiens
  misc_feature: NA.45.79.H02.4.454.light.1.nb
tagtttgtctcctggtaccaacaacaccccggcgaacgcccccaaactaatcatttatagggacactaagcggccctcggggtttcaagtcgcttctctggctccaagtctggcaacacggcctcctgacaatctctgggctccaggct

SEQ ID NO: 297747 - DNA, 128 bp, Homo sapiens
  misc_feature: NA.45.79.H02.5.454.light.1.nb
atcgtgggccctttctgccctgactcagcctgcctccgtgtctgggtctcctggacagtcgatcaccatggcctgcactggaaccaacagtgatgttgggagttttagtttgtctcctggtaccaaca

SEQ ID NO: 297748 - DNA, 194 bp, Homo sapiens
  misc_feature: NA.45.79.H02.7.454.light.1.nb
aggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatcctcctgcactggaaccagcagtgacgttggttattataactatgtct

SEQ ID NO: 297749 - DNA, 315 bp, Homo sapiens
  misc_feature: NA.45.80.H03.1.454.light.1.nb
tccaggaggcagaactctgggtgtctcaccatggcctgggtccctctacttctccccctcctcactctctgcacagggtctgaggcctcctatgaggtgacacagccaccctcggtgtcagtgtccccaggacagacggccaggatcacctgctctggagatgctttgccaacacaatatggttactggtaccagcagaaggcgggccaggccctctattgataatatatctggactctaagaggccctcagggatccctgagcgattctctggctccagcgcagggacaactgtcacattgaccatcatgatcc

SEQ ID NO: 297750 - DNA, 88 bp, Homo sapiens
  misc_feature: NA.45.80.H03.2.454.light.1.nb
cgagcccagcactggaagtcgccggtgtttccactcggtgatcatcaccgaacacagaggacgcaccatggagtttgggctgagctgg

SEQ ID NO: 297751 - DNA, 335 bp, Homo sapiens
  misc_feature: NA.45.84.H07.1.454.light.1.nb
gtcaggacacagcatggacatgagggtccccgctcagctcctggggctcctgctgctctggctcccaggtgccaaatgtgacatccagatgacccaatctccttctaccctgtctgcatctgtaggagacagagtcaccatcacttgccgggccagtcaaagtattagtgactggttggcctggtatcagcagaaaccggggaaagcccctaaggtcctgatctacagggcgtctagtctagaaagtggggtgccacaaggttcagcggcagtggatctgggacagaattcactctcaccatcagcagcctgcagcctgatgattttgctaactt

SEQ ID NO: 297752 - DNA, 72 bp, Homo sapiens
  misc_feature: NA.45.87.H10.1.454.light.1.nb
gctcagttaggacccagagggaaccatggaagccccagctcagcttctcttcctcctggcactctggctccc

SEQ ID NO: 297753 - DNA, 37 bp, Homo sapiens
  misc_feature: NA.45.87.H10.2.454.light.1.nb
agataccaccggagaaattgtgttgacacagtctcca

SEQ ID NO: 297754 - DNA, 51 bp, Homo sapiens
  misc_feature: NA.45.87.H10.3.454.light.1.nb
gccaccctgtctttgtttccaggggaaagagccaccctctcctgcagggcc

SEQ ID NO: 297755 - DNA, 236 bp, Homo sapiens
  misc_feature: NA.45.87.H10.4.454.light.1.nb
agtcagggtgttaacagctacttagcctggtaccaacaaaaacctggccaggctcccaggctcatcatctatgacgcatcgaacagggccactggcatcccagccaggttcagtggcagtgggtctgggacagacttcactctcaccatcagcagcctggaccctgaggtattttgcctatttactactgtcagcagcgtggcgaccgagcgctcacgtttcggcggagggaccaa

SEQ ID NO: 297756 - DNA, 203 bp, Homo sapiens
  misc_feature: NA.45.87.H10.5.454.light.1.nb
gccattctgtctctctctccaggggagacagccaccctctcatgcagggccagtcagagtattagaacatacttggcctggtatcaatacaagcctggccagggtccccggctcctcatctatgatgcttccagcagggccatggcatcccagccaggttcagtggcggtgggtttgcacagacttcactctcacaatcagca

SEQ ID NO: 297757 - DNA, 137 bp, Homo sapiens
  misc_feature: NA.45.87.H10.6.454.light.1.nb
ggcaccctgtctctgtctccgaggggagacagccaccctctcctgcagggccagtaggagtgtcagtaagtacttaggctggtaccaacagaaacctggccaggcctcccaggctcctcatccatgatgcatccaac

SEQ ID NO: 297758 - DNA, 87 bp, Homo sapiens
  misc_feature: NA.46.26.C04.1.454.light.1.nb
cggtcctaggtcagcccaaggccaacccactgtcactctgttcccacctcctctactgctagtctgagcgggctggcaaggcgcata

SEQ ID NO: 297759 - DNA, 363 bp, Homo sapiens
  misc_feature: NA.46.34.D01.1.454.light.1.nb
actcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaatcagcagggtggaggctgaggatgttggaatttattactgcat

SEQ ID NO: 297760 - DNA, 192 bp, Homo sapiens
  misc_feature: NA.46.34.D01.2.454.light.1.nb
cctgctactctggctccgaggtgccagatgtgacatcgagctgacccagtctccatcctccctgtctgcaaccgtgggagacagtgtcaccatcacttgccgggcaagtcggaacattgacacctatttaaatggtatcaacatagaccagggacgcccctaagctcctaatctatgctgcatccagtttgc

SEQ ID NO: 297761 - DNA, 75 bp, Homo sapiens
  misc_feature: NA.46.44.D11.1.454.light.1.nb
gctgtggctgcaccatctgtcttcatcttcccgccatctgaacgcactcgtctgagcgggctggcaaggcgcata

SEQ ID NO: 297762 - DNA, 86 bp, Homo sapiens
  misc_feature: NA.46.45.E01.1.454.light.1.nb
aaatcaaacgaactgtggctgcaccatctgtcttcatcttcccgccctcctctactgctagtctgagcgggctggcaaggcgcata

SEQ ID NO: 297763 - DNA, 430 bp, Homo sapiens
  misc_feature: NA.46.67.G01.2.454.light.1.nb
tcggtcaggacacagcatggacatgagggtccccgctcagctcctggggctcctgctactctggctccgaggtgccagatgtgacatcgagctgacccagtctccatcctccctgtctgcaaccgtgggagacagtgtcaccatcacttgccgggcaagtcggaacattgacacctatttaaattggtatcaacatagaccagggacggccctaagctcctaatctatgctgcatccagtttgcaaagtgggtcccatcgaggttcagtggcagtggatctgggacagatttcactctcaccatcagtaatctgcaacgtgaagattttgcaacttattactgtcaacagaattacaatgttttcggccaagggacacgactaacaaattaaacgaactgtgctgcaccatctgtcttcatcttcccgca

SEQ ID NO: 297764 - DNA, 82 bp, Homo sapiens
  misc_feature: NA.46.83.H06.1.454.light.1.nb
ttaaacgaactgtggctgcaccatctgtcttcatcttcccgcatctgaagtactctatctgagcgggctggcaaggcgcata

SEQ ID NO: 297765 - DNA, 103 bp, Homo sapiens
  misc_feature: NA.46.89.I01.1.454.light.1.nb
agggaccaaactgaccgtcctaggtcagcccaaggctgccccctcggtcactctgttcccaccctcctctactgctagtctgagcgggctggcaaggcgcata

SEQ ID NO: 297766 - DNA, 364 bp, Homo sapiens
  misc_feature: NA.47.14.B03.1.454.light.1.nb
gcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctacgtgagctctgagcgggctggcaaggcgc

SEQ ID NO: 297767 - DNA, 109 bp, Homo sapiens
  misc_feature: NA.47.14.B03.2.454.light.1.nb
cagagggtcgtcatctcttgctctggaagcagctccaatatcggaaatgataatgtatactggtaccagcaagtcccacgaaccggcccccaaactcctcatctataac

SEQ ID NO: 297768 - DNA, 289 bp, Homo sapiens
  misc_feature: NA.47.19.B08.1.454.light.1.nb
ctgcagggccagtcagatgttaaccaactacttagcctggtaccaacagaaacctggccaggctcccaggctcctcatctatgatgcatccaacagggccactggcatcccagacaggttcagtggcagtgggtctgggacagacttcactctcaccatcagcagcctagagcctgaagacttttgcagtttattactgtcagcagcgtgagttctggcctccgctcactttcggcggtagggaccagggtcggagatacaaaacgactgtggctgcaccatctgtctt

SEQ ID NO: 297769 - DNA, 219 bp, Homo sapiens
  misc_feature: NA.47.19.B08.2.454.light.1.nb
ctgcagggccagtcagactgttaacttcaactacttagcctggtaccagcacaaacctggccaggctcccaggctcctcatctatggcgcatccagcagggccactggcatcccagacacgttcagtggcagtgggtctgggacagacttcactctcaccatcagcagactggagcctgaagtattttgcagtgtattactgtcagcagtatggaagct

SEQ ID NO: 297770 - DNA, 169 bp, Homo sapiens
  misc_feature: NA.47.2.A02.1.454.light.1.nb
cctgtagggccggtcagagtattagcatcaacttagcctggtaccagcagaaacctgggcaggctcccaggctcctcatctatgatgcgtccaccagggccactggtttcccagccaggttcagtggcagtgcgtctgggacagagttcactctcaccatcaacagcct

SEQ ID NO: 297771 - DNA, 252 bp, Homo sapiens
  misc_feature: NA.47.23.C01.2.454.light.1.nb
acgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactcccccgagcgtattctctggctccaagtctgggaacacggccacccgtgacccgtcacgcgagggtcgacggtcggga

SEQ ID NO: 297772 - DNA, 169 bp, Homo sapiens
  misc_feature: NA.47.23.C01.3.454.light.1.nb
cctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagg

SEQ ID NO: 297773 - DNA, 206 bp, Homo sapiens
  misc_feature: NA.47.3.A03.1.454.light.1.nb
acgtcccactcaggacacagcatggacatgagggtccccgctcagctcctggggctcctgctgctctggttcccaggttgccaggtgtgacatccagatgacccagtctccatcctccctgtctgcatctgtaggagacagagtcaccatcacttgccgggcgagtcagggcttgcaaatgctttggcctggtttcagcagacacc

SEQ ID NO: 297774 - DNA, 56 bp, Homo sapiens
  misc_feature: NA.47.3.A03.3.454.light.1.nb
gaggagccttagccctggactccaaggcctttccacttggtgatcagcactgacgc

SEQ ID NO: 297775 - DNA, 209 bp, Homo sapiens
  misc_feature: NA.47.36.D03.2.454.light.1.nb
ttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtgggtcccatcaaggttcagcggcagtggatcgtgggacagatttcactctcactatcagcagcctg

SEQ ID NO: 297776 - DNA, 130 bp, Homo sapiens
  misc_feature: NA.47.36.D03.3.454.light.1.nb
ctccctgtctgcatctgtaggagacagagtcaccatcacttgccgggcgagtcgagggcgttgcaaatgctttggcctggtttcagcagacaccagggaacgccctaagcgcctgatctatggtgcatac

SEQ ID NO: 297777 - DNA, 304 bp, Homo sapiens
  misc_feature: NA.47.38.D05.2.454.light.1.nb
gactcctcagttcaccttctcacaatgaggctccctgctcagctcctggggctgctaatgctctgggtctctggatccaggtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggtctgatcgggcctccggggtcctgacaggttcagtggcagtggatcaggcac

SEQ ID NO: 297778 - DNA, 96 bp, Homo sapiens
  misc_feature: NA.47.39.D06.1.454.light.1.nb
tatgcgccttgccagcccgctcagagctcacgtaggaagtagtccttgaccaggcagcccagggccgctgtggcaggaccgtcagtcttcctcttc

SEQ ID NO: 297779 - DNA, 409 bp, Homo sapiens
  misc_feature: NA.47.46.E02.2.454.light.1.nb
  modified_base (64)..(64): a, c, t, g, unknown or other
  misc_feature (64)..(64): n is a, c, g, or t
gaccactggagaaatagtgatgacgcagtctccagccaccctgtctgtctctccgaggggaaangccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccatctgtcttcatcttcccgcatctgatacgtgagctctgagcgggctggcaaggcgcata

SEQ ID NO: 297780 - DNA, 143 bp, Homo sapiens
  misc_feature: NA.47.46.E02.3.454.light.1.nb
taccatcggagaagttgtgttgacacagtctccagccaccctgtctttgtctccaggggaaagagccaccctctcctgcagggccagtcagaatattcactcctacttagcctggtaccaacagaaacctggtcaggctccca

SEQ ID NO: 297781 - DNA, 165 bp, Homo sapiens
  misc_feature: NA.47.46.E02.5.454.light.1.nb
  modified_base (63)..(63): a, c, t, g, unknown or other
  misc_feature (63)..(63): n is a, c, g, or t
ttccaccggagacattgttttgacacagtctccagccaccctgtctttgtctccaggggaaanagccaccctctcctgcagggccagtcagagtgttggcagctacttagcctggtaccaacagaaacctggtcaggctcccaggcctcctcatctatgatgcat

SEQ ID NO: 297782 - DNA, 367 bp, Homo sapiens
  misc_feature: NA.47.48.E04.1.454.light.1.nb
agtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtgggtcccatcaaggttcagcggcagtaggtctgggacagagttcactctcactatcagcggcctgcagcctgaagattctgcaacttattactgtctcagtatgatgcttacc

SEQ ID NO: 297783 - DNA, 203 bp, Homo sapiens
  misc_feature: NA.47.50.E06.1.454.light.1.nb
gacaggattcaggacaatctccagcatggccggcttccctctcctcctcaccctcctcactcactgtgcagggtcctgggcccagtctgtgctgactcagccaccctcagcgtctgggacccccggcagagggtcactatctcttgttctggaagcagctccaaatacggaaatgataatgtatactggtaccagcaagtccc

SEQ ID NO: 297784 - DNA, 318 bp, Homo sapiens
  misc_feature: NA.47.52.E08.1.454.light.1.nb
gcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggcctctggggactccctgaacgattcctctggctccaattccggacaacaccggccaccctgaccatccagcagacgacccaaggtccggagactgg

SEQ ID NO: 297785 - DNA, 495 bp, Homo sapiens
  misc_feature: NA.47.53.E09.1.454.light.1.nb
cctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggactccccgagcgattctctggctccaagtctgggaacacggccaccctgaccgtcagcagggtcgacggtcggggatggaggccgtatattttgtcaggtgtgggagactaattttggtcatatgttgttcggcggagggaccaagctgaccgtcctcggtcagcccaaggctgcccctcggtcactctgttcccgccctcctctacgtgagctctgagcgggctggcaaggcgcata

SEQ ID NO: 297786 - DNA, 105 bp, Homo sapiens
  misc_feature: NA.47.53.E09.3.454.light.1.nb
agactgacggtccccaggagttcaggtgctgggcacagcggccctgggctgcctggtcaaggactacttcctacgtgagctctgagcgggctggcaaggcgcata

SEQ ID NO: 297787 - DNA, 518 bp, Homo sapiens
  misc_feature: NA.47.55.E11.4.454.light.1.nb
agctcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggagacggtcaccatctcttgttctggaagcagctccaatatcggaaatgataatgtatactggtaccagcaagtcccacgaaccggcccccaaactcctcatctataacaatgatcagcggccctcaggggtccctggccgattctctggctccaagtctggcgcctcagccaccctggccatcagtgggctccggcccgaggatgaggctgattattactgtgtaggttggatcgcagcctgactgcttacgtcttcggagctgggaccaaggtcaccgtcctaggtcagcccaaggccaaccccactgtcactctgttcccgccctcctctacgtgagctctgagcgggctggcaaggcgcata

SEQ ID NO: 297788 - DNA, 217 bp, Homo sapiens
  misc_feature: NA.47.57.F02.1.454.light.1.nb
acccagtcaggacacagcatggacatgagagtcctcgctcagctcctggggctcctgctgctctgtttcccaggtgccagatgtgacatccagatgacccagtcgccatcctcctgtctgcatctgtaggagacagagtcaccatcacttgtcgggcgagtcagggcattagcaactggttagcctggtttcagcagaaaccagggaaagcccctaa

SEQ ID NO: 297789 - DNA, 270 bp, Homo sapiens
  misc_feature: NA.47.59.F04.2.454.light.1.nb
attttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacagggccctggcatcccagccaggttcagtggcagtgggtctgggacagacttcactctcaccatcagcagcctagagcctgaagtattttgctagtttattactgtcagcagcgtag

SEQ ID NO: 297790 - DNA, 198 bp, Homo sapiens
  misc_feature: NA.47.59.F04.3.454.light.1.nb
gtgttgacacagtctccagccaccctgtctttgtctccaggggaaagccaccctctcctgcagggccagtcagagtattcactcctacttagcctggtaccaacagaaacctggccaggctcccaggctcctcatctatgatgcatccaacagggccactggcatcccagccaggttcagtggcagtgggtctgggac

SEQ ID NO: 297791 - DNA, 327 bp, Homo sapiens
  misc_feature: NA.47.62.F07.1.454.light.1.nb
tcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagtattttacttcaccatcagcagcctgcagcctgaa

SEQ ID NO: 297792 - DNA, 73 bp, Homo sapiens
  misc_feature: NA.47.64.F09.1.454.light.1.nb
tggtatctgggagccagagtagcaggaggaagagaagctgagctggggcttccatggttccctctgggtccta

SEQ ID NO: 297793 - DNA, 88 bp, Homo sapiens
  misc_feature: NA.47.64.F09.2.454.light.1.nb
tcggagaagttgtgttgacacagtctccagccaccctgtctttgtctccaggggaaagagccaccctctcctgcagggccagtcagaa

SEQ ID NO: 297794 - DNA, 217 bp, Homo sapiens
  misc_feature: NA.47.64.F09.3.454.light.1.nb
tattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggc

SEQ ID NO: 297795 - DNA, 158 bp, Homo sapiens
  misc_feature: NA.47.64.F09.4.454.light.1.nb
gtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcct

SEQ ID NO: 297796 - DNA, 210 bp, Homo sapiens
  misc_feature: NA.47.64.F09.6.454.light.1.nb
ctggagaaatagtgatgacgcagtctccagccaccctgtctgtctctccaggggaaaggccaccatctcctgtagggccagtcagagtattagcatcaacttagcctggtaccagcagagacctgggcaggctcccaggctcctcatctatgatgcgtccaccagggccacgtggtactcccagccaggttcagtggctaggtcgggtct

SEQ ID NO: 297797 - DNA, 236 bp, Homo sapiens
  misc_feature: NA.47.64.F09.7.454.light.1.nb
tccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcag

SEQ ID NO: 297798 - DNA, 199 bp, Homo sapiens
  misc_feature: NA.47.64.F09.8.454.light.1.nb
ccggagaagttattttgacacagtctccagccaccctgtctttgtctccaggggaaagagccaccctctcctgcagggtcagtcagagtgttgacagctacttagtctggtaccaagagaaacctggccaggctcccaggctcctcatctgggatgcatccaacgagggccagctggcatcccagccaggttcagtgca

SEQ ID NO: 297799 - DNA, 60 bp, Homo sapiens
  misc_feature: NA.47.70.G04.1.454.light.1.nb
gtctcagtcaggacacagcatggacatgagggtccccgctcagctcctggggctcctgct

SEQ ID NO: 297800 - DNA, 106 bp, Homo sapiens
  misc_feature: NA.47.70.G04.2.454.light.1.nb
actctggctccgaggtgccagatgtgacatccagatgacccagtctccatcctccctgtctgcatctgtaggagacagagtcaccatcacttgccgggcaagtcag

SEQ ID NO: 297801 - DNA, 208 bp, Homo sapiens
  misc_feature: NA.47.70.G04.3.454.light.1.nb
agcattaacagcgatttaaattggtatcaccagaaaccagggaaacgcccctaacctcctgatctatgctgcatccagtttgcatagtgggtcccatctaggttcagtggcagtggatctgggacagatttcactctcaccatcagcagtctgcaacctgaagtattttgactaacttactactgtacaacagagttacggtacccgt

SEQ ID NO: 297802 - DNA, 182 bp, Homo sapiens
  misc_feature: NA.47.70.G04.5.454.light.1.nb
cgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgctaacttattactgt

SEQ ID NO: 297803 - DNA, 108 bp, Homo sapiens
  misc_feature: NA.47.70.G04.6.454.light.1.nb
gctctggttcccaggtgccaggtgtgacatccagatgacccagtctccatcctccctgtctgcatctgtaggagacagagtcaccatcacttgccgggcgagtcaggg

SEQ ID NO: 297804 - DNA, 322 bp, Homo sapiens
  misc_feature: NA.47.73.G07.1.454.light.1.nb
agtcaggacacagcatggacatgagggtccctgctcagctcctgggactcctgctgctctggctcccagataccagatgtgacatccagatgacccagtctccatcctccctgtctgcatctgtaggagacacagtcaccatcacttgccgggcgagtcaggacattagcaattatttagcctggtatcagcagaaaccagggaaagttcctaagctcctgatctatgttacatccactttgcaattcggggtccatctcggttcagtggcagtggatctgggacagatttcactctcaccatcagcagcctgcagcctgaa

SEQ ID NO: 297805 - DNA, 291 bp, Homo sapiens
  misc_feature: NA.47.76.G10.2.454.light.1.nb
ttccaccggagacattgttttgacacagtctccagccaccctgtctttgtctccgaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtatttgctactttattactgtcagcagcgtagcaac

SEQ ID NO: 297806 - DNA, 16 bp, Homo sapiens
  misc_feature: NA.47.76.G10.3.454.light.1.nb
taccatcggagaagtt

SEQ ID NO: 297807 - DNA, 222 bp, Homo sapiens
  misc_feature: NA.47.76.G10.4.454.light.1.nb
gtgttgacacagtctccagccaccctgtctttgtctccaggggaaagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcag

SEQ ID NO: 297808 - DNA, 140 bp, Homo sapiens
  misc_feature: NA.47.76.G10.5.454.light.1.nb
  modified_base (47)..(47): a, c, t, g, unknown or other
  misc_feature (47)..(47): n is a, c, g, or t
attttgacacagtctccagccaccctgtctttgtctccaggggaaangccaccctctcctgcagggtcagtcagagtgttgacagctacttagtctggtaccaagagaaacctggccaggctcccaggcctcctcatcgt

SEQ ID NO: 297809 - DNA, 173 bp, Homo sapiens
  misc_feature: NA.47.76.G10.8.454.light.1.nb
  modified_base (130)..(130): a, c, t, g, unknown or other
  misc_feature (130)..(130): n is a, c, g, or t
aggacccagacggaaccatggaagccccagcgcagcttctcttcctcctgctactctggctcccagataccactggagaaatagagatgacgcagtctccagccaccctgtctgtgtctccaggggaaanacgccaccctctcctgcagggccagtcagagtattagcagcaa

SEQ ID NO: 297810 - DNA, 377 bp, Homo sapiens
  misc_feature: NA.47.78.H01.1.454.light.1.nb
gctcagcttcagctgtggtagagaagacaggattcaggacaatctccagcatggccggcttccctctcctcctcaccctcctcactcactgtgcagggtcttgggcccagtctgtgctgactcagccaccctcagcgtcgtcgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattactgtg

SEQ ID NO: 297811 - DNA, 300 bp, Homo sapiens
  misc_feature: NA.47.80.H03.1.454.light.1.nb
cccagtcaggacacagcatggacatgagggtccccgctcagctcctggggctcctgctgctctggtcccaggtgccaaatgtgacatccagatgacccagtctccttccaccctgtctgcatctgtcggagacagagtcaccatcacttgccgggcagtcagagtattgataggtggttggcctggtatcagcagaaaccagggaaagcccctgaactcttaatctataaggcgtctattttagaaactggggtcccatcaaggttcagcggcagtggatctgggacagagttcactctc

SEQ ID NO: 297812 - DNA, 324 bp, Homo sapiens
  misc_feature: NA.47.81.H04.1.454.light.1.nb
gagctgctcagttaggacccagagggaaccatggaaaccccagcgcagcttctcttcctcctgctactctggctcccagatatcgccggagaaattgtgttgacgcagtctccaggcaccctgtctttgtctccaggggaaagccaccgtctcctgcagggccagtcagagtgttggcagcaactacttagcctggtaccagcagaaacctggccaggctcccaggctcctcatctatggtacatacaacagggccactggctactcccagacagattcagcggcaggtgggtctgggacagacttcactctcaccatcagcag

SEQ ID NO: 297813 - DNA, 301 bp, Homo sapiens
  misc_feature: NA.47.81.H04.3.454.light.1.nb
  modified_base (61)..(61): a, c, t, g, unknown or other
  misc_feature (61)..(61): n is a, c, g, or t
ccatcggagaagttgtgttgacacagtctccagccaccctgtctttgtctccaggggaaanagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagtactttggacttttattactgtcagcagcgtgagttctggcctccgctc

SEQ ID NO: 297814 - DNA, 367 bp, Homo sapiens
  misc_feature: NA.47.82.H05.1.454.light.1.nb
tgagacacaccagtgtggccttgttggcttgaagctcctcaggaagcagcagtcgggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggatccctgaacgattctctggctccaattcggacaacacggccaccctgaccatcagcagacgcccaagtcgga

SEQ ID NO: 297815 - DNA, 378 bp, Homo sapiens
  misc_feature: NA.47.83.H06.1.454.light.1.nb
gaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatacctcccccagctggtaccagcacgaccccgggcagactccacgcacgctcatctacaacacagacactcgctcttcgtcgggtccctgactcgcttctctgttccatccttggaacaagctcgccctcaccatccggcggggcccaggcagatgatgagtgt

SEQ ID NO: 297816 - DNA, 253 bp, Homo sapiens
  misc_feature: NA.47.84.H07.2.454.light.1.nb
  modified_base (54)..(54): a, c, t, g, unknown or other
  misc_feature (54)..(54): n is a, c, g, or t
gaaatagagatgacgcagtctccagccaccctgtctgtgtctccgaggggaaanagccaccctctcctgcagggccagtcagagtattagcagcaacttagcctggtaccagcagaaacctgggcaggctcccaggctcctcatctatggtgcatccaccagggccactggtactcccagccaggttcagtggcagtgggtctgggacagagttcactctcaccatcagcagcctgcagtctagaagtatttt

SEQ ID NO: 297817 - DNA, 240 bp, Homo sapiens
  misc_feature: NA.47.84.H07.3.454.light.1.nb
  modified_base (54)..(54): a, c, t, g, unknown or other
  misc_feature (54)..(54): n is a, c, g, or t
gaaatagtgatgacgcagtctccagccaccctgtctgtctctccgaggggaaanagccaccatctcctgtagggccgtcagagtattagcatcaacttagcctggtaccagcagagacctgggcaggctcccaggctcctcatctatgatgcgtccaccagggccactggtttcccagccaggttcagtggcagtgcgtcgtgggacagagttcactctcaccatcaacagcctgcagtc

SEQ ID NO: 297818 - DNA, 220 bp, Homo sapiens
  misc_feature: NA.47.84.H07.4.454.light.1.nb
gaagttgtgttgacacagtctccagccaccctgtctttgtctccaggggaaagccaccctctcctgcagggccagtcagaatattcactcctacttagcctggtaccaacagaaacctggtcaggctcccaggctcctcatctatgatgcatccaacagggccactggcatcccagacaggttcagtggcagtgagtctgggacagacttcactctcacc

SEQ ID NO: 297819 - DNA, 466 bp, Homo sapiens
  misc_feature: NA.47.85.H08.1.454.light.1.nb
gaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtctaggtcagcccaaggctcgcccctggtcactctcgttcccgccctcctctacgt

SEQ ID NO: 297820 - DNA, 340 bp, Homo sapiens
  misc_feature: NA.47.87.H10.2.454.light.1.nb
gactcctcagttcaccttctcacaatgaggctccctgctcagctcctggggctgctaatgctctgggtctctggatccagtggggatattgtgatgactcagtctccagtctccctgcccgtcatcgttggagagccggcctccatctcctgcaggtctagccagagcctcctgcagactaatggaaatacctatttggattggtacctgacaaaagccagggcagtctccacaactcctgatctatttggcttttaatcgggcctccgggtccctgacaggttcactggcagtggatcaggcacagtattttacattgaaaatcagcagagtggaggct

SEQ ID NO: 297821 - DNA, 354 bp, Homo sapiens
  misc_feature: NA.48.1.A01.1.454.light.1.nb
caggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatcgtgggcagagttcattctcaccatcaacagccttcagcctgaagtatttgctaacttactattgtcagcagggtgac

SEQ ID NO: 297822 - DNA, 153 bp, Homo sapiens
  misc_feature: NA.48.1.A01.2.454.light.1.nb
gatccgggacagattttcggctcaccatcagcagtctacaacctgaagattttgcaacctacttctgtcaccaggcttacaattcccctcgacgttcggccaagggaccaaggtgaagtcagacgaactgtggctgcaccatctgtcttcatc

SEQ ID NO: 297823 - DNA, 57 bp, Homo sapiens
  misc_feature: NA.48.12.B01.4.454.light.1.nb
ctcgatttagtagtgtagattccgcgggcacgaccggtgctcgatttagctctacgc

SEQ ID NO: 297824 - DNA, 65 bp, Homo sapiens
  misc_feature: NA.48.13.B02.1.454.light.1.nb
tcgatttagtctagcgactcccgccatctgatatgtatactctgagcgggctggcaaggcgcata

SEQ ID NO: 297825 - DNA, 352 bp, Homo sapiens
  misc_feature: NA.48.15.B04.1.454.light.1.nb
ggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgttttcacacctccatgaacaaggagtacttggcttggttccagcagaaaccagggcagcctcctaaactactcatttactcggcatccacccggaagtccgaggttcctgaccgattccgtggcagcggtctgggacagattttacctcaccatcactaccctgcaggctgaagatgtggactagttt

SEQ ID NO: 297826 - DNA, 210 bp, Homo sapiens
  misc_feature: NA.48.17.B06.1.454.light.1.nb
agcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacaccagcaaa

SEQ ID NO: 297827 - DNA, 229 bp, Homo sapiens
  misc_feature: NA.48.19.B08.1.454.light.1.nb
agcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctcctggtaccaacagcacccaggcaaagccccaaatcatgattta

SEQ ID NO: 297828 - DNA, 229 bp, Homo sapiens
  misc_feature: NA.48.19.B08.2.454.light.1.nb
gatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcagcccaaggctcgccccctggtcactctcgttcccaccctcctctatgtatactctgagcgggctggcaaggcgcata

SEQ ID NO: 297829 - DNA, 248 bp, Homo sapiens
  misc_feature: NA.48.21.B10.1.454.light.1.nb
tgctcagttaggacccagagggaaccatggaaaccccagcgcagcttctcttcctcctgctactctggctcccagacaccaccggagaaattgtgttgacgcagtctccaggcaccctgtctttgtctccaggggaaaccgccaccctctcctgtagggccagtcagaatgttaagagccactccttagcctggtaccagcaaaaacctggccagcctcccaggctcctcatctatggtgcgtccacc

SEQ ID NO: 297830 - DNA, 350 bp, Homo sapiens
  misc_feature: NA.48.22.B11.1.454.light.1.nb
gacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtcgggtcccgtctaggttcagcggcagcggatctgggacagatttcactctcaccatcagcagcctgcagcctgaagatgttgctaacttattactgtcaacagtactt

SEQ ID NO: 297831 - DNA, 218 bp, Homo sapiens
  misc_feature: NA.48.24.C02.2.454.light.1.nb
aaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtg

SEQ ID NO: 297832 - DNA, 384 bp, Homo sapiens
  misc_feature: NA.48.25.C03.1.454.light.1.nb
tgctcagttaggacccagacggaaccatggaagccccagcgcagcttctcttcctcctgctactctggctcccagattccactggacaaatagtgatgacgcagtccccagccaccctgtctgtgtctccgaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtggtctgggacagagttcactctcaccatcagcagcctgcagtctgaagtattttacattttatactgtcagcagtatcgtaagtgactcgacgtttggccaa

SEQ ID NO: 297833 - DNA, 371 bp, Homo sapiens
  misc_feature: NA.48.26.C04.1.454.light.1.nb
ctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgagtcagtaagcggccctcaggggtccctgatcgcttctctggctccaagtctggcaacacggcctccctgaccgtctcgtgggctccaggctgaggactggaggctgattattactgcagctcatat

SEQ ID NO: 297834 - DNA, 395 bp, Homo sapiens
  misc_feature: NA.48.30.C08.1.454.light.1.nb
taaaagaggttctttctctgggatgtggcatgagcaaaactgacaagtcaaggcaggaagatgttgccatcacaactcattgggtttctgctgctctgggttccagcctccaggggtgaaattgtgctgactcattccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctcggggtcccctcgaggttcagtggcagtggatcgtgggacagtatttcaccctcaccatcaatagcctggaagctgaagatgctgcaacctattactgtcatcagtactt

SEQ ID NO: 297835 - DNA, 87 bp, Homo sapiens
  misc_feature: NA.48.33.C11.1.454.light.1.nb
gaagtcaaacgaactgtggctgcaccatctgtcttcatcttcccgccatctgatatgtatactctgagcgggctggcaaggcgcata

SEQ ID NO: 297836 - DNA, 326 bp, Homo sapiens
  misc_feature: NA.48.35.D02.1.454.light.1.nb
cccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaa

SEQ ID NO: 297837 - DNA, 309 bp, Homo sapiens
  misc_feature: NA.48.35.D02.2.454.light.1.nb
tccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaattttggttttgtatcagcagaagtcaggccaggccccaagactgctcatgtatagagacagtgagaggtcctcgagggactccctgagcgattctctggctccgagctcgtgggacacactcactctgacta

SEQ ID NO: 297838 - DNA, 87 bp, Homo sapiens; identical to SEQ ID NO: 297835
  misc_feature: NA.48.35.D02.4.454.light.1.nb

SEQ ID NO: 297839 - DNA, 389 bp, Homo sapiens
  misc_feature: NA.48.36.D03.1.454.light.1.nb
tctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcattatttatgatgtcactaagcggccctcgggggtccctgatcgcttctctggctccaagtctggcaacacggcctccctgaccatctctgggctccaggctgaagatcaggctgattattactgctgttctattttcaagtttcctttttgtc

SEQ ID NO: 297840 - DNA, 343 bp, Homo sapiens
  misc_feature: NA.48.37.D04.1.454.light.1.nb
ctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctcgtcggggtccccgatcggttctcgtggctccatcgacacggtcctccaactctgcctctctcaccatctctcggactgcagactg

SEQ ID NO: 297841 - DNA, 86 bp, Homo sapiens
  misc_feature: NA.48.37.D04.3.454.light.1.nb
gaagtcaaacgaactgtggctgcaccatctgtcttcatcttccgccatctgatatgtatactctgagcgggctggcaaggcgcata

SEQ ID NO: 297842 - DNA, 410 bp, Homo sapiens
  misc_feature: NA.48.38.D05.1.454.light.1.nb
tgctcgatttagtatctgatagttgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttgtatcagcagaagtcaggccaggccccaagactgctcatgtatagagacagtgagaggtcctcagggatccctgagcgattctctggctccagctcgtgggacacactcactctgactatcagtgaagtccgggagaagacgaggctagactactattgtcagtca

SEQ ID NO: 297843 - DNA, 364 bp, Homo sapiens
  misc_feature: NA.48.43.D10.1.454.light.1.nb
cactcaggacacagcatggacatgagggtccccgctcagctcctggggcttctgctgctctggctcccaggtgccagatgtgacgtccagttgacccagtctccatcctccctgtctgcatctgtgggagacagagtcaccctacttgccgggcaagtcaggccatttccaattctttagcctggtatcagcagaaaccaggacaaactcctacactcctgatctatgatgcgtccagtttagagagtggggcccagtcgaggttcagcggcagtggatcgagggacagagttcactctcaccatcagcagcctgcagcctgaagtattttgactaacttattactgtacaactactttaacaa

SEQ ID NO: 297844 - DNA, 294 bp, Homo sapiens
  misc_feature: NA.48.45.E01.1.454.light.1.nb
aggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggacaaacgcccccaaactcatgatttatgatgtcactaagcggcctcgaggggtccctgctcgcttctctgctcaagtct

SEQ ID NO: 297845 - DNA, 69 bp, Homo sapiens
  misc_feature: NA.48.47.E03.1.454.light.1.nb
tgctcgatttagagctcacgtattgggtttggggtttttaggtatctgagcgggctggcaaggcgcata

SEQ ID NO: 297846 - DNA, 282 bp, Homo sapiens
  misc_feature: NA.48.53.E09.1.454.light.1.nb
aggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgaccaagtaaaattttgtattggtaccaactgaagtcaggccaggcccctgtcctggtcatttatgaggacaccagcgaccctccaggatccctgcgaggttctctggatcgaactca

SEQ ID NO: 297847 - DNA, 87 bp, Homo sapiens; identical to SEQ ID NO: 297835
  misc_feature: NA.48.55.E11.2.454.light.1.nb

SEQ ID NO: 297848 - DNA, 378 bp, Homo sapiens
  misc_feature: NA.48.56.F01.1.454.light.1.nb
gctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgactgaagactgaggacgaggctgcttttactgtcagtcctctgatggcagc

SEQ ID NO: 297849 - DNA, 224 bp, Homo sapiens
  misc_feature: NA.48.57.F02.1.454.light.1.nb
  modified_base (128)..(128): a, c, t, g, unknown or other
  misc_feature (128)..(128): n is a, c, g, or t
acaggattcaggacaatctccagcatggccggcttccctctcctcctcaccctcctcactcactgtgcagggtcctgggcccagtctgtgttgactcagccaccctcaacgtctgggacctcccgggnagaccgtcaccatctcttgtctggcagcagatggaacatcgggagctaattttgtcactggtaccagcaactgccaggacgccggacccccaaact

SEQ ID NO: 297850 - DNA, 383 bp, Homo sapiens
  misc_feature: NA.48.59.F04.2.454.light.1.nb
ctcagttaggacccagagggaaccatggaaaccccagcgcagcttctcttcctcctgctactctggctcccagatgcccccggagaaattgtgttgacgcagtctccagacaccctgtctttgtctccgaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcg

SEQ ID NO: 297851 - DNA, 67 bp, Homo sapiens
  misc_feature: NA.48.61.F06.1.454.light.1.nb
aaacttgatggtcttcatcttcccgccatctgatatgtatactctgagcgggctggcaaggcgcata

SEQ ID NO: 297852 - DNA, 304 bp, Homo sapiens
  misc_feature: NA.48.65.F10.1.454.light.1.nb
gcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctcctggtaccaacagcacccaggcaaagcccccaaactcatgatttatgaggacagtaagcggccctcaggggtttctaatcgcttctctggctccaagtctggcaacacggcctccctga

SEQ ID NO: 297853 - DNA, 385 bp, Homo sapiens
  misc_feature: NA.48.67.G01.1.454.light.1.nb
gctcagttaggacccagagggaaccatggaagccccagcccagcttctcttcctcctgctactctggctcccagcagccaccggagaaattgtgctgacacagtctccagccaccctgtccttgtctccagggcaaagagcctcctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagacgcccgaagattttgcggtttattactgtcagcagcgtgccaactggcctctcacgttcggcgga

SEQ ID NO: 297854 - DNA, 369 bp, Homo sapiens
  misc_feature: NA.48.71.G05.1.454.light.1.nb
tgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgtattttgctagttgttttctgttcagctagtatggaa

SEQ ID NO: 297855 - DNA, 368 bp, Homo sapiens
  misc_feature: NA.48.78.H01.1.454.light.1.nb
acaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattactgctgctcatatg

SEQ ID NO: 297856 - DNA, 75 bp, Homo sapiens
  misc_feature: NA.48.78.H01.2.454.light.1.nb
tatgcgccttgccagcccgctcagcatagtagtgcggatccggcccaacccaaactactcacactaaatcgagca

SEQ ID NO: 297857 - DNA, 250 bp, Homo sapiens
  misc_feature: NA.48.82.H05.1.454.light.1.nb
ggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacaacaccaggcaaacgcccccaaactcatgatttatgatgtcagtaatcgg

SEQ ID NO: 297858 - DNA, 283 bp, Homo sapiens
  misc_feature: NA.48.83.H06.1.454.light.1.nb
aagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttggacataaattggggaaaatatgtttgttggtatcaacagaagccaggccagtcccctgtgttggtcatccgtgaagataacaagcggccctcaggcatccctgagcgattctctggctccaactctagggaa

SEQ ID NO: 297859 - DNA, 394 bp, Homo sapiens
  misc_feature: NA.48.87.H10.1.454.light.1.nb
acaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttatactgtcagcacttgttttggcgtttctccgtactttc

SEQ ID NO: 297860 - DNA, 202 bp, Homo sapiens
  misc_feature: NA.48.87.H10.2.454.light.1.nb
  modified_base (136)..(136): a, c, t, g, unknown or other
  misc_feature (136)..(136): n is a, c, g, or t
  modified_base (163)..(163): a, c, t, g, unknown or other
  misc_feature (163)..(163): n is a, c, g, or t
ctctctcagtccagacacagcatggacatgagggcccccgctcagctcctgggactcctgctgctctggctcccagataccagatgtgacatccagatgacccagtctccatcctccctgtctgcatctgtggganacagagtcaacgtcacgttggccgggngagtcagggcattaacaattattagcctggtatcagcag

SEQ ID NO: 297861 - DNA, 130 bp, Homo sapiens
  misc_feature: NA.48.87.H10.3.454.light.1.nb
gtctccactcccgccttgacgaggctgattactactgtcagtcttttgataacaacaatcacgtggtcttcggcggagggaccagcctgaccgtcctaggtcagcccaaggctgccccctcggtcactct

SEQ ID NO: 297862 - DNA, 90 bp, Homo sapiens
  misc_feature: NA.48.87.H10.4.454.light.1.nb
gtatgcgccttgccagcccgctcagagtatacatatcagatggcgggaagatgaagacagatggtgcagccacagttcgtttgacttccg

SEQ ID NO: 297863 - DNA, 322 bp, Homo sapiens
  misc_feature: NA.48.9.A09.3.454.light.1.nb
caacacaatttccccagagggaaccatggaaaccccagcgcagcttctcttcctcctgctactctggctcccagataccaccggagaaattgtgttgacgcagtctccaggcaccctgtctttgtctccaggggaaaagccaccctctcctgcagggccagtgagacagttactgttaattatttggcctggtaccagcagaagcctggccaggctcccaggctcctcatctctgctgcatcctacagggccactggcatcccagacaggttcagtggcagtggtctgggacagacttcactctctccatcagcagactgga

SEQ ID NO: 297864 - DNA, 467 bp, Homo sapiens
  misc_feature: NA.49.11.A11.1.454.light.1.nb
cagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacacattggaagtaagactgtgcactggtaccagcagaagccaggccaggcccctgtgctggtcgtctatggtgatggcgaccggccctcagggatccctgagcgattctctggctccaactctgggaacccgccaccctgaccatcagccgggtcgaagacggggatgaggccgactattactgtcaggtgtgggatagtggtagtggtgtcgtcttcggagctgggaccagggtcaccgtcctaggtcagcccaaggccaacccactgtcactctgttcccacctcctctctctcgactctgagcgggctggc

SEQ ID NO: 297865 - DNA, 95 bp, Homo sapiens
  misc_feature: NA.49.11.A11.2.454.light.1.nb
gccggccttaattaaggtcagcctaaggctgccccagcgtcactctgttcccaccctcctctctctcgactctgagcgggctggcaaggcgcata

SEQ ID NO: 297866 - DNA, 172 bp, Homo sapiens
  misc_feature: NA.49.12.B01.3.454.light.1.nb
aggacacagcatggacatgagggtccctgctcagctcctggggctcctgctgctctggctctcaggtgccagatgtgacatccggatcgacccagtctccatccctccctgtctgcatctgtaggagacagaatcaccatcacttgccaggcgactcgaggactattacgac

SEQ ID NO: 297867 - DNA, 139 bp, Homo sapiens
  misc_feature: NA.49.12.B01.4.454.light.1.nb
tcatcatgacctgctcccctctcctcctcacccttctcattcactgcacagggtcctgggcccagtctgtgttgacgcagccgccctcagtgtctgccggcccaggacagaaagtcaccatctcctgctctggaagcag

SEQ ID NO: 297868 - DNA, 89 bp, Homo sapiens
  misc_feature: NA.49.15.B04.2.454.light.1.nb
tcacgcgagaaagggaaggggctggccctgacgtgtttctgttcccaccctcctctctctcgactctgagcgggctggcaaggcgcata

SEQ ID NO: 297869 - DNA, 389 bp, Homo sapiens
  misc_feature: NA.49.16.B05.1.454.light.1.nb
cagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcgaggacaacagtcacgttgaccatcagtggagtccaggcagaagacgaggctgactattattgtcaatcagcagacaccggtgtacttagtcgggtgttcggcggagggaccaa

SEQ ID NO: 297870 - DNA, 412 bp, Homo sapiens
  misc_feature: NA.49.20.B09.1.454.light.1.nb
gaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgaccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggcagaggacgaggctgactattactgtcagtccgcagacagcagtggcagttatgtcgtattcggcggagggactacgctgaccgtccgtaggtca

SEQ ID NO: 297871 - DNA, 317 bp, Homo sapiens
  misc_feature: NA.49.21.B10.1.454.light.1.nb
taattttgtctcctggtaccaacaccacccagacaaagcccccagactcattatttatggtgtcggtgaccggccctcaggggtttcgaatcgcttctctggctccaagtccggctacacggcctccctgaccctctctgggctccaggccgaggacgaggctgattattactgcgcctcatatacaaacaacaacatttgggtgttcggcggagggaccaagctgaccgtcctaggtcagcccaaggctgccccctcggtcactctgttcccagccctcctctctctcgactctgagcgggctggcaaggcgcata

SEQ ID NO: 297872 - DNA, 322 bp, Homo sapiens
  misc_feature: NA.49.23.C01.1.454.light.1.nb
aggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgaccaaaaagatatgcttattggtaccatcagaagtcaggccaggcccctgtactggtcatctatgaggacaccaaacgaccctcgggatccctagagattctctgctccagtttaggacagtggccacctgacagtcaggtcgggccaggtggagga

SEQ ID NO: 297873 - DNA, 426 bp, Homo sapiens
  misc_feature: NA.49.24.C02.1.454.light.1.nb
ctgaggaaaacaaaccccagctgggaagcctgagaacacgtagccttcatgagtgtccccaccatggcctggatgatgcttctcctcggactccttgcttatggatcaggtgtggaatctcagactgtggtgacccaggagccatcgttgtcagtgtccccggggggacagtcacactcacttgtggcttgagctctggctcagtctcaactggttactaccccagctggtaccagcagaccccaggccaggctccacgcacgctcatgtacgatacaaatagtcgctcttctggggtccctgatcgcttctctggctccatccttgggaacaaagctgccctcaccatcgacggggcccaggcagatgatgaatgtgattattactgtgtgctgtatctgggtggtggtctttttcggtgttcgg

SEQ ID NO: 297874 - DNA, 493 bp, Homo sapiens
  misc_feature: NA.49.26.C04.4.454.light.1.nb
caggaggcagagctctgggaatctcaccatggcctggacccctctcctgcctccccctcctcactttctgcacagtctctgaggcctcctatgagctgacacagccaccctcggtgtcggtcgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtcctaggtcagcccaaggctgccccctggtcactctgttcccacctcctctctctcgactctgagcgggctggcaaggcgcata

SEQ ID NO: 297875 - DNA, 356 bp, Homo sapiens
  misc_feature: NA.49.28.C06.1.454.light.1.nb
gtgctcagttaggacccagacggaaccatggaagccccagcgcagcttctcttcctcctgctactctggctcccagagaccactggagaaatagcgatgacgcagtctccagccaccctgtctgtgtctccgaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtatttgctagtttattactgtcag

SEQ ID NO: 297876 - DNA, 358 bp, Homo sapiens
  misc_feature: NA.49.33.C11.1.454.light.1.nb
gtgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtactcccagccaggttcagtggcaggtgggtctgggacagagttcactctcaccatcagcagcctgcagtctagaagtattttgctagtttattactgtca

SEQ ID NO: 297877 - DNA, 68 bp, Homo sapiens
  misc_feature: NA.49.34.D01.2.454.light.1.nb
gctgccccagcgtcactctgttcccaccctcctctctctcgactctgagcgggctggcaaggcgcata

SEQ ID NO: 297878 - DNA, 430 bp, Homo sapiens
  misc_feature: NA.49.35.D02.1.454.light.1.nb
caagaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggaccaactgaccgtcctacgtcagcccaaggc

SEQ ID NO: 297879 - DNA, 414 bp, Homo sapiens
  misc_feature: NA.49.40.D07.1.454.light.1.nb
ctcaggaagcagcatcgggggtgccgcagccatggcctggaccgctctccttctgagcctccttgctcactttacaggttatgtggcctcctacgaagtgattcagccacgttccgtctcagtggccctgggacagacggccacaattacctgtgacggcgagaacaatcgaaataagaatattcactggtatcaacaaaagcctggccaggcccctgttttggtcctttatcgagacttcaatcggcccgctgggatccctgagcgattctctggctccacgtcggggaacagggccactctgaccatcatcagggcccagggcgacgatgaggctgactattactgtcaggtcgaagacgccaaacttgtcatattcggcggagggaccaaagttgaccgtcctgggtcagc

SEQ ID NO: 297880 - DNA, 97 bp, Homo sapiens
  misc_feature: NA.49.41.D08.1.454.light.1.nb
tttatgcgccttgccagcccgctcagagtcgagagagaggagggtgggaacagaaacacgtcagggccagcccctttccctttctcgcgtgactaaa

SEQ ID NO: 297881 - DNA, 383 bp, Homo sapiens
  misc_feature: NA.49.46.E02.1.454.light.1.nb
gctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgctagtttattactgtcagcagcgtagcaactggcctctcactttcggc

SEQ ID NO: 297882 - DNA, 90 bp, Homo sapiens
  misc_feature: NA.49.5.A05.2.454.light.1.nb
actctgaacggtcagcccaaggctgccccctcggtcactctgttcccaccctcctctctctcgactctgagcgggctggcaaggcgcata

SEQ ID NO: 297883 - DNA, 391 bp, Homo sapiens
  misc_feature: NA.49.52.E08.1.454.light.1.nb
caggaggcagaactctgggtgtctcaccatggcctggatccctctacttctccccctcctcactctctgcacaggctctgaggcctcctatgagctgacacagccaccctcggtgtcagtcgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggactgcgac

SEQ ID NO: 297884 - DNA, 261 bp, Homo sapiens
  misc_feature: NA.49.52.E08.2.454.light.1.nb
gaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataacctttctcctggtaccaacaacaccaggacaaacgcccccaaactcatcatttatgaggccgatcagccggccctcga

SEQ ID NO: 297885 - DNA, 418 bp, Homo sapiens
  misc_feature: NA.49.53.E09.1.454.light.1.nb
tccaggaggcagaactctgggtgtctcaccatggcctggatccctctacttctcccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgaggctgactattactgtcagtcatcagacagtagtggcacttctgtcgtattcggcggagggaccaagctgaccgtctaggtcagccc

SEQ ID NO: 297886 - DNA, 59 bp, Homo sapiens
  misc_feature: NA.49.61.F06.1.454.light.1.nb
acgtgtttctgttcccaccctcctctctctcgactctgagcgggctggcaaggcgcata

SEQ ID NO: 297887 - DNA, 406 bp, Homo sapiens
  misc_feature: NA.49.62.F07.1.454.light.1.nb
gtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtc

SEQ ID NO: 297888 - DNA, 84 bp, Homo sapiens
  misc_feature: NA.49.62.F07.2.454.light.1.nb
ccataaagggaaggggctggccctgacgtgtttctgttcccgccctcctctctctcgactctgagcgggctggcaaggcgcata

SEQ ID NO: 297889 - DNA, 378 bp, Homo sapiens
  misc_feature: NA.49.64.F09.1.454.light.1.nb
agtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccgggaagcccctaagttactgatctatgctgcagccaatttgcaaagtgggtcccatcaaggttcagtggcagtggatctgggacagaattcactctcaccatcagcagtctgcaacctgaagattttggaaagttactattgtcaacagagttacggaaacttgactcattttcggcgg

SEQ ID NO: 297890 - DNA, 222 bp, Homo sapiens
  misc_feature: NA.49.65.F10.2.454.light.1.nb
atttagctacgctctaggggacacggccaccctgaccatcagcagggtcgaagccggggatgaggccgactattactgtcacgtgtgggacagtagtagtgatcatgtggtgttcggcggagggaccaagctgaccgtcctaggtcagcccaaggctgccccctggtcactctgttcccaccctcctctctctcgactctgagcgggctggcaaggcgcata

SEQ ID NO: 297891 - DNA, 220 bp, Homo sapiens
  misc_feature: NA.49.65.F10.3.454.light.1.nb
tttagctacgactgcagggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcgactctgagcgggctggcaaggcgcata

SEQ ID NO: 297892 - DNA, 392 bp, Homo sapiens
  misc_feature: NA.49.66.F11.1.454.light.1.nb
gttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggttggacagacttcacgctcaccatcagcagcctagagcctgaagtattttgctagtttattactgtcaacagcgtacacaggattcactttcggccctgggaccagagtggata

SEQ ID NO: 297893 - DNA, 58 bp, Homo sapiens
  misc_feature: NA.49.67.G01.1.454.light.1.nb
gctgcctggtcaaggactacttcctctctcgactctgagcgggctggcaaggcgcata

SEQ ID NO: 297894 - DNA, 400 bp, Homo sapiens
  misc_feature: NA.49.73.G07.4.454.light.1.nb
cgtttagagagagtgtgttgggtttgggggtgggtccaggaggcagaactctgggtgtctcaccatggcctggatccctctacttctccccctctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcgagggacccctgagcgattctctggctccagctcagcgacaacagtcacgttgaccatcagtggagtccgggcagaggacgaggctgactattactgtcagtcatcagacagtagt

SEQ ID NO: 297895 - DNA, 407 bp, Homo sapiens
  misc_feature: NA.49.81.H04.1.454.light.1.nb
tcatcatgacctgctcccctctcctcctcacccttctcattcactgcacagggtcctgggcccagtctgtgttgacgcagccgccctcagtgtctgcggccccaggacagaaagtcaccatctcctgctctggaagcagctccaacattgggaagaattatgtatcgtggtaccagcagttcccaggaacggccccagactcctcattcatgacaataacaagcgagtcccagagattcctgaccgattctctggctccaagtctggcacctcagccaccctggccatcaccggactccagactggggacaggccgattatactgcggaacatgggattccagcctgagtggtgtcagggtgttcggcggagggaccaagctgaccgtctaggtcagcccaggctgg

SEQ ID NO: 297896 - DNA, 350 bp, Homo sapiens
  misc_feature: NA.49.81.H04.2.454.light.1.nb
gacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaacgcccctaacctcctgatctacgatgcatccaatttggaaatagggtcccatcaaggttcagtggaagtggatctgggacgtatttacttcacatcatcaacctgcagcctgaggatattgcaacatattactgtcaacaatatgataat

SEQ ID NO: 297897 - DNA, 96 bp, Homo sapiens
  misc_feature: NA.49.82.H05.3.454.light.1.nb
gatttagtcacgcgagaaagggaaggggctggccctgacgtgtttctgttcccaccctcctctctctcgactctgagcgggctggcaaggcgcata

SEQ ID NO: 297898 - DNA, 412 bp, Homo sapiens
  misc_feature: NA.49.82.H05.4.454.light.1.nb
aggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctcaggctggggacgaggctgattattattgctgttcatatgccggtgatgtggccgaagggtgttcggcggagggaccgaaggtgaccgt

SEQ ID NO: 297899 - DNA, 123 bp, Homo sapiens
  misc_feature: NA.49.83.H06.2.454.light.1.nb
acgtgcgtcgcgggcacgaccggtgctcgatttagtcacgcgagaaaggaaggggctggccctgacgtgtttctgttcccgccctcctctctctcgactctgagcgggctggcaaggcgcata

SEQ ID NO: 297900 - DNA, 399 bp, Homo sapiens
  misc_feature: NA.49.85.H08.1.454.light.1.nb
gaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggagacaaagttgggggataaatatgctggctggtatcagcagaagccaggccagtcccctgtgttggtcatctatcaagataccaagcggccctcagggatccctgagcgattctctggctccaactctgggaacacagccactctgaccatcagcgggactcaggctatcgatgagctgactattactgtcaggcgtgggacagccgcacgtggggtattcgggcggaggaccaagctgaccgtc

SEQ ID NO: 297901 - DNA, 403 bp, Homo sapiens
  misc_feature: NA.49.9.A09.1.454.light.1.nb
cagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatggaggccgactatatctgtcaggtgtgggatagtagtagtgctcgttccgggggtgttcgggcggagggaccaaggtt

SEQ ID NO: 297902 - DNA, 475 bp, Homo sapiens
  misc_feature: NA.4.1.A01.1.454.light.1.nb
taggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtactccctgccaggttccgtggcagtgggtctgggacagagttcactctcaccatcagcagcctgcagtctgatgatgttgctagtttattactgtcatcaatatggtgaccggcccacgttcggccaagggaccaaggtggaaatcaaacgaactgtggctgcaccatctgtcttcatcttcccgcatctgactacagtgctctgagcgggctggcaaggcgcata

SEQ ID NO: 297903 - DNA, 318 bp, Homo sapiens
  misc_feature: NA.4.10.A10.1.454.light.1.nb
caggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggctattttcagttatttagcctggtatcagacaaaaaccgagggaaacgcccctaagctcctgatctatggtgcatccactttgcaaagtggggtcccatcaaggttcagcggcagtggatcgtgggacagatttcactctcaccatcagcagcctaca

SEQ ID NO: 297904 - DNA, 61 bp, Homo sapiens
  misc_feature: NA.4.12.B01.1.454.light.1.nb
tatgcgccttgccagcccgctcagagcactgtagggaagtagtccttgaccaggcagctat

SEQ ID NO: 297905 - DNA, 61 bp, Homo sapiens; identical to SEQ ID NO: 297904
  misc_feature: NA.4.13.B02.1.454.light.1.nb

SEQ ID NO: 297906 - DNA, 404 bp, Homo sapiens
  misc_feature: NA.4.28.C06.1.454.light.1.nb
caggaagcagcatcggaggtgcctcagccatggcatggatccctctcttcctcggcgtccttgcttactgcacaggatccggggcctcctatcaactgactcaaccaccctcactgtccgtctctccaggacggacagccgtcatcacctgctctgcaaacgacttgggggagagatatgtttcctggtatctccagaggccaggccactcccctattctagtcatgtatcaaactacgaagcgcccctcaggggtccctgagcgcttttctggctccaagtctggggacacagccactctgactctctccggggcccaggccatcgatgagggagactattactgtcaggcgtgggacagcacaactgcagtcttcggcggagggaccgagggtcgaccgtcc

SEQ ID NO: 297907 - DNA, 87 bp, Homo sapiens; identical to SEQ ID NO: 297177
  misc_feature: NA.4.30.C08.1.454.light.1.nb

SEQ ID NO: 297908 - DNA, 371 bp, Homo sapiens
  misc_feature: NA.4.34.D01.1.454.light.1.nb
caggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggactt

SEQ ID NO: 297909 - DNA, 338 bp, Homo sapiens
  misc_feature: NA.4.37.D04.1.454.light.1.nb
tcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaacgcccccaaatcattttagatgctgaggacgaggctgattattactgcagctcatatacaagcagcagcacgtgggtcttcggaactgggaccaaggtcaccgtcgtcccagtc

SEQ ID NO: 297910 - DNA, 485 bp, Homo sapiens
  misc_feature: NA.4.38.D05.2.454.light.1.nb
ctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttaacctggtaccagcagaaacctggccaggctcccaggctcctcatctatggtgcatccagcagggccactggcatcccagacaggttcagtggcaggtgggtctgggacagacttcactctcaccatcagcagactggagcctgaagtattttgcagtgtattactgtcagcagtgtggtagctcaccgacgttcggccaagggaccaaggtggaaatcaaacgaactgtggctgcaccatctgtcttcatcttcccgccatctgactacagtgctctgagcgggctggcaaggcgcata

SEQ ID NO: 297911 - DNA, 290 bp, Homo sapiens
  misc_feature: NA.4.45.E01.1.454.light.1.nb
gctgtgctagagaagacaggattcaggacaatctccagcatggccggcttccctctcctcctcaccctcctcactcactgtgcagggtcctgggtccagtctgtgctgactcagccaccctcagcgtctcggggacccccgggcaggagggtcaccatctcttgttctggaagcaactccaacatcgaaacttattatgtatactggtaccagcagttcccaggaaccgcccccaaactcctcatctataagaataatcagcggccctcgacggggtccctgaccgattc

SEQ ID NO: 297912 - DNA, 356 bp, Homo sapiens
  misc_feature: NA.4.47.E03.1.454.light.1.nb
ctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctactctggagatgcattgccataccagcagaagtcagaccaggcccctgttctggtcatctgtggagacaccaaacgaccctccgggatccctgagagattctctggctccagctcagggacaatggccaccttgactatcagtggggcccaggtggaggatgaacctgactactattgttactcaacagacagcagtgactaatc

SEQ ID NO: 297913 - DNA, 409 bp, Homo sapiens
  misc_feature: NA.4.49.E05.1.454.light.1.nb
gggcctcaggaagcagcatcggaggtgcctcagccatggcatggatccctctcttcctcggcgtccttgcttactgcacaggattcggggcctcctatcaactgactcagccaccctcagtgtccgtctccccaggacggacagccgtcatgacctgctctggaaacaacttggggtccagatatgtttcctggtatctccagaggccaggccactcccccattttagcatgtatcaaacttcgaggcgcccctcaggagtccctgaacgcttttcgggctccaagtctggggacacagccactctgactattaccggggccaggccatcgatgagggagactttactgtcaggcgtgggacagcacaacttccatcttcggcggagggacacggatgaccgtctgggt

SEQ ID NO: 297914 - DNA, 81 bp, Homo sapiens
  misc_feature: NA.4.5.A05.1.454.light.1.nb
aaacgaactgtggctgcaccatctgtcttcatcttcccgccatctgactacagtgctctgagcgggctggcaaggcgcata

SEQ ID NO: 297915 - DNA, 367 bp, Homo sapiens
  misc_feature: NA.4.51.E07.1.454.light.1.nb
ctgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagtattttggagtttatactgtcagcagtataataact

SEQ ID NO: 297916 - DNA, 356 bp, Homo sapiens
  misc_feature: NA.4.52.E08.1.454.light.1.nb
ctgctcagttaggacccagagggaaccatggaagccccagctcagcttctcttcctcctgctactctggctcccagactaccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtggtctgggacagacttcactctcaccatcaccagcctagagcctgaggattttgctagtttattactgtcagc

SEQ ID NO: 297917 - DNA, 376 bp, Homo sapiens
  misc_feature: NA.4.57.F02.1.454.light.1.nb
gtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtccatcaagattcagtggcagtggatctgggacagatttcactctcaccatcagtagtctacaacctgaagattttgcaacttactactgtcaacagagttacgataccctcgctcactt

SEQ ID NO: 297918 - DNA, 185 bp, Homo sapiens
  misc_feature: NA.4.8.A08.1.454.light.1.nb
  modified_base (144)..(144): a, c, t, g, unknown or other
  misc_feature (144)..(144): n is a, c, g, or t
actgctcagttaggacccagacggaaccatggaagccccagcgcagcttctcttcctcctgctactctggcctcccagactaccactggagaaatagtgatgacgcagtctccagcccaccctgtctgtgtctccaggggaaangccaccctctcctgcaggccagtcagagtgttaggagcaac

SEQ ID NO: 297919 - DNA, 366 bp, Homo sapiens
  misc_feature: NA.4.87.H10.1.454.light.1.nb
cagggcagagggtcgccatctcctgcactgggagcagctccaacatcggggcaggttatggcgtacagtggtaccagcagcttccagggacagcccccaaactcctcatctatgctaacaacattcggccctcaggggtccctgaacggttctctggctccaagtctggcacctcagcctccctggccatcactgggctccaggctgaggatgaggctgattattactgccagtcctatgacagcagcctgagtggttcgggattcggcggagggaccaaactgaccgtctaagtcagcccaaggctcgcccctggtcactctcgttccccgccctcctcctacagtcgctctgacgcgggctggc

SEQ ID NO: 297920 - DNA, 320 bp, Homo sapiens
  misc_feature: NA.51.1.A01.1.454.light.1.nb
cacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagacaaaaaccgagggaaagcccctaagctcctgatcctcgatgcatccaatttggaaacaggggtcccatcaaggttcagtgcaagtggctcgtgggacagtatttcactttcaccatcagcagactgcagcctagaa

SEQ ID NO: 297921 - DNA, 302 bp, Homo sapiens
  misc_feature: NA.51.10.A10.1.454.light.1.nb
tcagctgtgggtagagaagacaggactcaggacaatctccagcatggccagcttccctctcctcctcaccctcctcactcactgtgcagggtcctgggcccaatctgtgctgactcagccaccctcagcgtctcgggacccccgggcagagggtcaccatctcctgttctggaagcaactccaacatcggaagttatactgcagactggtaccagcaactcccaggactccggacccccaaactcctcatctatactactaatcaacgggccacgacggggtccctagaccgattcctccgg

SEQ ID NO: 297922 - DNA, 144 bp, Homo sapiens
  misc_feature: NA.51.12.B01.2.454.light.1.nb
acaacggtcacattggccatcagtggagtccaggcagaggacgaggctgactattattgtcaatcaacagacaccattggtacttatgtcttcggaactgcgaccaaggtcaccgtcctgggtcagcccaaggccaaccccact

SEQ ID NO: 297923 - DNA, 84 bp, Homo sapiens
  misc_feature: NA.51.12.B01.4.454.light.1.nb
ggaggcagaactctgggtgtctcaccatggcctggatccctctacttctccccctcctcactctctgcacaggctctgaggcct

SEQ ID NO: 297924 - DNA, 129 bp, Homo sapiens
  misc_feature: NA.51.14.B03.1.454.light.1.nb
ctcgatttagtgtgagtagttccgcgggcacgaccggtgctcgatttagagtgctacgaagggaaaggcagcgtcactctgttcccaccctcctctcgtagcactctgagcgggctggcaaggcgcata

SEQ ID NO: 297925 - DNA, 223 bp, Homo sapiens
  misc_feature: NA.51.15.B04.1.454.light.1.nb
tcgatttagagctcacgtattggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccatctgatcgtagcactctgagcgggctggcaaggcgcata

SEQ ID NO: 297926 - DNA, 129 bp, Homo sapiens
  misc_feature: NA.51.15.B04.3.454.light.1.nb
tcgatttagacagtatatatccgcgggcacgaccggtgctcgatttagagtgctacgaagggaaagggcagcgtcactctgttcccgccctcctctcgtagcactctgagcgggctggcaaggcgcata

SEQ ID NO: 297927 - DNA, 110 bp, Homo sapiens
  misc_feature: NA.51.22.B11.1.454.light.1.nb
gctcagggcacgaccggtgctcgatttagagtgctacgaagggaaagggcagcgtcactctgttcccgccctcctctcgtagcactctgagcgggctggcaaggcgcata

SEQ ID NO: 297928 - DNA, 262 bp, Homo sapiens
  misc_feature: NA.51.26.C04.1.454.light.1.nb
cctgggcctcaggaagcagcatcggaggtgcctcagccatggcatggatccctctcttcctcggcgtccttgcttactgcacaggatccctggccgcctatgacctgactcagccaccctcagtgtccgtgtccctaggacagacagccaccatcacctgctctggagataatttggggtctaagtatgtttcgtggtatcaacatcacccaggccgtccccgatactgctcctctatcatgatgccaagcggccctcaggg

SEQ ID NO: 297929 - DNA, 347 bp, Homo sapiens
  misc_feature: NA.51.27.C05.1.454.light.1.nb
caggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaatcatgatttatgatgtcagtgatcggccctgaggggtttcaatcgcttctctggctcaagtccggcaacacggcctccctgaccatctctgggcctccgaggccgaggacgaggctga

SEQ ID NO: 297930 - DNA, 344 bp, Homo sapiens
  misc_feature: NA.51.28.C06.1.454.light.1.nb
caggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttac

SEQ ID NO: 297931 - DNA, 314 bp, Homo sapiens
  misc_feature: NA.51.3.A03.1.454.light.1.nb
ggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagccaggccaggcccctgtttggttatttataaagactttgagaggccctcagggacccctgagcgattctctggctccagctcagcgacaacagtcacgttgaccatcagtggagtccagg

SEQ ID NO: 297932 - DNA, 52 bp, Homo sapiens
  misc_feature: NA.51.30.C08.1.454.light.1.nb
tctgttcccaccctcctctcgtagcactctgagcgggctggcaaggcgcata

SEQ ID NO: 297933 - DNA, 363 bp, Homo sapiens
  misc_feature: NA.51.32.C10.1.454.light.1.nb
agtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaatggtatcagcagaaaccagggaaagcccctaactcctgatctatgctgcagccactttgcaaagtgagtcccatcgagttcagtggcagtgggtctgggacagatttctctctcaccattagcagtctgcaacctgaagtattttgctaacttactactgtacaacagagttacaa

SEQ ID NO: 297934 - DNA, 375 bp, Homo sapiens
  misc_feature: NA.51.35.D02.1.454.light.1.nb
ccaggaggcagaactctgggtgtctcaccatggcctggatccctctacttctccccctcctcactctctgcacaggctctgaggcctcctatgagctgacacagcccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttat

SEQ ID NO: 297935 - DNA, 373 bp, Homo sapiens
  misc_feature: NA.51.38.D05.1.454.light.1.nb
caggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggccaaagcccccaaatcatgatttatgatgtcagtgatcggccctcgaggggtttcaatcgcttctctggctccaagtccggcaacacggcctccctgaccatctctggcctccgaggccgaggacgaggctgatttatactgcagctcatatacaat

SEQ ID NO: 297936 - DNA, 377 bp, Homo sapiens
  misc_feature: NA.51.40.D07.1.454.light.1.nb
agtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacagggtcccatcaaggttcagtggaagtggttctgggacagtattttacttcaccatcagcagccttcaccctgaagatcttgcaacatattactgtcaacagtatgataatctccactcacttt

SEQ ID NO: 297937 - DNA, 83 bp, Homo sapiens
  misc_feature: NA.51.42.D09.1.454.light.1.nb
tcaaacgaactgtggctgcaccatctgtcttcatcttcccgccatctgatcgtagcactctgagcgggctggcaaggcgcata

SEQ ID NO: 297938 - DNA, 51 bp, Homo sapiens
  misc_feature: NA.51.42.D09.2.454.light.1.nb
ctgttcccaccctcctctcgtagcactctgagcgggctggcaaggcgcata

SEQ ID NO: 297939 - DNA, 256 bp, Homo sapiens
  misc_feature: NA.51.43.D10.1.454.light.1.nb
cgcagcactggtggtgcctcagccatggcctggaccgttctcctcctcggcctcctctctcactgcacagtctctgtgacatcctatgtgctgactcagccaccctcggtgtcagtggccccaggacagacggccaggatttcctggtgggggagacaacattggaaagtaaaagtgtacactggtaccagcagaggccaggccaggccctgtgttggtcgtctatgattataacgaccggccctcgagggatccc

SEQ ID NO: 297940 - DNA, 87 bp, Homo sapiens
  misc_feature: NA.51.45.E01.1.454.light.1.nb
tatgcgccttgccagcccgctcagagtgctacgatcagatggcgggaagatgaagacagatggtgcagccacagttcgtttaatctc

SEQ ID NO: 297941 - DNA, 54 bp, Homo sapiens
  misc_feature: NA.51.45.E01.2.454.light.1.nb
tatgcgccttgccagcccgctcagagtgctacgagaggagggcgggaacagagt

SEQ ID NO: 297942 - DNA, 305 bp, Homo sapiens
  misc_feature: NA.51.5.A05.2.454.light.1.nb
ggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaaagaaatctgtctttttggaccatcagaggccaggccaggcccctgtattggtcatctatgaggacaccaagcgaccctccggaatccctgagagagtcgctggctccaggtcagggacaagtggccacttgactatcac

SEQ ID NO: 297943 - DNA, 207 bp, Homo sapiens
  misc_feature: NA.51.52.E08.1.454.light.1.nb
  modified_base (178)..(178): a, c, t, g, unknown or other
  misc_feature (178)..(178): n is a, c, g, or t
caggaggcagagctctgattgtctcaccatggcctggatccctctcctgcctccccctcctcattctctgcacagtctctgtggcctcctatgagctgacacagccatactcagtgtcagtgtctccgggacagacagccaggatcacctgctcaggagatgtactagggaaaaaatntgctcgttgttccagcagaggcggccagg

SEQ ID NO: 297944 - DNA, 130 bp, Homo sapiens
  misc_feature: NA.51.52.E08.2.454.light.1.nb
ctcgatttagtcgagctctctcgcagggcacgaccggtgctcgatttagagtgctacgaagggaaagggcagcgtcactctgttcccaccctcctctcgtagcactctgagcgggctggcaaggcgcata

SEQ ID NO: 297945 - DNA, 52 bp, Homo sapiens; identical to SEQ ID NO: 297932
  misc_feature: NA.51.58.F03.1.454.light.1.nb

SEQ ID NO: 297946 - DNA, 386 bp, Homo sapiens
  misc_feature: NA.51.59.F04.1.454.light.1.nb
agcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattg

SEQ ID NO: 297947 - DNA, 463 bp, Homo sapiens
  misc_feature: NA.51.6.A06.1.454.light.1.nb
tagatctactgacaggggtggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtgtacttatgtcttcggaactgggaccaggtcaccgtctaggtcagcccaaggccc

SEQ ID NO: 297948 - DNA, 328 bp, Homo sapiens
  misc_feature: NA.51.60.F05.1.454.light.1.nb
tgtagggccagtcagagtgttagcagcaactacttagcctggtaccagcagacacctggccaggctcccaggctcctcatccatggtgcatccaccagggccactggcatcccagacaggttcagtggcagtgggtctgggacagacttcattctcaccatcagcagactggagcctgaagattttgcagtgtattactgtcagcagtacggtagttcatctccgacgttcggccaagggaccaaggtggaaatcaaacgaactgtggctgcaccatctgtcttcatcttcccgcatctgatcgtagcactctgagcgggctgggcaa

SEQ ID NO: 297949 - DNA, 312 bp, Homo sapiens
  misc_feature: NA.51.60.F05.2.454.light.1.nb
ggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacacgccactctgaccatcagcgg

SEQ ID NO: 297950 - DNA, 374 bp, Homo sapiens
  misc_feature: NA.51.67.G01.1.454.light.1.nb
gtgctcgatttagagtatacatattgggtttgggggcaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacacgacccctaaactcctgactcctcgatgcatccactttggaacagggtcccatcaaggttcagtggaagtggctctgggacagtattttacttcaccatcagcaggctgcagcctgaa

SEQ ID NO: 297951 - DNA, 188 bp, Homo sapiens
  misc_feature: NA.51.70.G04.1.454.light.1.nb
actggtaccagcagcttccaggaacagcccccaaactcctcatttattctaacacccatcggccctcaggggtccctgatcgattctctggctccaagtctggcacctcagcctccctggccatcactggactccaggctgagatgaggctgattattactgccagtcctatgacatcagcctgagtc

SEQ ID NO: 297952 - DNA, 51 bp, Homo sapiens
  misc_feature: NA.51.70.G04.2.454.light.1.nb
tatgcgccttgccagcccgctcagagtgctacgagaggagggcgggaacag

SEQ ID NO: 297953 - DNA, 419 bp, Homo sapiens
  misc_feature: NA.51.71.G05.1.454.light.1.nb
aggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcacgtctgggtcagcccaaggccaa

SEQ ID NO: 297954 - DNA, 52 bp, Homo sapiens
  misc_feature: NA.51.72.G06.1.454.light.1.nb
tctgttcccgccctcctctcgtagcactctgagcgggctggcaaggcgcata

SEQ ID NO: 297955 - DNA, 310 bp, Homo sapiens
  misc_feature: NA.51.73.G07.1.454.light.1.nb
tttagtacacgtgattagggattgggggaggaactgctcagttaggacccagagggaaccatggaagccccagctcagcttctcttcctcctgctactctggctcccagataccatcggggaaactgtgttgacacagtctccagccaccctgtctttgtctccaggggaaagccaccctctcctgcagggccagtgagagtattgacatcttcttggcctggtaccaacagaaacctggccaggctccccgactcctcatttatgatgcatccaaaagggtcgttggcatcccagccaggttcagtggc

SEQ ID NO: 297956 - DNA, 218 bp, Homo sapiens
  misc_feature: NA.51.73.G07.2.454.light.1.nb
gatttagagctcacgtattgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctggtcactctgttcccgccatctgatcgtagcactctgagcgggctggcaaggcgcata

SEQ ID NO: 297957 - DNA, 362 bp, Homo sapiens
  misc_feature: NA.51.76.G10.1.454.light.1.nb
gttaggacccagacggaaccatggaagccccagcgcagcttctcttcctcctgctactctggctcccagataccactggagaagtagtgatgacgcagtctccagccaccctgtctgtgtctccgaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagtatttgctaatttattactgtcagcagtataataact

SEQ ID NO: 297958 - DNA, 90 bp, Homo sapiens
  misc_feature: NA.51.79.H02.1.454.light.1.nb
ctcgatttagagtgctacgaagggaagggcagcgtcactctgttcccaccctcctctcgtagcactctgagcgggctggcaaggcgcata

SEQ ID NO: 297959 - DNA, 289 bp, Homo sapiens
  misc_feature: NA.51.81.H04.1.454.light.1.nb
  modified_base (171)..(171): a, c, t, g, unknown or other
  misc_feature (171)..(171): n is a, c, g, or t
aggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgaccaaaccgntatgcttattggtaccagcagaagccggccacggcccctgtgttggtgatgtataaagacactgagaggccctcagggatccctgagcgattctctggctccaggtcagggacaacgg

SEQ ID NO: 297960 - DNA, 299 bp, Homo sapiens
  misc_feature: NA.51.82.H05.1.454.light.1.nb
gtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggaacagttccaacatcggggcaggttataatgtacactggtaccagcaacttccaggaacacgcccccaaactcctcatccatgataccagaaactcggccctcgggggtccctgaccgattctctggctccaa

SEQ ID NO: 297961 - DNA, 363 bp, Homo sapiens
  misc_feature: NA.51.83.H06.1.454.light.1.nb
tcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagtatttgctagtttattattgtcagcagcgaaacaac

SEQ ID NO: 297962 - DNA, 368 bp, Homo sapiens
  misc_feature: NA.52.1.A01.1.454.light.1.nb
gtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctagaactcctgatctatggttcatccactttgctgagtggggtcccatcaaggttcagtggcagtggatcgtgggacagaattcactctcaccatcaccagtctgcaggctgaggtattttgctaacttacttctgtcaacagagttacagttccctc

SEQ ID NO: 297963 - DNA, 209 bp, Homo sapiens
  misc_feature: NA.52.10.A10.1.454.light.1.nb
aggcacacaacagaggcagttacagacttcactctcaccatcagcaacctagagcctgaagactttgcagtttattactgtcagcagcgtagtaagtggcgcttcggccaagggacacgactggaggttaaacgaactgtggctgcaccatctgtcttcatcttcccgcatctgatatacgatcgctgagcgggctggcaaggcgcata

SEQ ID NO: 297964 - DNA, 359 bp, Homo sapiens
  misc_feature: NA.52.14.B03.1.454.light.1.nb
cagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaacgcccctaaactcctgatctataaggcgtctagtttagaaagtggggtcccttcaaggttcagcggcagtggatctgggacagaattcactctcaccatcaacagcctgcagcctgatgatttgctaacttattactgccaacactataatc

SEQ ID NO: 297965 - DNA, 298 bp, Homo sapiens
  misc_feature: NA.52.15.B04.1.454.light.1.nb
aggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaacgtccccaaactcatgatctttgagtcagtgatcggcccgcaggggtttctcatcgcttctccggctccaagtctggcagca

SEQ ID NO: 297966 - DNA, 270 bp, Homo sapiens
  misc_feature: NA.52.15.B04.2.454.light.1.nb
gtggtagagaagacaggattcaggacaatctccagcatggccggcttccctctcctcctcaccctcctcactcactgtgcagggtcctgggcccggtctgtgttgactcagccaccctcaacgtctgggacccccgggcaaagggtcaccatgtcttgttctggaagcagctccaacatcggcactacttatgtgtactgacaccaggtcagcccaaggctgccccctggtcactctgttccccgcctcctctatacgatagctgagcgg

SEQ ID NO: 297967 - DNA, 233 bp, Homo sapiens
  misc_feature: NA.52.17.B06.1.454.light.1.nb
gcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggcaccaacagtgattttggtgttatgtattctgtcttctggtaccaacggcacccaggcaaacgtccccaaactcatgattact

SEQ ID NO: 297968 - DNA, 374 bp, Homo sapiens
  misc_feature: NA.52.2.A02.1.454.light.1.nb
caggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaactcctgatcctcgatgcatccaatttggaaacagggtccatcaaggttcagtggaagtggctcgtgggacagtattttacttcaccatcgccagactgcagcctgaagatattgcaacatattactgtcaacagtatgataatctcccgctcactttcggcgg

SEQ ID NO: 297969 - DNA, 247 bp, Homo sapiens
  misc_feature: NA.52.2.A02.2.454.light.1.nb
tttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcgggctggcaaggcgcata

SEQ ID NO: 297970 - DNA, 488 bp, Homo sapiens
  misc_feature: NA.52.32.C10.1.454.light.1.nb
gagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttacttcaccatcagcaggctgcagcctgaagacattgcaacatattactgtcaacagtatgatagtctcccgctcactttcggcgggggaccaaggtggagatcaagcgaactgtggctgcaccatctgtcttcatcttcccgcatctgatatacgatcgctgagcgggctggcaaggcgcata

SEQ ID NO: 297971 - DNA, 221 bp, Homo sapiens
  misc_feature: NA.52.36.D03.1.454.light.1.nb
gctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactaggggaaaaattatgctgactggtaccagcagaagccaggccaagcccctgag

SEQ ID NO: 297972 - DNA, 339 bp, Homo sapiens
  misc_feature: NA.52.37.D04.1.454.light.1.nb
tctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaacgtccccaaactcatgatctttgaggtcagtgatcggcccgcaggggtttctcatcgcttctccggctccaagtctggcagcacggcctccctgaccatctctgggctccaggctg

SEQ ID NO: 297973 - DNA, 334 bp, Homo sapiens
  misc_feature: NA.52.38.D05.1.454.light.1.nb
ccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgaccaaaccgatatgcttattggtaccagcagaagccgggccaggcccctgtgttggtgatgtataaagacactgagaggccctcagggatcccgtgagcgattctctggctccaggtcagggacaacggtcacattggccatcagtgagtccaggcagaggacgagg

SEQ ID NO: 297974 - DNA, 212 bp, Homo sapiens
  misc_feature: NA.52.4.A04.1.454.light.1.nb
cagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaagataaatatgtttcctggtatcgccagaagccaggccagtcgcctgtcc

SEQ ID NO: 297975 - DNA, 343 bp, Homo sapiens
  misc_feature: NA.52.42.D09.1.454.light.1.nb
gtccaggaggcagaactctgggtgtctcaccatggcctggatccctctacttctcccctcctcactctctgcacaggctctgaggcctcctatgagctgacacagccaccctcggtgtcagtgtccccaggacagacggccaggatcacctgctctggagatgcattgccaaacgatatgcttattggtaccagcagaagccggccaggcccctgtgttggtgatgtataaagacactgagaggccctcagggatccctgagcgattctctggctccgaggtcagggacaacggtcacattggccatcagtggagtccaggcagaggacgaggctgactatta

SEQ ID NO: 297976 - DNA, 324 bp, Homo sapiens
  misc_feature: NA.52.46.E02.1.454.light.1.nb
ctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaacgtccccaaactcatgatctttgaggtcaatgatcggcccgcaggggtttctcatcgcttctccggctccaagtctggcagcacggcctcctgaccatctct

SEQ ID NO: 297977 - DNA, 261 bp, Homo sapiens
  misc_feature: NA.52.5.A05.1.454.light.1.nb
agcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattggggatatacatgtttcctggtatcagcagaagccaggccagtctcctgttctcctcatctataaagatgtcaagcgccctcagggatccctgagcgatt

SEQ ID NO: 297978 - DNA, 96 bp, Homo sapiens
  misc_feature: NA.52.52.E08.1.454.light.1.nb
tcgatttagtcacgcgagaagggaagggctggccctgacgtgtttctgttcccgccctcctctatacgatcgctgagcgggctggcaaggcgcata

SEQ ID NO: 297979 - DNA, 66 bp, Homo sapiens
  misc_feature: NA.52.52.E08.2.454.light.1.nb
gaggcagaactctgggtgtctcaccatggcctggatccctctacttcctccccctcctcactctct

SEQ ID NO: 297980 - DNA, 260 bp, Homo sapiens
  misc_feature: NA.52.53.E09.2.454.light.1.nb
tggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtggcactacacctacgccatcgcatggcatcagctgcagccagagaagggccctggtacttgatgaggctcaacagtgatggcagccacagcgagggggacgtatccc

SEQ ID NO: 297981 - DNA, 317 bp, Homo sapiens
  misc_feature: NA.52.57.F02.1.454.light.1.nb
agggtggtgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctatatgcaggcgacaacaatttgggggtttcgcggagggaccaaggtgaccgtcctacgtcagcccaaggctgcccctggtcactctgttcccacctcctctatacgatcgctgagcggg

SEQ ID NO: 297982 - DNA, 234 bp, Homo sapiens
  misc_feature: NA.52.57.F02.2.454.light.1.nb
caggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactca

SEQ ID NO: 297983 - DNA, 323 bp, Homo sapiens
  misc_feature: NA.52.6.A06.1.454.light.1.nb
gcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcaccggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctcc

SEQ ID NO: 297984 - DNA, 248 bp, Homo sapiens
  misc_feature: NA.52.60.F05.1.454.light.1.nb
  modified_base (176)..(176): a, c, t, g, unknown or other
  misc_feature (176)..(176): n is a, c, g, or t
gaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaaccgtttntgcttattggtaccagcagaagccaggccaggcccctgtgttggtgatatataaggacactgagacggccct

SEQ ID NO: 297985 - DNA, 257 bp, Homo sapiens
  misc_feature: NA.52.63.F08.1.454.light.1.nb
ctgtgagcgcagaaggcaggactcgggacaatcttcatcatgacctgctcccctctcctcctcacccttctcattcactgcacagggtcctgggcccagtctggtttgacgcagccgccctcagtgtctgcggccccgggacagcaggtcaccatctcctgctctggaagcagacccagcattgggagtaattatgtctcctggtaccagcagctcccaggaacaaccccaaactcctcatctatgacaatgataag

SEQ ID NO: 297986 - DNA, 185 bp, Homo sapiens
  misc_feature: NA.52.65.F10.1.454.light.1.nb
tcctcaccatcagcagcctgcagcctgaagattttgcgacttactattgtcaacaggggtacagttttccgtacacctttggccaggggactaagctggacatcaaacgaactgtggctgcaccatctgtcttcatcttcccgccatctgatatacgatcgctgagcgggctggcaaggcgcata

SEQ ID NO: 297987 - DNA, 291 bp, Homo sapiens
  misc_feature: NA.52.75.G09.1.454.light.1.nb
ggcagcgctctcgggacgtctccaccatggcctgggctctgctattcctcaccctcctcactctgggcacaggatcccgggcccagtctgccctgactcagcctgcctccgtgtctgggtctcctggacagtcgatcaccatctcctgcactggaaccagcagtgacattggtcttataactatgtctcctggtaccgacaacaccccggcaaacgcccccaaactcatgatttatgctgtcacttatcggccgcagggatttctcatcgcttctctggctccaagtctgg

SEQ ID NO: 297988 - DNA, 203 bp, Homo sapiens
  misc_feature: NA.52.75.G09.2.454.light.1.nb
gagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccggggagtcgagacattagcatgtatctgaattggtatcagac

SEQ ID NO: 297989 - DNA, 370 bp, Homo sapiens
  misc_feature: NA.52.76.G10.1.454.light.1.nb
ggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataactctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatacacaaacag

SEQ ID NO: 297990 - DNA, 479 bp, Homo sapiens
  misc_feature: NA.52.78.H01.1.454.light.1.nb
aggaggcagaactctgggtgtctcaccatggcctggatccctctacttctcccctcctcactctctgcacaggctctgggcctcctatgaactgacacagccaccctcggtgtcagtgtcctcaggacagacggccaggatcacctgctctggagatgcactgaccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgcccctggtcactctcgttcccaccctcctctatacgatcgctgagcgggctggcaa

SEQ ID NO: 297991 - DNA, 336 bp, Homo sapiens
  misc_feature: NA.52.8.A08.1.454.light.1.nb
caaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagacaaaaaccagggacagcccctaaactcctgatcctcgatgcatccactttggaaacaggggtcccatcaaggttcagtggaagtggctctgggacagattttacttcacctatcagcaggctgcagcctgaagatattgcaac

SEQ ID NO: 297992 - DNA, 263 bp, Homo sapiens
  misc_feature: NA.52.81.H04.2.454.light.1.nb
gctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattggcaataattttgtgtcctggtaccagcaactcccaggcacacgcccccaaactcctcatttatgacaatgataagcga

SEQ ID NO: 297993 - DNA, 371 bp, Homo sapiens
  misc_feature: NA.52.82.H05.1.454.light.1.nb
ggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctagactaccactgtcaatcaacagacagcagtggttattatgt

SEQ ID NO: 297994 - DNA, 86 bp, Homo sapiens
  misc_feature: NA.52.82.H05.3.454.light.1.nb
cgagttatccacgcccagagctcgaaaacaccgttggtcaaggactacttcctatacgatcgctgagcgggctggcaaggcgcata

SEQ ID NO: 297995 - DNA, 240 bp, Homo sapiens
  misc_feature: NA.52.85.H08.1.454.light.1.nb
aagcagcatcggaggtgcctcagccatggcatggatccctctcttcctcggcgtccttgcttactgcacaggatccgtggcctcctatgacctgactcagccaccctcagtgtccgtgtctccaggacagacagccaccatcacctgctctggagataaagttggggggaaaatatgcttgctggtatcaacagcggccaggccagtcccctgtactggtcatctatctgaatagtaggc

SEQ ID NO: 297996 - DNA, 353 bp, Homo sapiens
  misc_feature: NA.52.86.H09.1.454.light.1.nb
ctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctg

SEQ ID NO: 297997 - DNA, 102 bp, Homo sapiens
  misc_feature: NA.52.89.I01.1.454.light.1.nb
agggaccaaactgaccgtcctaggtcagcccaaggctgccccacggtcactctgttcccaccctcctctatacgatcgctgagcgggctggcaaggcgcata

SEQ ID NO: 297998 - DNA, 352 bp, Homo sapiens
  misc_feature: NA.53.1.A01.1.454.light.1.nb
aggcaggggcagcaagatggtgttgcagacccaggtcttcatttctctgttgctctggatctctggtgcctgcggggacgttcgttttgacccagtctcccgactccctggctgtgtctctgggcgagagggccaccatcaactgcaagtccagccactattttaacacctacaacaataagattaacttagcttggtaccagacaaaaaccaggacagcctcctgagctgctcatttacgggctctacccgggaatcgtgggtccctgaccgattcattggaagcgggtctgggacagtatttcactctcaccatcagcagcctgcaggctgaagatgtggctagtttatt

SEQ ID NO: 297999 - DNA, 270 bp, Homo sapiens
  misc_feature: NA.53.10.A10.1.454.light.1.nb
  modified_base (244)..(244): a, c, t, g, unknown or other
  misc_feature (244)..(244): n is a, c, g, or t
tttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctntgttggtcatgtatcaagataacaag

SEQ ID NO: 298000 - DNA, 345 bp, Homo sapiens
  misc_feature: NA.53.11.A11.1.454.light.1.nb
agaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactatactgtcaatctgcg

SEQ ID NO: 298001 - DNA, 116 bp, Homo sapiens
  misc_feature: NA.53.12.B01.1.454.light.1.nb
tcgatttagtagtgtagattccgcgggcacgaccggtgctcgatttagtagtgtagattcgcggggatggcctccctcgagtctacagtgctctgagcgggctggcaaggcgcata

SEQ ID NO: 298002 - DNA, 123 bp, Homo sapiens
  misc_feature: NA.53.16.B05.1.454.light.1.nb
gtcaggacacagcatggacatgagggtccccgctcagctcctggggctcctgctgctctggctcccaggtgccagatgtgacatccagttcgacccagtcctccatccttcctgtctgcgtct

SEQ ID NO: 298003 - DNA, 115 bp, Homo sapiens
  misc_feature: NA.53.22.B11.1.454.light.1.nb
ccatcagtggagtccaggcagaggacgaggctgactattattgtcaatcaacagacaccattggtacttatgtcttcggaactgcgaccaaggtcaccgtcctgggtcagcccaa

SEQ ID NO: 298004 - DNA, 346 bp, Homo sapiens
  misc_feature: NA.53.27.C05.1.454.light.1.nb
ctcagtcaggacacagcatggacatgagggtccccgctcagctcctggggctcctgctactctggctccgagatgccaattgtgacatccagatgacccagtctccatcctccctgtcagcatctgtaggagacagagtcaccatcacttgccgggcaagtcagatcattggaatccatttaaatggtatcagcagaaaccaggacaagcccctaatattctgatcttggctgcaaacactttgcaaagtgggtccatcaaggttcagtggcagtggatcgtgggacagaattcactctcacgatcaacagtctgcaggctgacgattttgctaacctactactgt

SEQ ID NO: 298005 - DNA, 387 bp, Homo sapiens
  misc_feature: NA.53.28.C06.1.454.light.1.nb
agtcaggacacagcatggacatgagggtccccgctcagctcctggggctcctgctgctctggctcccaggtgccagatgtgacatccagttgacccagtctccatccttcctgtctgcgtctgtgggagacagagtcaccttcacttgccgggccagtcagggcattagcgactctttagcctggtatcagcaaaagccagggatggcccctaagctcctcatctatgctgcttccactttgcatagtggggtctcatcaaggttcggcggcagcggatctgggacagaattcactctcacaattaccaactgcagcctgatgatttgactaacttattactgtacaacagttgatacttaccctcggtacttttggccaggggacc

SEQ ID NO: 298006 - DNA, 424 bp, Homo sapiens
  misc_feature: NA.53.31.C09.1.454.light.1.nb
ggtgctcgatttagacgtctcatcaaggaaggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcgagggacccctgagcgattctctggctccagctcagggacaacagtcaccttgaccatcagtggagtccggcagaggacgaggctgactattactgtcagtccgcagacagcagtggcagttatgtcgta

SEQ ID NO: 298007 - DNA, 362 bp, Homo sapiens
  misc_feature: NA.53.38.D05.1.454.light.1.nb
ccaggaggcagaactctgggtgtctcaccatggcctggatccctctacttctcccctcctcactctctgcacaggctctgaggcctcctatgaggtgacacagccaccctcggtgtcagtgtccccaggacagacggccaggatcacctgctctggagaggcattggacaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtacaatctgcggacag

SEQ ID NO: 298008 - DNA, 343 bp, Homo sapiens
  misc_feature: NA.53.5.A05.1.454.light.1.nb
ggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatggattgccaaagcactatggttactggtaccaacagaagccaggccaggcccctctattggtaatgtataaagacaatgagaggccctgagggatccctgagcgatactctggctccactcagggacaacagtcacattgaccatcagtggagtccaggcagaagacgaggctgactattactgt

SEQ ID NO: 298009 - DNA, 378 bp, Homo sapiens
  misc_feature: NA.53.54.E10.1.454.light.1.nb
cggtgctcgatttagatcgtagcagaacacacaagggggaggaactgctcagttaggacccagacggaaccatggaagccccagcgcagcttctcttcctcctgctactctggctcccagagatcattggagaaatagtgatgacgcagtctccagccaccctgtctgtgtctccgaggggaaagagccaccctctcctgcagggccagtcagagtgttagcagcgacttagcctggtaccagcaaaaacctggccaggctcccaggctcctcatctatggcgcatccaccagggccactgatatcccagccaggttcagtggcagtgggtctgggacagaattcactctcaccatcagcagcctgcagtctgaagta

SEQ ID NO: 298010 - DNA, 267 bp, Homo sapiens
  misc_feature: NA.53.57.F02.1.454.light.1.nb
  modified_base (247)..(247): a, c, t, g, unknown or other
  misc_feature (247)..(247): n is a, c, g, or t
cccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatagaaactatttaaatggtatcagcagaaccaggaaagcccctaaactcctgatctacgatgcatccaatttggaaacngggtcccatcaaggttcagt

SEQ ID NO: 298011 - DNA, 348 bp, Homo sapiens
  misc_feature: NA.53.65.F10.1.454.light.1.nb
aagcagcactggtggtgcctcagccatggcctggaccgttctcctcctcggcctcctctctcactgcacagactctgtgacctcctatgtgctgactcagccaacctcggtgtcagtcggccccaggacagacggccagcattacctggtgggggaaaccacattggagactaaaaatgtgcactggtaccagcagaagccaggccaggcccctgtgctggtcgtctataatggaagcggccggccctcatggatcccgtgggcgattctctggctcaagtctggaacacggccaccctaacatcagcagggtcgaaggccggggatggagggccgactattactgtc

SEQ ID NO: 298012 - DNA, 234 bp, Homo sapiens
  misc_feature: NA.53.71.G05.1.454.light.1.nb
aaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaaagtaaaagtgtgcactggtaccagcacaggccaggccaggcccctgcgctggtcgtctatgat

SEQ ID NO: 298013 - DNA, 360 bp, Homo sapiens
  misc_feature: NA.53.73.G07.2.454.light.1.nb
tcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatctgggacagagttcactctcaccattagcagcctgcagcctgatgatttgctaacttattactgccaacagtacaatactttgt

SEQ ID NO: 298014 - DNA, 35 bp, Homo sapiens
  misc_feature: NA.53.73.G07.5.454.light.1.nb
cgctcagggcacgaccggtgctcgatttagctcta

SEQ ID NO: 298015 - DNA, 219 bp, Homo sapiens
  misc_feature: NA.53.75.G09.1.454.light.1.nb
caggttcagtggcagtgggtttggggcaaacttctctctcaccatcagcagactggagcccgaagattttgcagtgtattactgtcatcagtatgctacatcacctcaaacgttcggccaagggaccaaggtggaagtcaaacgaactgtggctgcaccatctgtcttcatcttcccgcatctgatcgtactgcgctgagcgggctggcaaggcgcata

SEQ ID NO: 298016 - DNA, 17 bp, Homo sapiens
  misc_feature: NA.53.82.H05.2.454.light.1.nb
gggcacgaccggtgctc

SEQ ID NO: 298017 - DNA, 21 bp, Homo sapiens
  misc_feature: NA.53.82.H05.3.454.light.1.nb
gatttagtcgagctctctcgc

SEQ ID NO: 298018 - DNA, 252 bp, Homo sapiens
  misc_feature: NA.53.85.H08.1.454.light.1.nb
gtgggcacaagaggcagcactcaggacaatctccagcatggcctggtctcctctcctcctcactctcctcgctcactgcacagggtcctgggcccagtctgtgctgacgcagccgccctcagtgtcgtcggggccccagggcagagggtcaccatctcctgcacgtgggagcagctccaacagtcggggcacgttatgatgtacactggtaccagcaccttccaggagcacgcccccaacctcctcctctct

SEQ ID NO: 298019 - DNA, 99 bp, Homo sapiens
  misc_feature: NA.5.14.B03.1.454.light.1.nb
tatgcgccttgccagcccgctcagatcagacacggaggagggcgggaacagaaacacgtcagggccagcccctttccctttctcgcgtgactaaatcga

SEQ ID NO: 298020 - DNA, 383 bp, Homo sapiens
  misc_feature: NA.5.24.C02.1.454.light.1.nb
caggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacacccgacaaacgcccccaaactcatcattttgagtcactacgcgaccctcacgggtccctgatcgcttctctgctccaagtctggcaacacggcctccctgaccgtctctgggctccaggctgaggatgaggctgattattactgcagctcatatgcaggcagcagcacgtccc

SEQ ID NO: 298021 - DNA, 327 bp, Homo sapiens
  misc_feature: NA.5.34.D01.1.454.light.1.nb
acccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaa

SEQ ID NO: 298022 - DNA, 402 bp, Homo sapiens
  misc_feature: NA.5.57.F02.1.454.light.1.nb
aacgtgctcagttaggacccagacggaaccatggaagccccagcgcagcttctcttcctcctgctactctggctcccagataccgttggggagatcgtgatgacgcagtctccagccatcctgtctgtgtctccaggggaagagccaccctctcctgcagggccagtcagaacattggagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttatactgtcaacaatgtgtcagtgcctcgaacgttcggcccagggaccacgagtggata

SEQ ID NO: 298023 - DNA, 373 bp, Homo sapiens
  misc_feature: NA.5.59.F04.1.454.light.1.nb
taggacccagagggaaccatggaaaccccagcgcagcttctcttcctcctgctactctggctcccagatgccaccggaaagactgtgttgacgcagtctccaggcaccctgtctttgtctccaggggaaagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgctagtgtattactgtcagcagtatggtagctcacggacgttcgg

SEQ ID NO: 298024 - DNA, 135 bp, Homo sapiens
  misc_feature: NA.5.59.F04.2.454.light.1.nb
gcatgtgtgagttttgtcacaagatttgggctcaactttcttgtccaccttggtgttgctgggcacagcggccctgggctgcctggtcaaggactacttcccgtgtctgatctgagcgggctggcaaggcgcata

SEQ ID NO: 298025 - DNA, 380 bp, Homo sapiens
  misc_feature: NA.5.86.H09.2.454.light.1.nb
gtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgagctgactattactgcagctcatttgcaggcagcc

SEQ ID NO: 298026 - DNA, 388 bp, Homo sapiens
  misc_feature: NA.5.9.A09.1.454.light.1.nb
tggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattatactgccaggcccttgacaactagtttgggtgtttgggtgttcggcggagggaccaagctgaccgtcctaagtcacgcccaaggctcgcccctggtcactctcgttcccaccctcctccgtgtctgatctga

SEQ ID NO: 298027 - DNA, 359 bp, Homo sapiens
  misc_feature: NA.6.19.B08.1.454.light.1.nb
caggacacagcatggacatgagggtccccgctcagctcctggggctcctgctactctggctccgaggtgccagatgtgacatccagatgacccagtctccatcctccctgtctgcatctgtaggacacagagtcaccatcacttgccgggcaagtcagagcattagcacctatttaaattggtatcaggagaatccagggaaagcccctaaactcctgatctatgatgcatccactttgcaaagtgggtcccatcaaggttcagtggcagtggatctgggacagatttcactctcaccatcagcagtctgcaacctgaagattttgctaacttactactgtacaacagagttacagtcg

SEQ ID NO: 298028 - DNA, 370 bp, Homo sapiens
  misc_feature: NA.7.27.C05.1.454.light.1.nb
cagagggtcaccatctcctgcactgggaacgcctccaacatcgggactttttatgatgcacactggtaccagcgccttccaggaacagcccccaccctcctcattcataataataacattcggccctcaggggtccctgaccgcttctctggctccaagtctggctcctcagcctccctggccatcactgggctccaggctgacgatgagggtgaatattactgccagtcatatgacagcagcctgcgtctttgggtgttcggcggagggaccaagctgaccgtcctacgtcagcccaaggctgccccctcggtcactctcgttcccgccctcctctagagacacgctgagcgggctggcaaggcgcata

SEQ ID NO: 298029 - DNA, 405 bp, Homo sapiens
  misc_feature: NA.7.5.A05.1.454.light.1.nb
gcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcaggtttcggcggagggaccaagctgaccg

SEQ ID NO: 298030 - DNA, 294 bp, Homo sapiens
  misc_feature: NA.7.71.G05.1.454.light.1.nb
cccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctgga

SEQ ID NO: 298031 - DNA, 332 bp, Homo sapiens
  misc_feature: NA.8.1.A01.1.454.light.1.nb
  modified_base (222)..(222): a, c, t, g, unknown or other
  misc_feature (222)..(222): n is a, c, g, or t
cagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttangaggacaagaaacgaccctccgggatccctgacagactctctggctccagctcagggacagtggccacttgactatcactggggcccaggtggaggatgaatgagactac

SEQ ID NO: 298032 - DNA, 243 bp, Homo sapiens
  misc_feature: NA.8.10.A10.3.454.light.1.nb
agaagttccagggcagagtctccatgaccatagacacatccgcgaccacagcctatatggagttgacgagcctgagatctgacgacacggccgtgtattactgtgcgagggatgtagtagtgacgtggtacgccggggggaaacttgactactggggccagggatccctggtcaccgtctcctcagcctccaccaagggcccatcggtcttccccctggcaccctcctccaagacgcacctct

SEQ ID NO: 298033 - DNA, 78 bp, Homo sapiens
  misc_feature: NA.8.10.A10.4.454.light.1.nb
tatgcgccttgccagcccgctcagctcgcgtgtcggaagtagtccttgaccaggcagcccagggccgctgtgcccagc

SEQ ID NO: 298034 - DNA, 94 bp, Homo sapiens
  misc_feature: NA.8.10.A10.5.454.light.1.nb
cagctccagactgcaccagctgaacctgggagtgggcacctgaactcctgggggaccgtcagtcttcctcttcccccaaaacccaaggacaccc

SEQ ID NO: 298035 - DNA, 319 bp, Homo sapiens
  misc_feature: NA.8.10.A10.7.454.light.1.nb
taggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcaggtgggtctgggacagacttcactctcacatcagcagcctagagcctagaa

SEQ ID NO: 298036 - DNA, 303 bp, Homo sapiens
  misc_feature: NA.8.11.A11.1.454.light.1.nb
tgctgacgcagccgccctcagtgtctggggccccaggccagagggtcgccatctcctgcactgggaacaactccaacatcggggcaggtcatgatgtacattggtaccagcagtttccaggaaaacgcccccggactcctcatttttgttaacaacgatcgcccctcaggggtccctgaccgcttctctggctccaggtctggcgcctctgcctcctggccatcgctgggctccaccttgacgatgtagggtttttatactgccagtcgtacgacgacagtctgactgccccggtgttcggcg

SEQ ID NO: 298037 - DNA, 374 bp, Homo sapiens
  misc_feature: NA.8.12.B01.1.454.light.1.nb
gaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcggaccaggctacggatgaggctgactattactgtcaggcgtgggacagcagcactatgtggtttcg

SEQ ID NO: 298038 - DNA, 339 bp, Homo sapiens
  misc_feature: NA.8.19.B08.1.454.light.1.nb
ttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagacgcctgaagtattttgctagttta

SEQ ID NO: 298039 - DNA, 147 bp, Homo sapiens
  misc_feature: NA.8.19.B08.3.454.light.1.nb
cattggagaagtggtgatgacacagtctccggtcaccctgtctgtttttcctggggagagagccaccctctcctgtgcggccagtcagagcgttaggacgaacttagcctggtatcagcagaggcctggccaggctcccagactcct

SEQ ID NO: 298040 - DNA, 56 bp, Homo sapiens
  misc_feature: NA.8.2.A02.1.454.light.1.nb
gggtccctgagcgattcagtggcagcggatttgggacagatttcactctcaccatc

SEQ ID NO: 298041 - DNA, 195 bp, Homo sapiens
  misc_feature: NA.8.20.B09.1.454.light.1.nb
  modified_base (7)..(7): a, c, t, g, unknown or other
  misc_feature (7)..(7): n is a, c, g, or t
acgtgcnggaaataggcggacccgtcctgccctggggccccgacggacactgaggcgggctgcgtcagcacagactgggcccaggaccctgtgcagtgagcgaggagagaccctcccctcgggatcctgcagctctagtctcccgtggtggggggtgagggatgagaacctatgaacattctgtaggggccactg

SEQ ID NO: 298042 - DNA, 486 bp, Homo sapiens
  misc_feature: NA.8.23.C01.1.454.light.1.nb
ctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctagtgggggatccatccggccaggtcgggacccctgcgcgattctctgcctccatctcggggaacgcggccacctgaccatcagcaaagcccaagccggtgatgaggctgactattttgtcaggtgtgggacagcagcatttatgtcttcggacctgggaccaaggtcaccgtcctaggtcagcccaaggccaaccccactgtcactctgttcccaccctcctcgacacgcgagctgagcgggctggcaaggcgcata

SEQ ID NO: 298043 - DNA, 249 bp, Homo sapiens
  misc_feature: NA.8.24.C02.1.454.light.1.nb
tcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagacgacccccaaactcatcatttatgatgt

SEQ ID NO: 298044 - DNA, 80 bp, Homo sapiens
  misc_feature: NA.8.28.C06.1.454.light.1.nb
acgtggcgtcagttaggacccagacggaaccatggaagccccagcgcagcttctcttcctcctgctactctggctcccag

SEQ ID NO: 298045 - DNA, 325 bp, Homo sapiens
  misc_feature: NA.8.28.C06.2.454.light.1.nb
agatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgtcctttaacgagggccagtggaatcccagccaggttcagcggcagtgggtctgggacttcgttcactctcaccatcaataacctgcaatctgacgactttgctagtttattctgtcagcagtctgaagactggccgttcacgtttcggcggtagggaccaagg

SEQ ID NO: 298046 - DNA, 211 bp, Homo sapiens
  misc_feature: NA.8.28.C06.3.454.light.1.nb
tttcagataccaccggagagattgtgttgacacaatctccagccaccctgtcttcgtctccgaggggaaagagccaccctctcctgcagggccagtcagaatgttggcgcctacgtatcctggtaccaacacaaacctggccaggctcccaggcccctcatctatggtgcatccaacgggccactggcatcccagccaggttcagtggcag

SEQ ID NO: 298047 - DNA, 71 bp, Homo sapiens
  misc_feature: NA.8.33.C11.1.454.light.1.nb
gtgctcagttaggacccagagggaaccatggaagccccagctcagcttctcttcctcctgctactctggct

SEQ ID NO: 298048 - DNA, 10 bp, Homo sapiens
  misc_feature: NA.8.33.C11.2.454.light.1.nb
ccagtttcag

SEQ ID NO: 298049 - DNA, 54 bp, Homo sapiens
  misc_feature: NA.8.33.C11.3.454.light.1.nb
actaccaccggagagattgtgttgacacagtctccagccaccctgtctttgtct

SEQ ID NO: 298050 - DNA, 222 bp, Homo sapiens
  misc_feature: NA.8.33.C11.4.454.light.1.nb
ccaggggaaaagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgt

SEQ ID NO: 298051 - DNA, 108 bp, Homo sapiens
  misc_feature: NA.8.33.C11.5.454.light.1.nb
ccgaggggaaagagccaccctctcctgcagggccagtcagaatgttggcgcctacgtatcctggtaccaacagaaacctggccaggcctcccaggccccctcatctat

SEQ ID NO: 298052 - DNA, 282 bp, Homo sapiens
  misc_feature: NA.8.33.C11.7.454.light.1.nb
cccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgtcactctcaccatcaataacctgacaatctgacgactttgcagtttattctgtcag

SEQ ID NO: 298053 - DNA, 354 bp, Homo sapiens
  misc_feature: NA.8.34.D01.1.454.light.1.nb
gctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtggtatgggacagacttcactctcaccatcatcagcctggacgcctgaggatgttgctagtttattact

SEQ ID NO: 298054 - DNA, 294 bp, Homo sapiens
  misc_feature: NA.8.36.D03.1.454.light.1.nb
caacatcgggactttttatgatgcacactggtaccggcaccttccaggaacagcccccagcctcctcatctataataataacattcggccctcaggggtccctgaccgcttctctggctccaagtctggctcctcagcctccctggccatcactgggctccaggctgacgatgaggctgattattactgccagtcatatgacagcagcctgtcgtttttgggtgttcggcggagggaccaagctgaccgtctgcgtcacgcccaaggctcgccccctcggtcactctcgttccc

SEQ ID NO: 298055 - DNA, 322 bp, Homo sapiens
  misc_feature: NA.8.38.D05.1.454.light.1.nb
tgctcagttaggacccagagggaaccatggaagccccagctcagcttctcttcctcctgctactctggctcccagataccaccggagagattgtgttgacacagtctccagccaccctgtctttgtctccaggggaaagcgccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctaga

SEQ ID NO: 298056 - DNA, 71 bp, Homo sapiens
  misc_feature: NA.8.38.D05.3.454.light.1.nb
actctcaccatcagcagcctagagcctgaagattttgcagtttattactgtcaacatcgtaccgagtggcc

SEQ ID NO: 298057 - DNA, 392 bp, Homo sapiens
  misc_feature: NA.8.39.D06.1.454.light.1.nb
gagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaacctggccaggctccccgactcctcttctttggtggagcctacagggccactggcaccccagacaggatcagtggcagcgggtctgggacagacttcattctcaccatcaacagactgcagcctgaagatattgctagtttactactgtcagcagtatgttacgtccccgtggtacgttcgg

SEQ ID NO: 298058 - DNA, 525 bp, Homo sapiens
  misc_feature: NA.8.4.A04.1.454.light.1.nb
aaaacaaaccccagctgggaagcctgagaacacttagccttcatgagtcgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcacgaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggaggaccaagctgaccgtcctaggtcagcccaaggctgccccctggtcactctgttcccaccctcctcgacacgcgagctgagcgggctggcaaggcgcata

SEQ ID NO: 298059 - DNA, 357 bp, Homo sapiens
  misc_feature: NA.8.42.D09.2.454.light.1.nb
ctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaacgcccccaaactcatgattttgaggtcaataagcggcctcagggtccctgatcgcttctcaggctccaagtctggcaacacggcctcctgaccgtctctgggctccagactgaggatgaggctgattattactgcagctcatat

SEQ ID NO: 298060 - DNA, 103 bp, Homo sapiens
  misc_feature: NA.8.45.E01.1.454.light.1.nb
atgaacattctgtagggccactgtcttctccaaggctgcccccacggtcactctgttcccaccctcctcgacacgcgagctgagcgggctggcaaggcgcata

SEQ ID NO: 298061 - DNA, 295 bp, Homo sapiens
  misc_feature: NA.8.49.E05.1.454.light.1.nb
agtctcagtcaggacacagcatggacatgagggtccccgctcagctcctggggctcctgctactctggctccgaggtggcagatgtgacatccagatgacccagtcctccgccctccctgtctgcatctgtaggagacagagtcaccatcacttgccgggcaagtcagagcattggcacctacttaaattggtatcagcagaaaccagggaaacgcccccaaatcctgatcaattatgcatccagtttgcaaagtggggtcccatcaagattcagtggcggtggatctgggacag

SEQ ID NO: 298062 - DNA, 515 bp, Homo sapiens
  misc_feature: NA.8.53.E09.1.454.light.1.nb
gcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgcccctcggtcactctgttcccccctcctcgacacgcgagctgagcgggctggcaaggcgcata

SEQ ID NO: 298063 - DNA, 230 bp, Homo sapiens
  misc_feature: NA.8.64.F09.1.454.light.1.nb
tctccagcatggcctggtctcctctcctcctcactctcctcgctcactgcacagggtcctgggcccagtctgagctgacgcagccgccctcagtgtctggggccccagggcagagggtcaccatctcctgcacgtggggacaactccaacatcggggcaggttataatgtttactggtatcaacaacttccagggacagcccccaaatcctcttgtatggtgacaactat

SEQ ID NO: 298064 - DNA, 382 bp, Homo sapiens
  misc_feature: NA.8.67.G01.1.454.light.1.nb
tgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaatcctgatttatggtgcatccatttcgcaaagtgggtcccatcaaggttcagtggcagtggatctggggcagatttcaccctcaccatcagcagtctgcaacctgaagactttgcaacttactactgtcagcagtcttacagtaggccggcacctttggccaggggacgaagctggagatcgaacgactgtggctgcaccatctgtcttca

SEQ ID NO: 298065 - DNA, 367 bp, Homo sapiens
  misc_feature: NA.8.71.G05.1.454.light.1.nb
ctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgctaacttactactgtcaacagacttacaatataccg

SEQ ID NO: 298066 - DNA, 291 bp, Homo sapiens
  misc_feature: NA.8.71.G05.2.454.light.1.nb
aagatgagctggaggaccgcaataggggtaggtcccctgtggaaaaagggtcagaggggatagaagttattcagcaggcacacaacagaggcagttccagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccatctgagacacgcgagctgagcgggctggcaaggcgcata

SEQ ID NO: 298067 - DNA, 405 bp, Homo sapiens
  misc_feature: NA.8.73.G07.1.454.light.1.nb
gtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctcgcccctcggtcactctcgttcccaccctcctcgacacgcgagctgagcggctggcaggcgca

SEQ ID NO: 298068 - DNA, 331 bp, Homo sapiens
  misc_feature: NA.8.73.G07.2.454.light.1.nb
ctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcgggcgagggaccaagttgaccgtctaggtcagcccaaggctcgccccct

SEQ ID NO: 298069 - DNA, 243 bp, Homo sapiens
  misc_feature: NA.8.73.G07.3.454.light.1.nb
caactccaacatcggggcaggtcatgatgtacattggtaccagcagtttccaggaaaacgcccccggactcctctatttttgttaacaacgatccgcccctcaggggtccctgaccgcttctctggctccaggtctggcgcctctgccctccctggccatcgctgggctccaccttgacgatggtagggtttttatactgccagtcgtacgacgacagtctgactcgccccggtgttcggcgg

SEQ ID NO: 298070 - DNA, 117 bp, Homo sapiens
  misc_feature: NA.8.74.G08.1.454.light.1.nb
gcagcgctctcgggacgtctccaccatggcctgggctctgctgctcctcaccctcctcactcaggacacagggtcctgggcccagtctgccctgactcagcctgcctccgtgtctgg

SEQ ID NO: 298071 - DNA, 476 bp, Homo sapiens
  misc_feature: NA.8.85.H08.1.454.light.1.nb
agtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtgggtcccatcaaggttcagtggcagtggatcgtgggacagatttcactctcaccatccgcagtctgcaacctgaagattttgcaatttattactgtcaagagactcacaatggaggcacttttggccaggggaccaagctggagaggaaacgaactgtggctgcaccatctgtcttcatcttcccgccatctgagacacgcgagctgagcgggctggcaaggcgcata

SEQ ID NO: 298072 - DNA, 314 bp, Homo sapiens
  misc_feature: NA.8.87.H10.1.454.light.1.nb
caggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcgggaacacggccaccctgaccatcagcaggg

SEQ ID NO: 298073 - DNA, 229 bp, Homo sapiens
  misc_feature: NA.9.1.A01.1.454.light.1.nb
ctggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccgcatctgaagacgtatcactgagcgggctggcaaggcgcata

SEQ ID NO: 298074 - DNA, 165 bp, Homo sapiens
  misc_feature: NA.9.1.A01.2.454.light.1.nb
tctcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaac

SEQ ID NO: 298075 - DNA, 389 bp, Homo sapiens
  misc_feature: NA.9.12.B01.1.454.light.1.nb
aggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttccgggtcgttcggcc

SEQ ID NO: 298076 - DNA, 244 bp, Homo sapiens
  misc_feature: NA.9.13.B02.1.454.light.1.nb
atgagaacctatgaacattctgtaggggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctcgccccctcggtcactctgttcccgccctcctcagacgtatcactgagcgggctggcaaggcgcata

SEQ ID NO: 298077 - DNA, 233 bp, Homo sapiens
  misc_feature: NA.9.16.B05.1.454.light.1.nb
agcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctggagccaccaatgactttggtggttttaatctgtgtcctggtaaccaaaaacacccaagcaaacgcccccaaatcctacattta

SEQ ID NO: 298078 - DNA, 189 bp, Homo sapiens
  misc_feature: NA.9.16.B05.2.454.light.1.nb
cctgagaacacttagccttcatgagtgtccccaccatggcctggaggatgcttctcctcggactccttgcttatggatcaggagtggattctcagactgtggtcgacccaggagccatcgttctcagtcgtccccgtggagggacagtcacactcacgttgtggcttgagctcgtggctcagtccttct

SEQ ID NO: 298079 - DNA, 267 bp, Homo sapiens
  misc_feature: NA.9.19.B08.1.454.light.1.nb
tgtgggcacaagaggcagtactcaggacaatctccagcatgccctggtctcctctcctcctcactctcctcgctcactgcacagggtcctgggcccagtctgtgctgacgcagccgccctcagtgtctggggccccagggcagagggtcaccatctcctgcactggcagcagttccaacatcggggcaggttatgatgtccactggtaccagcagtttccaggaacacgccccagggtcctcatctttggttacagtaatcggtccc

SEQ ID NO: 298080 - DNA, 328 bp, Homo sapiens
  misc_feature: NA.9.2.A02.1.454.light.1.nb
gcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaatcataatttatgatgtctttagacggccctcagggatttcttctcggttgtctggctccaagtctgggaacacggcctccctgaccatctctggacttcagcctg

SEQ ID NO: 298081 - DNA, 261 bp, Homo sapiens
  misc_feature: NA.9.2.A02.2.454.light.1.nb
ccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctgggtccctgatcgcttctctggctccaagtctggcaacacggcctccctgaccgtctctgggctccaggctgacgatgaggctgattatactgcagctcatatgcagg

SEQ ID NO: 298082 - DNA, 380 bp, Homo sapiens
  misc_feature: NA.9.20.B09.1.454.light.1.nb
gcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatggaggccgactattactgccaggtgtggcatattatcaccccgtgttcggcggggga

SEQ ID NO: 298083 - DNA, 243 bp, Homo sapiens
  misc_feature: NA.9.21.B10.1.454.light.1.nb
caagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgccagacaaacgcccccacactacttaattatga

SEQ ID NO: 298084 - DNA, 248 bp, Homo sapiens
  misc_feature: NA.9.22.B11.1.454.light.1.nb
gtgagcgcagaaggcaggactcgggacaatcttcatcatgacctgctcccctctcctcctcacccttctcattcactgcacagggtcctgggcccagtctgtggtgacgcagccgccctcagtgtctgcggccccaggacagagggtcaccatctcctgctctggaaacctcaccaacattgagagcaattatgtttcctggtaccagcagctcccaggaagacgcccccaaactcctcatctatgac

SEQ ID NO: 298085 - DNA, 220 bp, Homo sapiens
  misc_feature: NA.9.22.B11.2.454.light.1.nb
ctgcctccaagtctggctcgtcagccaccctggccatcaccggactccagactggggacgaggcccattattactgcggaacatgggattacaggttgagtgttggggctttcggcggagggaccgagctgagcgtcctaggtcagcccaaggctgccccctggtcactctgttcccaccctcctcagacgtatcactgagcgggctggcaaggcgcata

SEQ ID NO: 298086 - DNA, 330 bp, Homo sapiens
  misc_feature: NA.9.25.C03.1.454.light.1.nb
tgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcgagggactccctgagcgattctctggctccaactctgggaacacggccaccctgaccatcagcggggtcgaagccgggga

SEQ ID NO: 298087 - DNA, 234 bp, Homo sapiens
  misc_feature: NA.9.26.C04.1.454.light.1.nb
gagggatgagaacctatgaacattctgtaggggccactgtctcctccaactctgcctccctcaccatctctggactgcaggctgacgacgaggctgactactactgtcagtcttatgacaccaccaatctttgggtgttcggcggagggaccaagttgaccgtcctcggtcagcccaaggctcgcccctggtcactctgttcccacctcctcagacgtatcactgagcggctgg

SEQ ID NO: 298088 - DNA, 357 bp, Homo sapiens
  misc_feature: NA.9.27.C05.1.454.light.1.nb
  modified_base (330)..(330): a, c, t, g, unknown or other
  misc_feature (330)..(330): n is a, c, g, or t
ctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagtnttttgttttatattgtcagcagtatga

SEQ ID NO: 298089 - DNA, 250 bp, Homo sapiens
  misc_feature: NA.9.28.C06.1.454.light.1.nb
tgagaacacttagccttcatgagtgtccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctcttactttttacctaccccacctggtaccagcacgaccccaggccaggctccacgtatgatcatctacagca

SEQ ID NO: 298090 - DNA, 355 bp, Homo sapiens
  misc_feature: NA.9.3.A03.1.454.light.1.nb
taggacccagagggaaccatggaagccccagctcagcttctcttcctcctgctactctggctcccagtgaccaccggagaaattgtgttgacacagtctccagccaccctgtccttgtctccaggggaaagagccaccctctcctgcagggccagtcagagtgttggcacctacgtagcctggtaccaacagaatcctggccaggctcccaggctcctcatttatgatgcatccaacagggccactggcgtcccagccaggttcagtggcagtggtctgggacagacttcactctcaccatcagcagcctagacgcctgaagtattttgctatttattactgtcagcagcgtgcc

SEQ ID NO: 298091 - DNA, 332 bp, Homo sapiens
  misc_feature: NA.9.31.C09.1.454.light.1.nb
tcaggaggcagcgctctcgggacgtctccaccatggcctgggctctgctattcctcaccctcctcactcagggcacagggtcttgggcccagtctgccctgactcagcctgcctccgtgtctgggtctcctggacagtcggtagccatctcctgcactggaactaacagtgacgttggtgcttataattatgtctcctggtatcaacaacacccaggcaaagccccccaatcattattctgatgtcaacaatcggcccccagggatttctgatcgcttctctggctccaagtctggcaacacgcctccctgaccatctctgggctccgggct

SEQ ID NO: 298092 - DNA, 276 bp, Homo sapiens
  misc_feature: NA.9.32.C10.1.454.light.1.nb
cagggtcgtcatctctgttaattccgatcgcccctcaggggtctccgaccgcttctctggctccaggtctggcgcctcagcctccctggccatcgctgggctccagcctgaggatgaggctgattatttctgccattcatatgacagtagtctggttgcgtcggtgttcggcggagggaccaagctgaccgtcctaagtcagcccaaggctgcccccaggtcactctgttcccaccctcctcagacgtatcactgagcgggctggcaaggcgcata

SEQ ID NO: 298093 - DNA, 330 bp, Homo sapiens
  misc_feature: NA.9.33.C11.2.454.light.1.nb
tgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaag

SEQ ID NO: 298094 - DNA, 515 bp, Homo sapiens
  misc_feature: NA.9.34.D01.2.454.light.1.nb
tcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggcccaaccccactgtcactctgttcccgccctcctcagacgtatcactgagcgggctggcaaggcgcata

SEQ ID NO: 298095 - DNA, 126 bp, Homo sapiens
  misc_feature: NA.9.37.D04.3.454.light.1.nb
actgatcattgggtgttcggcggagggaccaagctgaccgtcctaggtcagcccaaggctgccccctcggtcactctgttcccaccctcctcagacgtatcactgagcgggctggcaaggcgcata

SEQ ID NO: 298096 - DNA, 226 bp, Homo sapiens
  misc_feature: NA.9.38.D05.1.454.light.1.nb
acattctgtaggggccactgtcttcaccacggcctccctgaccatctctgggctccaggctgaggacgaggctgattatttctgcagctacaaaaagaagtagccctctcgtggttttcggcgggggaccaaggtgaccgtcctaagtcagcccaaggctgccccctcggtcactctgttcccaccctcctcagacgtatcactgagcgggctggcaaggcgcata

SEQ ID NO: 298097 - DNA, 180 bp, Homo sapiens
  misc_feature: NA.9.38.D05.2.454.light.1.nb
caggaggcagcgctctcgggacgtctccaccatggcctgggctctgctattcctcaccctcctcactcagggcacgagggtcctggacccagtctgccctgactcaacctgcctccgtgtctgggtctcctggacagtcgatcaccatctcctgcactggaaccagcagtgacattggta

SEQ ID NO: 298098 - DNA, 369 bp, Homo sapiens
  misc_feature: NA.9.39.D06.1.454.light.1.nb
gtgctcagttaggacccagacggaaccatggaagccccagcgcagcttctcttcctcctgctactctgggtcccagataccactggagaaatagtgatgacgcagtctccagccaccctggctgtgtctccaggggaaacgccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagtattttgctagtttactattgtcagcagtatagtaacgg

SEQ ID NO: 298099 - DNA, 260 bp, Homo sapiens
  misc_feature: NA.9.43.D10.1.454.light.1.nb
agcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtgttatgactatgtctcctggtatcaacaacacccaggcaaacgccccaaactcttgatttatgaggtcagtaggacgccctcgacggggtccctga

SEQ ID NO: 298100 - DNA, 366 bp, Homo sapiens
  misc_feature: NA.9.50.E06.1.454.light.1.nb
  modified_base (141)..(141): a, c, t, g, unknown or other
  misc_feature (141)..(141): n is a, c, g, or t
ctgctcagttaggacccagagggaaccatggaagccccagctcagcttctcttcctcctgctactctggctcccagattccaccggagaagttgtgttgacacagtctccagccaccctgtctttgtctccgaggggaaanagccaccctctcctgcagggccagtcagagtcttaggagctccttagcctggtatcaacagaaacctggccaggctcccaggctcctcatctatgatgcatccaacgacgggccacgtggcatcccagccaggttcagtggcagtgggtctgggacagacttcactctcaccatcagcagactagagcctagaagtattttgctagtttattactgtcagcagcg

SEQ ID NO: 298101 - DNA, 501 bp, Homo sapiens
  misc_feature: NA.9.53.E09.2.454.light.1.nb
acaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggattatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgcccctcggtcactctgttcccaccctcctcagacgtatcactgagcgggctggcaaggcgcata

SEQ ID NO: 298102 - DNA, 364 bp, Homo sapiens
  misc_feature: NA.9.55.E11.1.454.light.1.nb
aaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggactccctgagcgattctcaggctccaactctagggaaaacgccaccctgaccatcagcagggtcgaaggccggggatggaggccgactattactgtcaggtgtgggctgg

SEQ ID NO: 298103 - DNA, 127 bp, Homo sapiens
  misc_feature: NA.9.55.E11.2.454.light.1.nb
atgatcatgcgggggtgttcggcggagggaccaagctgaccgtcctaagtcagcccaaggctgcccctcggtcactctgttcccaccctcctcagacgtatcactgagcgggctggcaaggcgcata

SEQ ID NO: 298104 - DNA, 367 bp, Homo sapiens
  misc_feature: NA.9.59.F04.1.454.light.1.nb
cagacccagtcaggacacagcatggacatgagggtccccgctcagctcctggggctcctgctgctctcggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatcgtagggcagatttcactctcaccatcaatcacctgcaggctgaggtattttgctaacttactactgtcagcaggctaac

SEQ ID NO: 298105 - DNA, 216 bp, Homo sapiens
  misc_feature: NA.9.6.A06.1.454.light.1.nb
ctgctcagttaggacccagagggaaccatggaagccccagctcagcttctcttcctcctgctactctggctcccagattccaccggagaagttgtgttgacacagtctccagccaccctgtctttgctccgaggggaaagccaccctctcctgcagggccagtcagagtcttaggagctccttagcctggtatcaacagaaacctggccaggctcc

SEQ ID NO: 298106 - DNA, 322 bp, Homo sapiens
  misc_feature: NA.9.65.F10.1.454.light.1.nb
agcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttctgactctgtctcctggtaccaacaacacccaggcaaaccccccaagctcatgatttatgatgtcaatcatcggccctcaggggtttctgatcgcttctctggctccaagtccggcaacacggcctccctgacccgtctctgggctcc

SEQ ID NO: 298107 - DNA, 244 bp, Homo sapiens
  misc_feature: NA.9.66.F11.1.454.light.1.nb
agcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcaatgacattggtgtctataactatgtctcctggtaccaacaataccccggcaaagcccccaaactcttggtttatgatgtcaatgt

SEQ ID NO: 298108 - DNA, 484 bp, Homo sapiens
  misc_feature: NA.9.67.G01.1.454.light.1.nb
tgctcagttaggacccagacggaaccatggaagccccagcgcagcttctcttcctcctgctactctggctcccagataccactggaataatagtgatgacgcagtctccagccaccctgtctgtgtttccaggagaaacagccactctcacctgcagggccagtcagagtcttggcaccaacttagcctggtaccagcagagacctggcttggctcccagggtcctcatctacggtgcgtccagcagggccactggtactcccggcaggttcagtggtagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcatcttcccgcatctgaagacgtatcactgagcgggctggcaaggcgcata

SEQ ID NO: 298109 - DNA, 370 bp, Homo sapiens
  misc_feature: NA.9.71.G05.1.454.light.1.nb
gaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaacgcccccacactcttaatttatgaggtcactaagcggccctcaggggtttctggtcgcttctctgcctccaagtctggcaacacggcctccctgacaatctctgggctccagtctgacgacgaggctgattattactgcagctcatatgc

SEQ ID NO: 298110 - DNA, 356 bp, Homo sapiens
  misc_feature: NA.9.75.G09.1.454.light.1.nb
aggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtgggtcccatcaagattcagcggcagtggatctgggacagaattcactctcaccatcagcagtctgcagcctgatgtattttgctaacttattactgaccaactagtataata

SEQ ID NO: 298111 - DNA, 278 bp, Homo sapiens
  misc_feature: NA.9.75.G09.2.454.light.1.nb
cccagggtcgtcatctctgttaattccgatcgccctcagggtctccgaccgcttctctggctccaggtctggcgccttcgagcctccctggccatcgctgggctccagcctgaggatgaggctgattatttctgccattcatatgacagtagtctggttgcgtcggtgttcggcggagggaccaagctgaccgtctaagtcagccaaggctgcccccaggtcactctcgttccccgccctcctcagacgtatcactgagcgggctggcaaggcgcata

SEQ ID NO: 298112 - DNA, 302 bp, Homo sapiens
  misc_feature: NA.9.76.G10.1.454.light.1.nb
gaagacaggactcaggacaatctccagcatggcctggtcccctctcttcctcaccctcatcactcactgtgcagggtcctgggcccagtctgtgctgactcagccaccctcggtgtctggagcccccaggcagagggtcaccatctcctgttctggaagcagctccaacatcggacataatggtgtaaactggtatcagcagctcccgggaaagcctcccaaactcctcatctattatgatgatctgctgccctcaggggtctctgaccgattctctggctccaagtctggcacctcacgcc

SEQ ID NO: 298113 - DNA, 337 bp, Homo sapiens
  misc_feature: NA.9.77.G11.1.454.light.1.nb
cccagtcaggacacagcatggacatgagggtccccgctcagctcctggggctcctgctgctctggctcccaggtgccaagtgtgacatccagatgacccagtctccttccaccctgtctgcatctgtaggagacagagtcaccatcacttgccgggccagtcagagtattgacacctcgttggcctggtatcagcagaaaccagggaaacgcccctaaactcctgatgtattatgcgtctagattagaagtgggtcccatcaaggttcagcggcagccaatctgggacagacttcactctcaccatcaccagtctgcagcctgatgacttcgctaag

SEQ ID NO: 298114 - DNA, 369 bp, Homo sapiens
  misc_feature: NA.9.78.H01.1.454.light.1.nb
  modified_base (141)..(141): a, c, t, g, unknown or other
  misc_feature (141)..(141): n is a, c, g, or t
tgctctaggttaggacccagagggaaccatggaaaccccagcgcagcttctcttcctcctgctactctggctcccagataccaccggagaaattgtgttgacgcagtctccaggcaccctgtctttgtctccaggggaaangccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagtattttgcagtgtattattgtcagctaatatggta

SEQ ID NO: 298115 - DNA, 371 bp, Homo sapiens
  misc_feature: NA.9.81.H04.1.454.light.1.nb
gaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcc

SEQ ID NO: 298116 - DNA, 432 bp, Homo sapiens
  misc_feature: NA.9.86.H09.1.454.light.1.nb
cacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggattttaacctgtctcctggtaccaacaccacccaggcaaacgcccccaaatcatgatttatgaagtcactaagcggccctcggggatttctgctcgcttctctggctccaagtccgtcaacacggcctccctgacaatctctggctccagactgaggacgaggctcattattactgttgctcatatacaggtgtaagtagttgggtgttcggcggagggaccaagctgaccgtctaggtcagcccaaggctcgcccct

SEQ ID NO: 298117 - DNA, 362 bp, Homo sapiens
  misc_feature: NA.9.88.H11.1.454.light.1.nb
aggaggcagcactctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccggcactgacgttggtcgttttgtctatgtctcctggtaccagcagcacccaggcaaaggccccaaactcgtcctttatgaagcctctaagcggccctcagggatccctgatcgcttctctggctccaggtctggcaacacggcctccctgaccgtctctggactccagcctgacgatgaggctatttattactgcagtgc

SEQ ID NO: 298118 - DNA, 382 bp, Homo sapiens
  misc_feature: NA.9.9.A09.1.454.light.1.nb
gtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcgaggggtccctgaccgattctctggctccaagtctggcactcagcctccctggccatcactgggcttcaggctgaggatgaggctgattattactgccactcctatgacagcagcctgagaagtgtggtattcgggcggagggaccaagctgaccgtctaggtcagcccaaggctcgcccctcggtcactctcgttcccaccctcctcagtacgta

SEQ ID NO: 298119 - DNA, 135 bp, Homo sapiens
  misc_feature: NA.9.9.A09.2.454.light.1.nb
ctgacgcagccgccctccgcgtccgggtctcctggacagtcggtcaccatctcctgccactggaaccagcagtgacattggtgcttataactatgtctcctggtaccaaacagcacccaggcaaacgtccccaaa

SEQ ID NO: 298120 - DNA, 549 bp, Homo sapiens
  misc_feature: GZ8MTXP01B2YPX.9.55.E11.1.454.CMB.2.raw
  modified_base (318)..(318): a, c, t, g, unknown or other
  misc_feature (318)..(318): n is a, c, g, or t
  modified_base (341)..(341): a, c, t, g, unknown or other
  misc_feature (341)..(341): n is a, c, g, or t
  modified_base (447)..(447): a, c, t, g, unknown or other
  misc_feature (447)..(447): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggcccaggcccctgtgctggtccctccatcatactagcgacccggccctnagggactccctgagcgattcccncaggctccaactctagggaaccgccaccctgacccatcagcagggtcgaaggccggggatggaggcccgacgtattacgtgtcagggtgtgggcgtggtgataagngatcgagtggcgggggtgttcgggcgggagggaaccaagcgtgaccgtccgtaagttccgcgccccgaaggcctcgccccctggcctaacgttccgttcccg

SEQ ID NO: 298121 - DNA, 521 bp, Homo sapiens
  misc_feature: GZ8MTXP01BESHB.9.55.E11.1.454.CMB.2.raw
  modified_base (410)..(410): a, c, t, g, unknown or other
  misc_feature (410)..(410): n is a, c, g, or t
  modified_base (461)..(461): a, c, t, g, unknown or other
  misc_feature (461)..(461): n is a, c, g, or t
  modified_base (490)..(490): a, c, t, g, unknown or other
  misc_feature (490)..(490): n is a, c, g, or t
  modified_base (511)..(511): a, c, t, g, unknown or other
  misc_feature (511)..(511): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagcgaccggccctcagggactcccctgagcgattccgtcaggctccaactctagggaacgccaccctgaccatcagcagggtcgaagcgggatgaggccgactatacngtcaggtgtgggcgtggtgataagtgatcagtggcgggggtgttcggcggngggaaccaaggctgaccgtctaagttcgngcccaagcgtcgcccctggcncttcgtcccg

SEQ ID NO: 298122 - DNA, 579 bp, Homo sapiens
  misc_feature: GZ8MTXP01ECE0R.9.55.E11.1.454.CMB.2.raw
  modified_base (436)..(436): a, c, t, g, unknown or other
  misc_feature (436)..(436): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagcgaccggcctcgaggctcctgagcgattcctcagctccaactcgtacgggaacgccaccctgaccatcagcgagggtcgaacggcggggatggacggacccgtattagttacgtggtacgaggtggtcgggngttggtgtaataagtgattcgagttcggggcgggggttggttcgggacggggacggggaaccgaaggttccgtacggaccgtaccgtaacgttcgacgacccgaaggccgtccgcccccgtggttacctccgttcgttccccg

SEQ ID NO: 298123 - DNA, 551 bp, Homo sapiens
  misc_feature: GZ8MTXP01E1TFP.9.55.E11.1.454.CMB.2.raw
  modified_base (414)..(414): a, c, t, g, unknown or other
  misc_feature (414)..(414): n is a, c, g, or t
tcagtgatacgtctcacgaccggtgctcgatttagcactcgcacgttgggtttgggctgggcctaaggaagcagcactggtggtgcctcagccatggcctggaccgttctcctcctcggcctcctctctcactgcacaggctctgtgacctcctatgtgctgactcagccaccctcgtgtcagtggcccaggagagacggccaggataacttgtagaaagaaacatcattgggaggtgttagtgtacactggtaccagcagaagccaggccaggcccctgtgctggtcctccatcatactagcgacccggcccctcagggactcccctgagcgattccctcaggcctacccaactctacgggggaaaccgcccaaccctgacccatcagcgagggtacgaaacggccgggggancggaggccgactattacgtggtcgagggtgtggggtcgtggtgagtaatggatcagtggcgggggtgtcggcggaggaaccagctcgaccgtctaagcgacgcccaaggcctcgccccctggttcaaccttctcccg

SEQ ID NO: 298124 - DNA, 536 bp, Homo sapiens
  misc_feature: GZ8MTXP01BYGGU.9.55.E11.1.454.CMB.2.raw
  modified_base (496)..(496): a, c, t, g, unknown or other
  misc_feature (496)..(496): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattccctcaggctccaactctagggaaacgccaccctgaccatcagcaggggtcgaaggccggggatgaggccgatatactgtcaggtgtgggctgggtgataagtgatcagtggcgggggtgttcgggcgggagggcccaaggctcggacccgtctaagttccgngccccgaaggcctcgccccctggttcctaacttcgtcccg

SEQ ID NO: 298125 - DNA, 515 bp, Homo sapiens
  misc_feature: GZ8MTXP01CD3OI.9.55.E11.1.454.CMB.2.raw
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (412)..(412): a, c, t, g, unknown or other
  misc_feature (412)..(412): n is a, c, g, or t
  modified_base (438)..(438): a, c, t, g, unknown or other
  misc_feature (438)..(438): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggactcccngagcgattcccncaggctccaactctagggaacgccaccctgaccatcagcagggtcgaaggccggggatgaggccgacgtatacngtcagggtgtgggcgtggtagataangatcagtggcgggggtgtcgggcggagggccaagctgacgtcagcagccaaggctcgccccgtcggctcgttctccg

SEQ ID NO: 298126 - DNA, 525 bp, Homo sapiens
  misc_feature: GZ8MTXP01AXEUJ.9.55.E11.1.454.CMB.2.raw
  modified_base (336)..(336): a, c, t, g, unknown or other
  misc_feature (336)..(336): n is a, c, g, or t
  modified_base (395)..(395): a, c, t, g, unknown or other
  misc_feature (395)..(395): n is a, c, g, or t
  modified_base (406)..(406): a, c, t, g, unknown or other
  misc_feature (406)..(406): n is a, c, g, or t
  modified_base (408)..(408): a, c, t, g, unknown or other
  misc_feature (408)..(408): n is a, c, g, or t
  modified_base (430)..(431): a, c, t, g, unknown or other
  misc_feature (430)..(431): n is a, c, g, or t
  modified_base (437)..(437): a, c, t, g, unknown or other
  misc_feature (437)..(437): n is a, c, g, or t
  modified_base (454)..(454): a, c, t, g, unknown or other
  misc_feature (454)..(454): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtacagcagaagccaggccaggccctgtgctggtcctccatcatactagcgaccggccctcagggatccctgagcgattcccncaggctccaaactctagggaaaccgccaaccctgaccatcagcaggtcgaagcggggangagacatatangnaggtgtggcggtggtgatatgnnagtggnggggtgggtcggcgggngggaacgaacgcgtcgacgtacgtaacgttacgacgaccgaacgcgtccgcccgtccgttcctcttcgtcg

SEQ ID NO: 298127 - DNA, 559 bp, Homo sapiens
  misc_feature: GZ8MTXP01AR2BW.9.55.E11.1.454.CMB.2.raw
  modified_base (341)..(341): a, c, t, g, unknown or other
  misc_feature (341)..(341): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattggaggtgttagtgtacactggtaccagcagaagccaggccaggccctgtcgctggtcctccatcatactagccgaccggccctcgagggactccctgagcgattccncaggcctccaactcgtagggaaccgccaaccctgaccntcagcgaggcgaaggcggganggagccgatatactgtcgaggtgtgggcgtggtgataagtgatcgagtcggggtcgggggttggtacggggcgggagggaacccgaaggcgttacggaccgtacgtaacgttcgacgccgaagggcctccggcccctcggcctaaccgttccgttcccg

SEQ ID NO: 298128 - DNA, 573 bp, Homo sapiens
  misc_feature: GZ8MTXP01BXCUX.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagccgaccggccctcgagggactccctgagcgtacttcctcaggcctcccaaactcgtacgggaaaccgccaaccctgacccatcagcgagggtcgaaggccggggatggaggccgacttattacgtgtcgagggttgtggggcgtggggtgagtaagtgatcgagtgggtcgggggtgttcgggcgggtacgggaaccgaagcgtcgaccgtaccgtaagttcgacgcccgaaggtccgtccgccccgtcggttctaaccgttcgtcccg

SEQ ID NO: 298129 - DNA, 714 bp, Homo sapiens
  misc_feature: GZ8MTXP01ATNCN.9.55.E11.1.454.CMB.2.raw
  modified_base (230)..(230): a, c, t, g, unknown or other
  misc_feature (230)..(230): n is a, c, g, or t
  modified_base (283)..(283): a, c, t, g, unknown or other
  misc_feature (283)..(283): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgcccacccgtcggtgtcaggtcggcccaggagagacggcaggatacttgagaaagaacatnagttggaggttgttagtgtacacgtggtacagcagacgcaggccacgccctgngctcgtcctcatcatactcgccgaccggcctagaggactcccgtgacgcgtacttcccgtacgacggcctacccgaacgttccgggtaaacgggggaaacccgccccaaccccgtacgaaccccgtataccggacgaccgggaacgggggttacggaaacgggggcccgggggtaataccggggaacgggtaccccgtaaattacgtttaaccgtggtaccggtaggggttggggtcgggggtacgttaggggtaaggtaattaagtaggtaacgttcgaagggttcggggggtccggggggttgggttaccgggggacgggggaacgggaacccgtaaaggcccgtaggaccccggttacgaacggttcccgaccggcccgaagggtccctcccggtccccgtcgggttacctaaccgttcccgtccccg

SEQ ID NO: 298130 - DNA, 643 bp, Homo sapiens
  misc_feature: GZ8MTXP01CFJZX.9.55.E11.1.454.CMB.2.raw
  modified_base (225)..(225): a, c, t, g, unknown or other
  misc_feature (225)..(225): n is a, c, g, or t
  modified_base (328)..(328): a, c, t, g, unknown or other
  misc_feature (328)..(328): n is a, c, g, or t
  modified_base (340)..(340): a, c, t, g, unknown or other
  misc_feature (340)..(340): n is a, c, g, or t
  modified_base (391)..(391): a, c, t, g, unknown or other
  misc_feature (391)..(391): n is a, c, g, or t
  modified_base (427)..(427): a, c, t, g, unknown or other
  misc_feature (427)..(427): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggcaggatactgagaaagaacatnagtggagtgtagtgtacactggacagcagaacgccaggccacggcccctgtcgcgtcggtccctccataccatactacgccgaccggccctgacggactccgngacgctattccncagcctaccgaactacgtaacgggaaaccgcccaaacccgtacgacccaancgaacggaccgtaggggacgaaacgggccggggtanagggaacgggaccgtaacttaagttaccgtcggtcgtagggtgggtgggtggtagggttagaataaagtcgaagttgaaggttggggcgggggttgtcggggacgggaacggggaaccaaggccgtacggacccggttaccgtacgggacacgggaccccgaaagggccccttcccgggcccccgttgggttccctaacccggttccgttcccccg

SEQ ID NO: 298131 - DNA, 561 bp, Homo sapiens
  misc_feature: GZ8MTXP01B3RU7.9.55.E11.1.454.CMB.2.raw
  modified_base (327)..(327): a, c, t, g, unknown or other
  misc_feature (327)..(327): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctcatcatactagcgaccggccctcgagggactcccngacgcgattccctcaggcctaccaactcgtacgggaaaccggcccaccctgaccatcagcgaggggtcgaaggccggggatggaggccgacttattactgtcgagggtgtgggctgggtagataagtgatcgagtgggcgggggttgttcgggcgggaggggaacaaggcgtcgaccgtccgtaagttcgacgcccgaagggcctcgcccccgtcggttccgtccttcgtcccg

SEQ ID NO: 298132 - DNA, 578 bp, Homo sapiens
  misc_feature: GZ8MTXP01D5GUK.9.55.E11.1.454.CMB.2.raw
  modified_base (284)..(284): a, c, t, g, unknown or other
  misc_feature (284)..(284): n is a, c, g, or t
  modified_base (293)..(293): a, c, t, g, unknown or other
  misc_feature (293)..(293): n is a, c, g, or t
  modified_base (341)..(341): a, c, t, g, unknown or other
  misc_feature (341)..(341): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattgggaggttgttagtgtacactggtaccagcagaagccaggccaggccctgngctggtccncatcatactagcgacccggccctcgagggactccctgagcgacttccncaggcctaccaactcgagggaaaccgccacctcgaccatcagcgagggcgaaggccgggatggacgccgattatacgtgacgagggtgtggggcgtggtagtaataagtgactgagtcggggtcgggggttgttcggggacggggaagggaaccaaggccgtacggacccgtacgttaaacgccgacgacccgaagggtccctccggcccccgtggttcctaaccttccgttccccg

SEQ ID NO: 298133 - DNA, 794 bp, Homo sapiens
  misc_feature: GZ8MTXP01A7KVH.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatcagttggaggtgttagtgtacacgtggtaccagcaagaagccgaggcccacggcccctggtcgcgtcggtccctccatcaatacgtacgccggaccggccctacgacgggtctcccgtagacgcgtacgttccctacgacggtaccctaccgaaacgttacccggtaaacggggaaacccggcccaaaccccgtagaacccctataccgaggaccggaacgggggtaccgaaaacggggcccgggggtaatacgggacgggtacccgtaaacgttacgttaaccgtgggttaccgtaaggggttggggtaccggggtcggttaggggttagaaaagtttacgaggtaaagtccgtaagggttcgggggtccggggggtttacggttccgggggaccggggaagggggaaacccaagggttcccggtaacgggttaaaccccgggttccttaaaaccggggttccgaacccgggaacccccggtaaaggggtcccccgttaaccccgggtcccccccgggttcgggttaaaccccttcccgttttccccgtttaaccccccccggg

SEQ ID NO: 298134 - DNA, 673 bp, Homo sapiens
  misc_feature: GZ8MTXP01CZGBX.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtacagcagaagccaggccacggccctgtcgcgtgtcctcatcatactagcgaccggcctcgaggctcccgtgacgcgtacttccacgacggtctaccaacgtaccgtacgggaaaccgcccacccgtgaaccagtcgacgcgtaggggtacgaacgggccggggtatcgggaacggaccgtaacgttaacgtttaccgtggttacgaaggggttggtacggggtcgttaggggttagtaaagttaagtacgacgttcgtaaggtcggggtcggggggttcgttaccggggacgggaacgggtaaccgtaaacggccgttacggacccggttaacctaaggttacccgaacggttaccccgaaacgggtcctaacccggtcccccgttacgggttacctaaccgtttcccgttaaccccg

SEQ ID NO: 298135 - DNA, 557 bp, Homo sapiens
  misc_feature: GZ8MTXP01D59AW.9.55.E11.1.454.CMB.2.raw
  modified_base (342)..(342): a, c, t, g, unknown or other
  misc_feature (342)..(342): n is a, c, g, or t
  modified_base (423)..(423): a, c, t, g, unknown or other
  misc_feature (423)..(423): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtggccccaggagagacggccaggataacttgtagaaagaaacatcattggaggttgttagtgtacactggtaccagcagaagccaggccaggcccctgtgctggtcctcatcatactagcgaccggccctcgagggactcccgtgagcgatttccncaggcctaccaactcgtagggaaaccgccaaccctgaccatcagcagggtcgaaggccgggatggaggaccgactatacgngtcgaggtgtgggcgttggtgaataagtgaattcgagtggcgggggtgttcgggcgggagggaaccaagcgtcgaccgtacgtaaggttccagcccgaaggcctccgcccccgtggcctaaccgttccttcccg

SEQ ID NO: 298136 - DNA, 533 bp, Homo sapiens
  misc_feature: GZ8MTXP01B0KWC.9.55.E11.1.454.CMB.2.raw
  modified_base (292)..(292): a, c, t, g, unknown or other
  misc_feature (292)..(292): n is a, c, g, or t
  modified_base (316)..(316): a, c, t, g, unknown or other
  misc_feature (316)..(316): n is a, c, g, or t
  modified_base (326)..(326): a, c, t, g, unknown or other
  misc_feature (326)..(326): n is a, c, g, or t
  modified_base (373)..(373): a, c, t, g, unknown or other
  misc_feature (373)..(373): n is a, c, g, or t
  modified_base (391)..(391): a, c, t, g, unknown or other
  misc_feature (391)..(391): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (426)..(426): a, c, t, g, unknown or other
  misc_feature (426)..(426): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtccnccatcatactagcgaccggccctnagggatcccngagcgattcctcaggctccaactctagggaaacgccaccctgaccancagcgaggagaggcggangagacgatatacngtgnggtgtggngtggtgatangatgagtggcggggtggtcgggcgggagggaacgaagacgtacgaccgtacgtaacgttacgacgaccgaacgcgtccgtccccgtccgttcctaaccgttcgtccg

SEQ ID NO: 298137 - DNA, 659 bp, Homo sapiens
  misc_feature: GZ8MTXP01EQQJX.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaacatcattggaggtgttagtgtacactggtaccagcagaagccaggccacggcccctgtgctggtcctccatcatactagcgacccggcctcgagggactccctgagcgattccctcaggtcctcccaactcgtaacgggaaaccggcccaacccgtgacccatacacgcaggggtcgaaaggccggggatggacggtacccgaacttaacgttacctggttccgaagggttgggtggggcggttggggtagtaaagttaaagtggtaatcgtaggttggggtccggggggtggtttacggggacgggggaagggaacccgtaaaggttccgtacgggttaacccgttaccgtaaacgttcccggaacggaccccgaaaggggccccttccggaccccccgttcgggttaccctaaccgtttcccgtttcccccg

SEQ ID NO: 298138 - DNA, 716 bp, Homo sapiens
  misc_feature: GZ8MTXP01CHBNC.9.55.E11.1.454.CMB.2.raw
  modified_base (348)..(348): a, c, t, g, unknown or other
  misc_feature (348)..(348): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaaagaaacatcattggaggttgttagtgtacactggtaccagcagaagccgaggccaggcccctgtcgctcggtcctccatcatactagccgaccggccctcgagggactcccgtgacgcgtattccncgaggtcctaccaacgtccgtaacgggaaacccgcccaacccgtcgaacccatacgaagccgaacgggggtacgaaacggggcccgggggaatacgggaacgggtacccgtaacgttaacgtttacgtcggttaccgtagggttgggttcgggggtcgttaggggttagtaaagttaaagtaggtaacgtcggtaaggttcgggggtccggggggttgggttaccgggggacgggggaacggggaacccgtaaagggttccgtacgggttaaaccccgttaccgtaacggttacccgacggaccccggtaaagggtccccgtcccggtccccccgttcgggttaccctaaccgttcccgtttcccccg

SEQ ID NO: 298139 - DNA, 679 bp, Homo sapiens
  misc_feature: GZ8MTXP01BH4ET.9.55.E11.1.454.CMB.2.raw
  modified_base (344)..(344): a, c, t, g, unknown or other
  misc_feature (344)..(344): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatcagttggaggtgttagtgtacacgtggtaccagcaagaacgccaggccacggccctgtgctcgtcctcatcatacgtagcgaccggccctcgagggctccctgacgcgtattccncaggcctaccaactcgaacgggaaccgcccaaccctgacctatcgagcgagggtacgaacgggccggggatacgggacggacccgtaacttaattaccgtggtaccgtagggttcgggtcggggcggtttaggggttagtaagttaaagtgtaacgtccggtaaggttccggggggtcggggggtttcggttaccgggggccgggggtaaaggggaaccccgtaaggttcccggttaaccggaccccggttaacgtaacggttaccggacgttacccggaacgggtcccgtcccggtaccccccggtcggttacccttccgttcccggttccccg

SEQ ID NO: 298140 - DNA, 685 bp, Homo sapiens
  misc_feature: GZ8MTXP01A5PNM.9.55.E11.1.454.CMB.2.raw
  modified_base (416)..(416): a, c, t, g, unknown or other
  misc_feature (416)..(416): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctggtgtcagtggccccaggagagacggccaggataacttgtagaaagaaacatcattggaggtgttagtgtacactggtaccagcagaagccaggccaggcccctgtcgctggtcctcatcatactagccgaccggcctcgacgggtactcccgtgacgcgatttcccacaggctaccaatcgtagggaaccgccaacccgtgaccatcgagcgacggggtacgaaacggccgggggtaanacggacggtaccgtacgttacgttacgtcggtacgtagggttcgggtaggggtcggttaggggtagtaacgttaacggtagtacgtacgtacgggttcgggggtcgggggttcggtaccgggggacggggaacgggtaaccgtaacggttcccgttaaccggttaacccggttaaccgttaacggttcccgaaccggttaccccggaacgggtccccgtaaccccggtcccccgttaccggttaccctaacccgttcccgttaaccccg

SEQ ID NO: 298141 - DNA, 618 bp, Homo sapiens
  misc_feature: GZ8MTXP01CIKWJ.9.55.E11.1.454.CMB.2.raw
  modified_base (345)..(345): a, c, t, g, unknown or other
  misc_feature (345)..(345): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattgggaggtgttagtgtacactggtaccagcagaagccaggccacggcccctgtgctggtcctcatcatactacgccgaccggcctcgagggctcccgtgacgcgtattcccncgacggctaccaacgtcgtaacggggaaacccgcccaaccctagaccactcgacgacgacggggtacgaacgggccggggtagtacgggacggaccgtaacgttaacgttacgtggttacgtaggggttggtaggggtcgttggggtagtaattaagtgtatcgaggtggggtcgggggtggttcgggcgggaaggaacgaacgcgtacgaccgtacgtagttcgacgcccgaaggcctccggccccgtcggttacctccgttccgttccccg

SEQ ID NO: 298142 - DNA, 664 bp, Homo sapiens
  misc_feature: GZ8MTXP01CMFTD.9.55.E11.1.454.CMB.2.raw
  modified_base (300)..(300): a, c, t, g, unknown or other
  misc_feature (300)..(300): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgcccaccctcggtgtcagtcggcccaggagagacggcaggataacttgagaaagaaacatcagttgggaggttgttagtgtacacgtggtaccagcaagacgccaggccacggcccctgtcgctcggtccnccatacaatacgtacgccgacccggcctacgaagggtctcccgtagacgcgtactttcccgacgacggtcctaccctaacgtaacccggaacggggaaacccgcccctaaacccgtcgaaccccagtaccgaacggcgggtaaacggggtccggaaacgggccggggtaagtcgggaacgtaccggtaacttaatacgttggtacgtgggtggtgggtcgtagggtaagtaagtaacgtgaagtcgtaaggtcggggtcgggggttcggtcgggacgggagggaacccaaagggttcgtacgaccgtaccgtaacgttcgcgcccgaaggtcctcccgccccgttcgcctcgttccgttccccg

SEQ ID NO: 298143 - DNA, 593 bp, Homo sapiens
  misc_feature: GZ8MTXP01EDEP1.9.55.E11.1.454.CMB.2.raw
  modified_base (343)..(343): a, c, t, g, unknown or other
  misc_feature (343)..(343): n is a, c, g, or t
  modified_base (548)..(548): a, c, t, g, unknown or other
  misc_feature (548)..(548): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaaagaaacatcagttgggaggttgttagtgtacacgtggtaccagcagaacgccaggccaggccctgtgctggtcctcatcatactagccgaccgccctcgaaggctccctgagcgatttccncgagcctccaactccgagggaaccgccacccgtagtaccatcgagcgaggggacgaacgggccgggatacggacggaccgtaacgttattacgtgtacgagggttgggtgggtcgggttaggtagtaagttaagtgaactgtaggtggggtcgggggttggtcgggacgggacggaacgaaggcgtcgaccgtcgtaaggttccncgacccgaagccctcgtccccctggttcctaacgttccgttcccg

SEQ ID NO: 298144 - DNA, 606 bp, Homo sapiens
  misc_feature: GZ8MTXP01CKVM4.9.55.E11.1.454.CMB.2.raw
  modified_base (356)..(356): a, c, t, g, unknown or other
  misc_feature (356)..(356): n is a, c, g, or t
  modified_base (461)..(461): a, c, t, g, unknown or other
  misc_feature (461)..(461): n is a, c, g, or t
  modified_base (471)..(471): a, c, t, g, unknown or other
  misc_feature (471)..(471): n is a, c, g, or t
  modified_base (483)..(483): a, c, t, g, unknown or other
  misc_feature (483)..(483): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcagttggaggttgttagtgtacacgtggtaccagacagaacgccaggcaacggcccctgtcgctggtcctccatcatactacgccgacccggccctcgacgggactcccgtgacgcgtactttcccncgacggtcctacccaacctacggtaacggggaaacccgccctaacccgtagaccagtcacgcgacggggtacgaacggcggggatggacgaccgtactattacgngtcgaggtgngggtcgtgggtnatagtgatcgaggtcgggcgggggtgttcgggcgggaaggtaaccaaggttcgtacgacccgtacgtagttccgacgcccgaacggtccgtccgccccgtggttacctccgttcgttaacccg

SEQ ID NO: 298145 - DNA, 706 bp, Homo sapiens
  misc_feature: GZ8MTXP01BS06G.9.55.E11.1.454.CMB.2.raw
  modified_base (301)..(301): a, c, t, g, unknown or other
  misc_feature (301)..(301): n is a, c, g, or t
  modified_base (501)..(501): a, c, t, g, unknown or other
  misc_feature (501)..(501): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctggtgtcagtcggcccaggagagacggcaggataacttgtagaaagaaacatctagttgggaggttgttagtgtacacgtggtaccagcagacgccaggccacggccctggtcgcgtcggtcccnccatcatactacggccggaccccggccctacgacgggtactcccgtgacgcgtactttcccacgacggtcctacccaacgtaaccggtaacggggaaaccgcccctaacccgtacgacccagtaccgaggacggacgggggtaccggaaacgggtccgggggagtacgggacggtacccggtaactttacgttaaccggnggtacgtaggggttgggtcgggggtcgttaggggtagtaaagttaagtcggtactcgggtaggtccgggggtcggggggttacgttccgggggacggggtaacgggaacccgaaggttccggtaacgacccgtacgttaacgccgaccggaccccgtaagggccctaaccccgggtcccctcggttacctccgttccgtccccgg

SEQ ID NO: 298146 - DNA, 652 bp, Homo sapiens
  misc_feature: GZ8MTXP01DVUBX.9.55.E11.1.454.CMB.2.raw
  modified_base (181)..(181): a, c, t, g, unknown or other
  misc_feature (181)..(181): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccacctcggtntcagtcggcccaggagagacggccaggataacttgtagaaagaaacatcattgggaggttgttagtgtactacgtggtaccagcaaggaacgccgaggcccacggcccctgtcgcgtcggtcctccatcatactacgcgacccggccctacgacgggactcccgtagacgcgtacttcctacgacggtccctacccgaaaccgttccgtaacggggaaacccgccctaacccgtacgaaccctataccgagaccgaggggtaccgaacgggccggggatacgggacgaccgtacttagttacgtgtacggtaggttggcgggtggttggtagtaataagtgaacgttgaggttgggggtcgggggttgtacgggcgggaacgggaacaaggcgttacggaccgttacaggttaccgccggttaccgaacggtcctcccggtccctcggttactcccgttcgttaacccccg

SEQ ID NO: 298147 - DNA, 675 bp, Homo sapiens
  misc_feature: GZ8MTXP01CZ21I.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccacccgtcggtgtcaggtcggccccaggagagacggccaggataacttgagaaagaacatcagttgggaggttgttagtgtacagtggtaccagcaagaacgccgaggccgacggcccctggtcgcgtcggtccctccatcatacgtacgccgacccgcctacgagggctcccgtgagcgacttcctacgacgcctacccaacgtaccgtaacgggaaaccgcccaacccgtacgaccatacgagacgaggggtacgaacgggccggggatacggaacggacccgtaattaacgttacgtggtacgtagggttggtcggggtagttagggtagtaattaagtgaacgttcgaagggttcgggggtacgggggttggttaccggggcgggtaaggggaacctaacggcgtacggttaacccgttacggtaaacgttccgaacggacccgtaaggtcccgtccggtacccccgttcgggttcccttaaccgttcccgttttccccg

SEQ ID NO: 298148 - DNA, 810 bp, Homo sapiens
  misc_feature: GZ8MTXP01D8RDL.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgcccaccctcggtgtcaggtcggacccgaggagagacggaccaaggattaacttgtaagaaaagaaacatacgtagttgggtaggttagttagtgtaacacgtaggtaccagcgaagaagccgaggccgacggtccccgtgtcgtaccgttcggtcccctacactacaacttaaccgtacggacccggaccccgggcccttacgggaacgggtacctcccgtaggagccgtactttccccgcgacgtcctaacccgtaaccgtaaccggtaaaccggggaaacccggccctaaaccccgacgacctactaccgaagggtcccggtaaggggtacggaaaccggggccggggagaccgggtaacggtacccgtaaggtttactaacggtggttacggtggggttcggttggggcggtttagggtagtaaagttagtacgtagtaccggtaagggttccggggggtacggggttcggggttaccgggggcggggaaaccgggtaacgtaacgggttccggtaaccggttaacccgttaaccgtaacgggttaacccgcccggaaaaccccggtaacggttcccccggtcccggttccccccggtacggttacccgttaacccgttccccgttttaaccccccg

SEQ ID NO: 298149 - DNA, 671 bp, Homo sapiens
  misc_feature: GZ8MTXP01BPFJ9.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctcatcatactagcgaccgcctcagggactcccgtgacgcgtattcctcaggcctaccaactcgtaacgggaaaccggccctacccgtagacccatacgacgacgacggggtacgaaacgggccggggatcgggaacggacccgtaacttaattaaccgtggtaccgtaagggttcgggtcggggtcgttaggggtaggtaaattaaagtggtaacgtcgtaggtcgggggtcggggggttcggttaccgggggcggggtaacgggggaaacccgtaaggccgttaccgggacccgttaccgtaaggttcccgacggaccccgtaagggtcctaacccggtcccccggttcggttaccctaaccgttccgtttaacccccg

SEQ ID NO: 298150 - DNA, 690 bp, Homo sapiens
  misc_feature: GZ8MTXP01EXKY6.9.55.E11.1.454.CMB.2.raw
  modified_base (510)..(510): a, c, t, g, unknown or other
  misc_feature (510)..(510): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctggtgtcagtacgcccaggagagacggccaggataacttgtagaaagaacatcagttggaggtgttagtgtacacgtggtaccagacaaggaacgccgacggccacggcccctgtcgcgtcggtccctaccatacaactactacggaccgacccggtccctacgagggtacctcccgtagacgtcgtacttcccgtacgacggtccctaccgtaaaccgttaaccgggaaacggggaaacccgccctaaccccgtacgaaccacgtacgacggacggacggggtacgaacggggaccgggagtcggaacgggtaccctaacgtttacttacggngttacgagggttgggtacggggtgtagggtaagtaagtagtagtacgtagtgggtagggggtccgggggttggtccggggacgggaacgggaacgaacggttcgtacgttaccgtacgtaacgttacgcgacccggaagtcccgtccggcccctacggttctaaccgttcctttaacccg

SEQ ID NO: 298151 - DNA, 594 bp, Homo sapiens
  misc_feature: GZ8MTXP02J16MV.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctcatcatactagcgaccggcccctcgagggactccctgacgcgattcctcaggcctaccaactcgtagggaaccggccaccctgaccatcagcaggggtcgaaggccggggatggaggccgactattacgtgtcgaggtgtgggctgggtgataatgatcgtagtcgggtcgggggtggttcggggacggggaacgggaccgaaaggccgttacggaacccgttaccgtaaacgtccgaaccggaccccgaaagggcccgttaccggcccccccgttacgggtccctaccgttccttccccgg

SEQ ID NO: 298152 - DNA, 515 bp, Homo sapiens
  misc_feature: GZ8MTXP02JVPU4.9.55.E11.1.454.CMB.2.raw
  modified_base (405)..(405): a, c, t, g, unknown or other
  misc_feature (405)..(405): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattcctcaggctccaactctgggaacgccacctgaccatcagcagggtcgaagccggggatgaggcgactatacngtcaggtgtgggctgggtgataagtgatcagtggcgggggtgttcgggcggagggaccaagctagaccgtctaacgtcacgcccaaggctcgccccctggtcactctccg

SEQ ID NO: 298153 - DNA, 510 bp, Homo sapiens
  misc_feature: GZ8MTXP02ITVPG.9.55.E11.1.454.CMB.2.raw
  modified_base (407)..(407): a, c, t, g, unknown or other
  misc_feature (407)..(407): n is a, c, g, or t
  modified_base (451)..(451): a, c, t, g, unknown or other
  misc_feature (451)..(451): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatcccctgagcgattcctcaggctccaactctgggaacggccaccctgaccatcagcagggtcaagccggggatgagcgactattacngtcaggtgtgggctggtgataatgatcatgcgggggtgttcggnggagggaccaagctgaccgtctacgtcagcccaaggctcgcccctggtccacgtctccg

SEQ ID NO: 298154 - DNA, 515 bp, Homo sapiens
  misc_feature: GZ8MTXP02IHI2R.9.55.E11.1.454.CMB.2.raw
  modified_base (315)..(315): a, c, t, g, unknown or other
  misc_feature (315)..(315): n is a, c, g, or t
  modified_base (502)..(502): a, c, t, g, unknown or other
  misc_feature (502)..(502): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggagtgttagtgtacactggtaccagcagaagccaggccaggcccctgtgctggtcctccatcatactagcgaccggccctnagggatccctgagcgattcctcaggctccaactctagggaaaccgccacctgaccatcagcaggtcgaagccgggatgagccgactatactgtcaggtgtggctggtgataagtgatcatggcgggggtgttcgggcggagggaccaaggctcgaccgtactaagtccagcccaaggctcgcccccncggtcactctccg

SEQ ID NO: 298155 - DNA, 514 bp, Homo sapiens
  misc_feature: GZ8MTXP02GR0QI.9.55.E11.1.454.CMB.2.raw
  modified_base (495)..(495): a, c, t, g, unknown or other
  misc_feature (495)..(495): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagcgaccggccctcagggactccctgagcgattcctcaggctccaactctagggaacgccacctgaccatcagcagggtcgaaggccggggatggagccgactatactgtcaggtgtgggctggtgataatgatcagtggcgggggtgttcgggcggagggaccaagcgtgaccgtctacgtcagccaaggcncgcccctggtcactctccg

SEQ ID NO: 298156 - DNA, 557 bp, Homo sapiens
  misc_feature: GZ8MTXP02JBBQD.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggccccctgtgctggtcctccatcatactagcgaccggccctcagggatcccctgagcgattcctcaggctcaactctagggaacgccacctgaccatcagcagggtcgaaaggccggggatgaggccgactattactgtcaggtgtgggctggtgatatgatcatggcgggggtgttcgggcgggagggacccgaaaggcgtacggaacccgttaccgtaaagtaccgaacgaccccgaaaggcccgtcggccccccgtcggtacctaccgtccgtttcccg

SEQ ID NO: 298157 - DNA, 561 bp, Homo sapiens
  misc_feature: GZ8MTXP02JE0OK.9.55.E11.1.454.CMB.2.raw
  modified_base (281)..(281): a, c, t, g, unknown or other
  misc_feature (281)..(281): n is a, c, g, or t
  modified_base (463)..(463): a, c, t, g, unknown or other
  misc_feature (463)..(463): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagagccaggccaggcccctgngctggtcctccatcatactagcgaccggccctcgagggactcccgtgacgcgattcctcaggctaccaactcgtagggaaaccggccaaccctgaccatcagcgagggtcgaaaggccggggatggacggccgactattacgtgtcgaggtggtgggcgtggtgataagtgagtcagtgggngggggtgttcgggcggagggaccgaagcgtcgaaccgtcgtaacgtacgacgacccgaacggcctaccggcccccgtggtacctaccgttcttccccg

SEQ ID NO: 298158 - DNA, 553 bp, Homo sapiens
  misc_feature: GZ8MTXP02JK5YR.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattcctcaggctccaactctagggaaaccgccaacctgacccatcagcagggtcgaaaggccgggggatggaggccgacgtattaccgtgtacaggttgtgggctggtgataagtgatcgagtcggtcgggggtgttcgggcgggaagggacccgaaggccgtcggacccgtccgtaaagtccgagccccaaaggcctcgccccctggtcctacctcttcccg

SEQ ID NO: 298159 - DNA, 602 bp, Homo sapiens
  misc_feature: GZ8MTXP02IVR7E.9.55.E11.1.454.CMB.2.raw
  modified_base (460)..(460): a, c, t, g, unknown or other
  misc_feature (460)..(460): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctcatcatactagcgaccggccctgagggactcccctgagcgattcctcaggcctaccaactccgtacggggaaaccggcccaaccctgacccatcgagccgaggggtcgaaacggccggggaatcggacggccgactagttactgtcgagggtggtggggctggggtanagtaacgtgatcgtagtgggcgggggttgttcggggcgggaacgggaccaaaggtcgtacggtacccgtaccgtaacgtaccacggaccccgaaaggccctacccggccccccttcggtacctaccgttccgtttcccccgg

SEQ ID NO: 298160 - DNA, 687 bp, Homo sapiens
  misc_feature: GZ8MTXP02G6A4X.9.55.E11.1.454.CMB.2.raw
  modified_base (282)..(282): a, c, t, g, unknown or other
  misc_feature (282)..(282): n is a, c, g, or t
  modified_base (291)..(291): a, c, t, g, unknown or other
  misc_feature (291)..(291): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcagttggaggtgttagtgtacactggtaccagcagagccaggccagccctgngctggtccncatcatactagccgaccggcctacgaggactccctgagcgtattccctcacggtctaccaaacgtcgtaacggggaaacccggcccaacccgtcgaaccacgtacgacggccgaacgggggtaccgaaagggacccgggggaagtacgggaacgggtacccgtaacgttaacgttaccgttaggtacggtaaggggttgggtcgggggtcgttagggggttagtaaagttaaggtagtagtacgtaaggtgggggtcggggggttggttccgggggacggggaacggggaacccgaaggtccgtacgggtacccggttaccgtaacggtaccgaaccggaccgaagggtccctaccggccccccgttacggtcccaacccgttccgttacccccgg

SEQ ID NO: 298161 - DNA, 613 bp, Homo sapiens
  misc_feature: GZ8MTXP02HNN42.9.55.E11.1.454.CMB.2.raw
  modified_base (343)..(343): a, c, t, g, unknown or other
  misc_feature (343)..(343): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagccgacccggccctcgacgggactccctgagcgattcccncgaggctaccaacgtcgtacgggaaaccgcccaacccgtcgacccatcgaacgcgaggggtaccgaaacgggcccgggggaatcgggacgggacccgtaacttacttaaccgtgtacgagggtggtgggctgggtgaataagtgatcgagtgggcgggggtgttcggggacgggaacgggaccaaggccgtacggacccgttaccgaacgtccgaacggccccgaaaggccgtccggccccccgtcggtcccgtaccttccgttccccgg

SEQ ID NO: 298162 - DNA, 530 bp, Homo sapiens
  misc_feature: GZ8MTXP02JT94R.9.55.E11.1.454.CMB.2.raw
  modified_base (416)..(416): a, c, t, g, unknown or other
  misc_feature (416)..(416): n is a, c, g, or t
tcagtgatacgtctcacgaccggtgctcgatttagcactcgcacgttgggtttgggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggcctcgagggatccctgacgcgattcctcaggctccaactcgtagggaaaccggccaaccctgacccatcagcagggtcgaaaggccggggatgacgcgactattacngtcaggtgtgggctgggtgataatgatcagtggcggggtgtcgggcggaggaccgaagctcggaccgtctaacgtcacgccgaaggctcgccccctcggtccacgtccttcccg

SEQ ID NO: 298163 - DNA, 697 bp, Homo sapiens
  misc_feature: GZ8MTXP02GPBBV.9.55.E11.1.454.CMB.2.raw
  modified_base (281)..(281): a, c, t, g, unknown or other
  misc_feature (281)..(281): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcagttggaggtgttagtgtacatggtaccagcagagcaggccaggccctgngctggtcctcatcatactagccgacccggccctcgacgggactccccgtaggacgccgtatttccccgtacgacggtccctaccctaaacgttccggtaacggggaaaccccggccccaaccccgtcggaaccctaacgtccgaacggccggaacggggtaccgggaaacggggcccgggggaagtcgggaaccggggacccggtaaccgttaagttaccgtggtaccgtaaggggttgggtggggtcgttgggtagaagttaaagtgtaactcgtaagtcggggtcgggggttcgggttacggggacggggaacgggtaaccgaaggcgtacggtacccgtaccgtacgtaccgaacggacccgaaacggtcccgtaccggtcccccgtcggtacccaccgtttccgtttccccg

SEQ ID NO: 298164 - DNA, 643 bp, Homo sapiens
  misc_feature: GZ8MTXP02IH2FZ.9.55.E11.1.454.CMB.2.raw
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatcagttggaggtgttagtgtacacgtggtaccagcagaagccaggccacggccctgcgctggtcctcatcatacagccgaccgccctcgagggactcccgngacgcgtacttccncgagcctaccaactcgaacgggaaccgcccaaccgtcgaccatcgaagcgaacggggtacgaaacgggcccggggatacgggaccgggaccgtaacttaagttaccgtggtaccgtaaggggtggtggggtcgttgggtagtaattaagtagattcgaggtcggggtcgggggttcggttacggggacgggaacgggtaaccgaaggccgtacggacccgttaaccgtaacgtacccgaacgacccgaacggtcccgtcccggtcccccgtacggtccctacccgtttccgttacccccg

SEQ ID NO: 298165 - DNA, 716 bp, Homo sapiens
  misc_feature: GZ8MTXP02GF435.9.55.E11.1.454.CMB.2.raw
  modified_base (277)..(277): a, c, t, g, unknown or other
  misc_feature (277)..(277): n is a, c, g, or t
tcagtgatacgtctcacgaccggtgctcgatttagcactcgcacgttgggtttgggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatcattggaggtgttagtgtacatggtaccagcagagcaggccagccctgngctggtcctcatcatactagcgacccgccctcgagggactcccgtgacgcgtacttcccgtacgacggcctaccctaacgtaccgtaacggggaaacccggtccccaaacccgtacggaacccctaactaccgaacgacgaacggggtaccgaaacggggacccgggggtaagtacgggaacgggtacccgtaacgttaacgtttacgtcggtacgagggttggtcggggtcgttaggggtagtaagtaaagttggaaacttcgagttcgggggtacgggggttcggttaccgggggacggggtaacggggaaaccgtaaacgggtaccgttacgggtaaacccggttaccgtaaacggtaccgaacccggaaccccgaaacggggtcccctacccgggtccccccgtacgggtacccaaccgtttcccgtttaccccg

SEQ ID NO: 298166 - DNA, 657 bp, Homo sapiens
  misc_feature: GZ8MTXP02GQBXS.9.55.E11.1.454.CMB.2.raw
  modified_base (283)..(283): a, c, t, g, unknown or other
  misc_feature (283)..(283): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgngctggtcctcatcatactagcgaccggccctcgagggactccctgacgccgtattccctacgacggctacccgaactccggtaacggggaaaacccggcccaaaccccgtacgaaccctaactaccgaaacggccgaaacgggggtaccggaaacggggcccgggggaagtcgggaaacgggacccgaaccgttaaagtttaccgtacggtaccgaggggttgggtggggccgttggggtagaagttaaagtgaacgtcgaagtcggggtcgggggttggttcggggacggggacgggaccaaaggcgtacgacccgtacgtacgtaccgacgaccgaacggccgtccgcccccgtacggcctacgtcttcccg

SEQ ID NO: 298167 - DNA, 630 bp, Homo sapiens
  misc_feature: GZ8MTXP02IL7VY.9.55.E11.1.454.CMB.2.raw
  modified_base (280)..(280): a, c, t, g, unknown or other
  misc_feature (280)..(280): n is a, c, g, or t
  modified_base (289)..(289): a, c, t, g, unknown or other
  misc_feature (289)..(289): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggcccaggagagacggccaggataacttgtagaaagaaacatcagttggaggtgttagtgtacactggtaccagcagagcaggcagccctgngctcgtccncatcatactagcgaccggcctcgagggactcccgtgacgcgtacttccctcgacgtcctacccaacgttccgtaacggggaaacccggcccaacccgtcgaacccatcgagcgagggtcgaaacggccgggatcggacggaccgtaacttagttacgtgtacgagggttggtcgggtcgtagggttagaagttagtagactacgaggtggggcgggggttgttacggggacggggtaacggaaccgaagggtccgtacggaacccgttaccgtaacggtaccgaaccggtacccgaaaggcccgtcccggtcccccgtacggtccctaccgtcgttccccg

SEQ ID NO: 298168 - DNA, 761 bp, Homo sapiens
  misc_feature: GZ8MTXP02IZWQ7.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagcaggccaggcccctgtgctcggtcctcatcatactagccgaccggccctcgagggactccccgtgacgcgtacttccctacacggcctaccgtaaactccgttaacggggaaacccggcccctaaaccccgtacggaacccctaacgtaccgaaacggacccgaaacgggggttaccggaaaaccggggacccggggggaagttacggggaacggggaccccgtaaacgtttaacgtttaaccgttggtaccgtaaggggttcgggtgggggtccgttaggggttagtaagttaaaagtgtaaacgttcggtaaggttcgggggcggggggtttggttacgggggaccggggaaacggggtaacccgaaaggtccggtaacggtaacccggttaaccgttaaacgggtaccgaaccggaccccggaaaacggggtcccgtaccccgggtaccccccgttacgggtaccccgtaccctttacccgtttccccccgg

SEQ ID NO: 298169 - DNA, 702 bp, Homo sapiens
  misc_feature: GZ8MTXP02JWQFD.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggagagacggccaggataacttgtagaaagaaacatcagttggaggttgttagtgtacactggtaccagcagaagccaggccaggcccctgtcgctcggtcctccatcatactagccgaccggccctcgagggactcccgtgacgcgtattcccgacgaggcctaccaacgtcgtaacggggaaacccggcccaaacccgtgaacccatcgagccgaaggggtaccgaaacgggcccgggggagtcggaacgggtccgaacgttagttaccgtgtcgagggttcggtggggtcgttaggggtagtaagttaagttaggaacttcggtaaggttcgggggtcggggggtttggttaccgggggacgggggtaacggggaacccgaaaagggccgttaacgggtaacccggttaccgttaacggtaccgaaccggtacccggaaacggtccccgttacccggtacccccccggttcgggtacccctaaccggtttcccgtttcccccgg

SEQ ID NO: 298170 - DNA, 605 bp, Homo sapiens
  misc_feature: GZ8MTXP02JF90T.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggttgttagtgtacactggtaccagcagagccaggccaggcccctgtgctggtccctccatcatactagccgaccggccctcgaggactcccgtgacgcgtattccctcgacggtcctacccaacgttaccgtacggggaaaccggcccacccgtgacccatcgagcgagggtcgaacggccggggatggacgccgacttagttacgtgtacgagggtggtgggacgtggtgagttagtgatcgagtgggtcgggggttgttcggggcgggacgggaccgaaggtcgtacggacccgtaccgtaacgtacgaccgacccgaaacgggccctacccggtcccccgtcggtaccctccgttccgttccccg

SEQ ID NO: 298171 - DNA, 562 bp, Homo sapiens
  misc_feature: GZ8MTXP02F7RT9.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattggaggtgttagtgtacactggtaccagcagagccaggccaggcccctgtgctggtcctcatcatacagccgaccgccctcgaggactccctgacgcgattcctcagctaccaactcgtagggaaccgccaccgtgaccatcagcgaggggtacgaaaggccggggatggacggccgactattactgtacaggtggtgggctgggtagataatgaatcgagtgggtcgggggtgttcgggacgggagggaccaaggcgtacgaaccgtcgtaacgtccgacgacccgaaaggccctacggcccccgtggtaccaccgttccgttacccg

SEQ ID NO: 298172 - DNA, 676 bp, Homo sapiens
  misc_feature: GZ8MTXP02HUN9F.9.55.E11.1.454.CMB.2.raw
  modified_base (314)..(314): a, c, t, g, unknown or other
  misc_feature (314)..(314): n is a, c, g, or t
  modified_base (432)..(432): a, c, t, g, unknown or other
  misc_feature (432)..(432): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtggccccaggagagacggccaggataacttgtagaaagaaacatcattggaggtgttagtgtacactggtaccagcagaagccaggccacgccctgtcgctcggtcctcatcatacacgcgaccgccngaggctcccgtgacgcgtacttcccgtcgacgtcctaccgaacttcggaacgggaaacccgcccaacccgtacgaccctactacgacgcggaaggggtacgaacgggccggggtaaancgggacggtacccgtacttaagttacgtcgtacgagggttcgggtgggtacgttgggtagtaattagtagaactcggtaaggttcgggggcgggggtttcggtccgggggacggggtaacgggaaccgtaacggtccggttaaccggaacccgtttaccggtaaacggacccgaaccgggacccgtaaacggtcccgaccccggttcccccgtacgggtttcccaccgtttcccgttcccccgg

SEQ ID NO: 298173 - DNA, 542 bp, Homo sapiens
  misc_feature: GZ8MTXP02IUBSI.9.55.E11.1.454.CMB.2.raw
  modified_base (282)..(282): a, c, t, g, unknown or other
  misc_feature (282)..(282): n is a, c, g, or t
  modified_base (308)..(308): a, c, t, g, unknown or other
  misc_feature (308)..(308): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
  modified_base (471)..(471): a, c, t, g, unknown or other
  misc_feature (471)..(471): n is a, c, g, or t
  modified_base (519)..(519): a, c, t, g, unknown or other
  misc_feature (519)..(519): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtggccccaggagagacggccaggataacttgtagaaagaaacatcattggaggtgttagtgtacactaggtaccagcagacgcagccaggccctgngctgtcctcatcatacagcacgcctnaggactcctgagcgattcctacgacggctaccaaacttcgaacggggaaaccgcccaaccctgaaccctaatccaagcaggggtacaacggccggggaagtgacggacgacgtattacgtgtcaggtgtggctggtgatangactnagtggagggtgttcggnggacggaccaagcttacggactaccgtagaccgagaccgaaggtcccnccgtcccgtccgtctactctccg

SEQ ID NO: 298174 - DNA, 654 bp, Homo sapiens
  misc_feature: GZ8MTXP02ILD35.9.55.E11.1.454.CMB.2.raw
  modified_base (182)..(182): a, c, t, g, unknown or other
  misc_feature (182)..(182): n is a, c, g, or t
  modified_base (229)..(229): a, c, t, g, unknown or other
  misc_feature (229)..(229): n is a, c, g, or t
  modified_base (460)..(460): a, c, t, g, unknown or other
  misc_feature (460)..(460): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtcgacctcctatgtgctgactcacgccacctcggtntcgagtcggcccaggagagacggcaaggattaacttgaagaaagaanatacagttgggaggttgttagtgtacacgtcggtaccaggacaaggaacgccgaacgggcccgaccggccctgtcgctcggtcctacactcatactacgccgaccggccctaggacgggtacctcccgtaggacgtcgtattccccgtacgacgtcctacctaacgtcgtaaacggggaaccgtcccaacgtacacctatcgacgacgtacggggacgaaacggtcggganacgggacgcctaatacgttcgagtggtagtgggtacgggtcgtaggtagaacttaaggtgaacgttcggaggttcgggggtcgggggttcgtcggggacgggaacgggacaacggtcgacggtaaccgtacgtacgaccgaccgtaacgaacggtcccttacccgccccgtagtcctaccgttccgttaccccg

SEQ ID NO: 298175 - DNA, 647 bp, Homo sapiens
  misc_feature: GZ8MTXP02GIYSQ.9.55.E11.1.454.CMB.2.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataattgtagaaagaaacatcattggaggtgttagtgtacactggtaccagcagaagccaggccaggcccctgtcgctggtcctcatcatactagccgaccggccctacgagggactccccgtagacgcgtacttccctacgacggctaccaacgtccgtaacggggaaaccgcccaacccgtgacccatacacggtcgagggtacgaacggccggggatcggacggaccgacttagttacgtgtacgagggtcggtgggacgttgggtagagtaagtgaacgtcgaaggttcggggtacgggggttcggttacggggacggggaacgggaaccgaacggtccgtaccggtaacccggttacctaacggtaccgaacggacccgaaacggtcccgtaccggtcccccgtacggtaccgtacccgttccgtttccccgg

SEQ ID NO: 298176 - DNA, 694 bp, Homo sapiens
  misc_feature: GZ8MTXP02FQM1A.9.55.E11.1.454.CMB.2.raw
  modified_base (524)..(524): a, c, t, g, unknown or other
  misc_feature (524)..(524): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacgccaggataacttgtagaaagaaacatcattggaggtgttagtgtacactggtaccagcagaagccaggccacggcccctgtcgctcggtcctaccatcatactagcgaccgcctgacggctcccgtgagcgtattccctcgacggctaccaacgtccgtaacggggaaaccggcccaacccgtacggaacccacgtacgaaacggcggtaaacggggtacgaaacggggccgggggaatacggggaaccgggtaccgaacgttaagtttaaccgtggtaccggtagggttcgggtagggtcgttaggtagtaagttaaagnggaacttacggaggttcgggggacgggggtttacggtacgggggacggggtaacgggaaccgtaaggaccggttacggaaccgttaccgtaaacggtaccgaccggtaaccccgaaggtccccgtacccggtacccccgttcggtaccctaccggtttccttacccccgg

SEQ ID NO: 298177 - DNA, 602 bp, Homo sapiens
  misc_feature: GZ8MTXP02IE96H.9.55.E11.1.454.CMB.2.raw
  modified_base (248)..(248): a, c, t, g, unknown or other
  misc_feature (248)..(248): n is a, c, g, or t
  modified_base (283)..(283): a, c, t, g, unknown or other
  misc_feature (283)..(283): n is a, c, g, or t
  modified_base (465)..(465): a, c, t, g, unknown or other
  misc_feature (465)..(465): n is a, c, g, or t
  modified_base (572)..(572): a, c, t, g, unknown or other
  misc_feature (572)..(572): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggagagacggccaggataacgttgtagaaagaaacatcattggaggtgttagngtacactggacagcagagcaggccacggcccctgngctcgtcctcgatcatactagccgaccggcctcgaggtactcccgtgagcgtacttccctacgacggtccctaccaacgttccgaacgggaaacccggcccctaaaccgtccgaaccacgtacgacgacgaagggtacgaacggaccgggatacggacgaccgtaacttagttacgcgtagnggtgtggcgtaggtagattaagtcagtgaggtgggcggggtttgcggggacgggtaacggacgaggtcgtacgtaaccggtcttaacgccgacgacccgaaggtccnccgtcccccgtgtccaccgttcgttccccg

SEQ ID NO: 298178 - DNA, 563 bp, Homo sapiens
  misc_feature: GZ8MTXP02F0N59.9.55.E11.1.454.CMB.2.raw
  modified_base (410)..(410): a, c, t, g, unknown or other
  misc_feature (410)..(410): n is a, c, g, or t
  modified_base (452)..(452): a, c, t, g, unknown or other
  misc_feature (452)..(452): n is a, c, g, or t
  modified_base (466)..(466): a, c, t, g, unknown or other
  misc_feature (466)..(466): n is a, c, g, or t
  modified_base (554)..(554): a, c, t, g, unknown or other
  misc_feature (554)..(554): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaacatcaatttggaggttgttagtgtacactggtaccagcagaagccaggccaggccccctgtgctggtacctcatcatactagccgaccggccctcgaggactccctgacgcgattccctcgagcctacgaactcgtacgggaacgcccaaccctgaccatcgagctagggtcgaagccggggtanggagccgacgttattactgtcgaggtggtagggctaggggtntactaagtgacgtnagtgggcggggtggttcgggcggacggaaccgtagcgtagaccgtcgtaacgtcgacgacccgaaggcctacgcccccgtggctaccncgtttcccg

SEQ ID NO: 298179 - DNA, 699 bp, Homo sapiens
  misc_feature: GZ8MTXP02FRMKH.9.55.E11.1.454.CMB.2.raw
  modified_base (344)..(344): a, c, t, g, unknown or other
  misc_feature (344)..(344): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgcccaccctcggtgtcagtcggccccaggagaggacggccaggataacgttgtagaaagaaacatcagttggaggtgttagtgtacacgtggtaccagcagagccaggcccacggcccctgtcgcgtcggtccctcatcatacgtacgccgaccggccctacgagggctccccgngacgcgtacttcccgtacgacggtcctaccaacttccggtaaacggggaacccggcccaacccgtacgaaccccataccgaggccgtaaacgggggtacggaaacgggccggggatcgggacggcccgtaacttagttacgtggtacgtaggggttcggtcggggtacgttggggagtaaagtacgttagacgttacggaggttcgggggtccgggggttacgtaccgggggacggggaacgggtaaccgacggtcggtaccgtaaccgtaccgttaaacggaccgaaccggacccgtaaacggggtccctaccccggtcccccgtacggttaccacccggttcctttccccccg

SEQ ID NO: 298180 - DNA, 555 bp, Homo sapiens
  misc_feature: GZ8MTXP02GMF0T.9.55.E11.1.454.CMB.2.raw
  modified_base (441)..(441): a, c, t, g, unknown or other
  misc_feature (441)..(441): n is a, c, g, or t
  modified_base (532)..(532): a, c, t, g, unknown or other
  misc_feature (532)..(532): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccacggcccctgtcgctggtcctccatcatactagccgaccggccctcgacgggactcccgtgacgcgattcctcaggctaccaactcgtacgggaaccggccaacccgtgaccatcagcgagggtacgaaggccgggatgacggccgactattactgtacgaggtcggnggcgtggtagataatgactgagtcgggtcgggggtggtcgggacgggagggaccaaggcgtacgaccgtactaacgtcacgaccaaggccncgcccctacgtccactcttcccg

SEQ ID NO: 298181 - DNA, 488 bp, Homo sapiens
  misc_feature: GZ8MTXP01BUXZ8.19.26.C04.1.454.CMB.2.raw
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
  modified_base (333)..(333): a, c, t, g, unknown or other
  misc_feature (333)..(333): n is a, c, g, or t
  modified_base (381)..(381): a, c, t, g, unknown or other
  misc_feature (381)..(381): n is a, c, g, or t
  modified_base (388)..(388): a, c, t, g, unknown or other
  misc_feature (388)..(388): n is a, c, g, or t
  modified_base (390)..(390): a, c, t, g, unknown or other
  misc_feature (390)..(390): n is a, c, g, or t
  modified_base (397)..(397): a, c, t, g, unknown or other
  misc_feature (397)..(397): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (461)..(461): a, c, t, g, unknown or other
  misc_feature (461)..(461): n is a, c, g, or t
  modified_base (465)..(465): a, c, t, g, unknown or other
  misc_feature (465)..(465): n is a, c, g, or t
  modified_base (467)..(467): a, c, t, g, unknown or other
  misc_feature (467)..(467): n is a, c, g, or t
tcagtactctcgtgcacgaccggtgctcgatttagtctagcgactttgggtttgggagaggagcccagcactagaagtcggcggtgtttccattcggtgatcagcactgaacacagaggactcaccatggagtttgggctgagcgtggttttctcgttagctcttttaagaggtgtccagtgtcaggtgcacctggtggagtctgggggagcgtggtccagcctgggagtccctgagactctcctgtgcagcctctggattcaccttcagtagctttggcatccactgggtccnccaggctccaggcaagggggctagngtgggtgcagttanatcatatgatgaggtaaatataattatgagatcgtgaggcgatcacanctcagananatacaanaacacagagatnganaananacagcngagagcgtggacgacgngtgtgttatagttgtgngagngcgngngcgactacactcgttcgtaag

SEQ ID NO: 298182 - DNA, 734 bp, Homo sapiens
  misc_feature: GZ8MTXP01CXOBL.19.26.C04.1.454.CMB.2.raw
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (335)..(335): a, c, t, g, unknown or other
  misc_feature (335)..(335): n is a, c, g, or t
tcagtactctcgtgcacgaccggtgctcgatttagtctagcgactttgggtttgggctgagcgtgggtttctcgttgctctttaagaggtgtccagtgtcaggtgcacctggtggagtctgggggaggcgtggtccagcctgggaggtccctgagactctcctgtgcagcctctggattcaccttcagtagctttggcatccactggtccaccaggctccaggcaaggggctagagtgggtgcagttanatnatatgagtaggaagtaaatatatagtggacgtactcgtagaacggctatacactatcacaagacactaactaccaaagaacanaggtagatcgtagaacaaatacgaaacacgtaaccgtaggaacggacgggtacgggtacgggggacctacggggtcttaggttagttaacgtttacggtggtacgggacggaacgggacgggacgggtacggtacggaaccgtaaactaactaacgttaaccgttaacggtttaacggggggtttacggggttaccgggttaccgggtacgggggtaccgggtaaaccggggaacccggtaaccggtaccgtacgtaccgtacccgtaccccgtacccgtaaccccgtaccccgaacccggtaaacccgggacccgtaccgttcccggttccccgttccccgttcccggtcccgtccccgtccgtcccgtacccgaccggtaaccgaacccgtaacccg

SEQ ID NO: 298183 - DNA, 583 bp, Homo sapiens
  misc_feature: GZ8MTXP01CNZSX.19.26.C04.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (341)..(341): a, c, t, g, unknown or other
  misc_feature (341)..(341): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggtttcgtcgttaggctcttttaagaggtgtccagtgtcaggtgcacctggtggagtcgtgggggagcgtggtccagcctgggaggtccctgagactctcctgtgcagcctntggattcaccttnagtncttgcactccacgtcggccncgagctcgaggcgagggctaggnggtgggtgactagttatactanatatagtagtaggtaagtaaataataaattagtgagtacgtacgtaggacggacgtactacacactactacagaacgaacaactaacaaacaacaacagtagtatactacgaactaaagtaacgaacgacgacgagagacgacggtacggacgacgtcgtgtagttagttacgttgtaggtacggacggcggacggtaacgtacgtaacgtaacgtacttacgtaaccgttaacgttaacgg

SEQ ID NO: 298184 - DNA, 631 bp, Homo sapiens
  misc_feature: GZ8MTXP01BBSY1.19.26.C04.1.454.CMB.2.raw
  modified_base (251)..(251): a, c, t, g, unknown or other
  misc_feature (251)..(251): n is a, c, g, or t
  modified_base (274)..(274): a, c, t, g, unknown or other
  misc_feature (274)..(274): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccgccaggctccaggcaaggggctagagtgggtgcagttanatcatatgatggaggtaaaatanattatggagactccgtgaagggccattcaccatctccagagacaattcccaagaacacagtgatctgacaaatgaacagcctagaagagcgtggggacacgggctgtgtattactgtgcgagaggcggtctgggaccaaactacatacctaagtttacgggggtttggacgttcgtagggggaccaaaggggacccacgggtcaacgttccggtacctcccccaaggtccctcccgaaccggaaaccggggcccctaacggttccccggggttccccttttcccccccgttgggggcccccgtcccccgttcggccccgttaccccggaaacggggtccgaaccccgtaacccccgg

SEQ ID NO: 298185 - DNA, 550 bp, Homo sapiens
  misc_feature: GZ8MTXP01BFBW6.19.26.C04.1.454.CMB.2.raw
  modified_base (521)..(521): a, c, t, g, unknown or other
  misc_feature (521)..(521): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaggtaaaatatattatggagactccgtgaagggccgattcaccatctccagagacaattccaagaacacagtggatctgacaaatgaaacagcctgaagagcgtgggggacacggctgtgtattactgtgcgagagcggctggcaacgtacatcctagttacggggtttggacgtcgtcggggaccaagggccacggtcatcgtctccccagccctccaccaacgggcccaagtccggttcttcccccgttggcccnccctcgcctccgacggaacgccgaacccg

SEQ ID NO: 298186 - DNA, 549 bp, Homo sapiens
  misc_feature: GZ8MTXP01EJV30.19.26.C04.1.454.CMB.2.raw
  modified_base (282)..(282): a, c, t, g, unknown or other
  misc_feature (282)..(282): n is a, c, g, or t
  modified_base (392)..(392): a, c, t, g, unknown or other
  misc_feature (392)..(392): n is a, c, g, or t
  modified_base (536)..(536): a, c, t, g, unknown or other
  misc_feature (536)..(536): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggagtaaaatatatatgganactccgtgaaggccgattcaccatctccagagacaattccaaagaacacagtggatctgacaaaatgaaacagccctagaagagcgtgggggacacgggctgtgtattanggtgcgagagcggcgtggcaactacaatactagttacggggtttggtacggtacgtcgggaccgaacggaccgacggtacacgtcgtctcccacgcctccaccaacggccgactcgttccgttccccttccgccgccctcgccnccgacgcgcgccg

SEQ ID NO: 298187 - DNA, 606 bp, Homo sapiens
  misc_feature: GZ8MTXP01CIXDP.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctttccaggcgaaggggctaggagtggggtggcagttatatcatatgatggaaggtaaaatatattatggagactccgtgaaggccgatcaccatctccagagacaattaccaaagaacacagtggatctcgacaaatagaacagaccctagaagagcgtggggacgacggctgtgtattactgtgcgagagcggctggcaactacatccagtttacgggggtttggacgttcgtacgggggaccaaggggacccacggtcacgttccgtcctccccgagcccctacccgacccgaaacgggcccctaacggtcccggttccccgttccccccgttggggtccccgccccgttcgcccttcccggacgggtaaccgccgtaaccccg

SEQ ID NO: 298188 - DNA, 592 bp, Homo sapiens
  misc_feature: GZ8MTXP01CX3JA.19.26.C04.1.454.CMB.2.raw
  modified_base (251)..(251): a, c, t, g, unknown or other
  misc_feature (251)..(251): n is a, c, g, or t
  modified_base (272)..(272): a, c, t, g, unknown or other
  misc_feature (272)..(272): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccgccaggctccaggcaaggggctagagtgggtgcagttanatcatatgatggagtaaatanatatggagactccgtgaaggccgattcaccatctccagagacaattccaaagaacacagtggatctgcaaatgaacagcctagaagagctgggggacacgggctgtgtattacngtagcgagagcggctggcaactacatcccaagttacggggtttggacgttcgtgggggaccaaaggggaccacgggtcaagtccgtctcccccaaggcccctacccgaaccgaaacggggcccctaaacgtcccggggttccctttccccccgttcgggcccgcccccttgggcccttccccgaaggggtaacgcccgtaaccccg

SEQ ID NO: 298189 - DNA, 536 bp, Homo sapiens
  misc_feature: GZ8MTXP01CPFWP.19.26.C04.1.454.CMB.2.raw
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (489)..(489): a, c, t, g, unknown or other
  misc_feature (489)..(489): n is a, c, g, or t
  modified_base (498)..(498): a, c, t, g, unknown or other
  misc_feature (498)..(498): n is a, c, g, or t
  modified_base (504)..(504): a, c, t, g, unknown or other
  misc_feature (504)..(504): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatccacgtgggtcccgccaggcctccgaggcaagggggctaggaggtggggtgcagttanatcatatgatggaagtaaaatntaattangganactcgtagaacggccatcaccatctcagagacaattaccaaagaacacagtaggatctaggacaaatgaaacagcctagagagcgtgggggacacgggctggtgttattacgngtgcgaggngcggtntcggaacaactacactaacgttaagttaacgg

SEQ ID NO: 298190 - DNA, 549 bp, Homo sapiens
  misc_feature: GZ8MTXP01APG2S.19.26.C04.1.454.CMB.2.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (345)..(345): a, c, t, g, unknown or other
  misc_feature (345)..(345): n is a, c, g, or t
  modified_base (353)..(353): a, c, t, g, unknown or other
  misc_feature (353)..(353): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (398)..(398): a, c, t, g, unknown or other
  misc_feature (398)..(398): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatccacgtgggtccgccaggctccgaggcaaggggctaggagtgggtgctagttatatcatatgatggagtaaatntatangganactcgtagaggcattcacatctcagagacaatccaagacacagtgatctgacaaatgaacngacctagngagcgtaggggacacggctggtntattacgngtgacgagagcggntggaccaacgtacattcctaagtttacgggggtttggaccgttcgtgggggacccaaggggccaacgggtcagtccgtcctccccgagccctaccacgacggcccagtccggttccttccccgngccgtccngctccgagcgcgtaacccg

SEQ ID NO: 298191 - DNA, 598 bp, Homo sapiens
  misc_feature: GZ8MTXP01BL8TT.19.26.C04.1.454.CMB.2.raw
  modified_base (357)..(357): a, c, t, g, unknown or other
  misc_feature (357)..(357): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaagtaaaatatattatggagactccgtgaagggccgattcaccatctccagagacaattccaaagaacacagtggatctgacaaatgaaacngaccctgaagagcgtggggacacgggctgtgtattacgtgtgcgagagcggctggacaactacatcctaagtttaacgggggtttcggaacggttcgtacgggggaccaaacggggacccaacgggtcaacgtccggtcctccccgagccctccaccgaacgggcccaacgttccgggttccctttcccccgngggaacccgccccgttcggcccttcccgaacggggccccgccgaaccg

SEQ ID NO: 298192 - DNA, 548 bp, Homo sapiens
  misc_feature: GZ8MTXP01C64R9.19.26.C04.1.454.CMB.2.raw
  modified_base (285)..(285): a, c, t, g, unknown or other
  misc_feature (285)..(285): n is a, c, g, or t
  modified_base (391)..(391): a, c, t, g, unknown or other
  misc_feature (391)..(391): n is a, c, g, or t
  modified_base (480)..(480): a, c, t, g, unknown or other
  misc_feature (480)..(480): n is a, c, g, or t
  modified_base (484)..(484): a, c, t, g, unknown or other
  misc_feature (484)..(484): n is a, c, g, or t
  modified_base (528)..(528): a, c, t, g, unknown or other
  misc_feature (528)..(528): n is a, c, g, or t
  modified_base (535)..(535): a, c, t, g, unknown or other
  misc_feature (535)..(535): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctaggagtgggtgcagttatatcatatgatggaggtaaaatatattatgganactccgtgaaggcgattcaccatctccagagacaattccaaagaacacagtgatctgacaaatgaacagacctgaagagcgtgggggacacgggctgtgtattacngtgcgagagcggctggacaaactacatcctaagtttacgggggtttggaacgtcgtggggccaaagggccacgggtcacgtcgtacccncccngcccaccaccgacggccctacgtccgttcccgttcccgcgcccncctcgcncgacgcgccgccg

SEQ ID NO: 298193 - DNA, 547 bp, Homo sapiens
  misc_feature: GZ8MTXP01ER8V4.19.26.C04.1.454.CMB.2.raw
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggagcgtggtccagcctgggagtccctgagactctcctgtgcagcctctggattcaccttcagtagctttggcatcccacgtgggtcccgccaggcctccgaggcgaagggggctaggaggtggggtgctagttatatcatatgataggaagtaaaatntaaattangganactcgtgaagggccattcaccatctcagagacaaattccaaagaacacagtggaatctagggacaaatagaacagcctagagagcgtaggggacacgggctggtgttattacgttggtgacgaggcgcgggctgggaacaacgtacactccgttaagtttttaacggg

SEQ ID NO: 298194 - DNA, 558 bp, Homo sapiens
  misc_feature: GZ8MTXP01D9Q4J.19.26.C04.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagcctgggagtccctgagactctcctgtgcagcctctggattcaccttnagtagctttggctatcccacgtgggtaccnccaggcctccgaggcgaagggggctaggaggtggggtgctagttatatcatatgataggaagtaaaatntaattatgganactcgtagaacgggcattcacatcacagagactaatacaaagaacacagtgatctaggacaaatagaacagcctagagagcgtagggggacacggcttaaggtgttagttacgttggtaggcgaggcggcgggcgtgggaaccaacgtacacgttcccgttaagttttaaccgggg

SEQ ID NO: 298195 - DNA, 547 bp, Homo sapiens
  misc_feature: GZ8MTXP01B4QQS.19.26.C04.1.454.CMB.2.raw
  modified_base (215)..(215): a, c, t, g, unknown or other
  misc_feature (215)..(215): n is a, c, g, or t
  modified_base (330)..(330): a, c, t, g, unknown or other
  misc_feature (330)..(330): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccnccaggctccaggcaaggggctagagtgggtgcagttatatcatatgatggagtaaatatattatggagactccgtgaaggccgattcacatctccagagacaattccaagaacanagtggatctgacaaatgaacagccctgngagcgtggggacacggctgtgtattactgtgcgagagcggctggcaactacatccagtttacgggggttggacgtcgtggggccaagggccacggtcacgtccgtcctccccagccctccaccgaacgggcccacgtccggttccttccccgttcggcccgcccctggcctccgaggtcgccgaacccg

SEQ ID NO: 298196 - DNA, 669 bp, Homo sapiens
  misc_feature: GZ8MTXP01BFA8Q.19.26.C04.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (283)..(283): a, c, t, g, unknown or other
  misc_feature (283)..(283): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttanatcatangatggagtaaaatatattatgganactcgtgaagggccattcaccatctccagagacaatcccaaagaacacagtgatctgacaaatgaaacagacctagnggagcgtaggggacacggcgtgtagtacttagtggtgcgaaggaggcgggctacgggactaaacgtacacgtaccgtaagtttacggggggtttcggaaccgggttcggtacgggggacccgaaacggggacccgtaacggttccgtaagtttccccggtccgttcccccaagggtcccccttaacccgaacccgggaaaccggggttccccctaaacggtttccccggggttccccttttccccccgggttagggccccgccccgttgccccgttccgaaaccgggggtcgttaacccctaaccccgg

SEQ ID NO: 298197 - DNA, 557 bp, Homo sapiens
  misc_feature: GZ8MTXP01EU26O.19.26.C04.1.454.CMB.2.raw
  modified_base (275)..(275): a, c, t, g, unknown or other
  misc_feature (275)..(275): n is a, c, g, or t
  modified_base (333)..(333): a, c, t, g, unknown or other
  misc_feature (333)..(333): n is a, c, g, or t
  modified_base (394)..(394): a, c, t, g, unknown or other
  misc_feature (394)..(394): n is a, c, g, or t
  modified_base (524)..(524): a, c, t, g, unknown or other
  misc_feature (524)..(524): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagacactcctgtgcagcctctggattcaccttcagtagctttggcatccactgggtccaccaggctccaggcaaggggctagagtgggtgcagttatatcatatgatggagtaaaatanatatggagactccgtgaagggccgattcaccatctcagagacaattcccaaagaacanagtggatctgacaaaatgaaacagcctagaagagcgtaggggacacgggctgtgtattacngtgcgagagcggctggacaactacatcctagtttacgggggttggacgtcgtacggggaccaaggggccacgggtcacgtcgtcctccccagccctaccacgaacgggcccagtccggttccttccccgnggcccgcctcgcctccgaggcgttccgaacccg

SEQ ID NO: 298198 - DNA, 611 bp, Homo sapiens
  misc_feature: GZ8MTXP01D7778.19.26.C04.1.454.CMB.2.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (324)..(324): a, c, t, g, unknown or other
  misc_feature (324)..(324): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggtttcctcgttagctctttaagaggtgtccagtgtcaggtgcactggtggagtcgtgggggagcgtggtccagcctgggagtccctgacgactctcctgtgcncgctcgtgtctcactnagtcgtcttgctactccncgtcggtccacgacggcctacgaggacggagggctaggnggtgggtgtactagttatatactatagtagagtaaggtaaagttaaatagtaaagttagtcggaacgtaccgtaccgggtaggacgggtactattaccactactccacgagactaactaacgtaccaaagaacagtagtagtatacgtacgaactaagtaacgaacgacgacgtagacggacggacggtacgggtacgacggtcgtgttagttacgttacgttggtacggtacggacggcggcggtcgtacgaacgtaactacttacgtaacgttaacggttaacgg

SEQ ID NO: 298199 - DNA, 587 bp, Homo sapiens
  misc_feature: GZ8MTXP01ARU5R.19.26.C04.1.454.CMB.2.raw
  modified_base (273)..(273): a, c, t, g, unknown or other
  misc_feature (273)..(273): n is a, c, g, or t
  modified_base (376)..(376): a, c, t, g, unknown or other
  misc_feature (376)..(376): n is a, c, g, or t
  modified_base (498)..(498): a, c, t, g, unknown or other
  misc_feature (498)..(498): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggaggcgtggtccagcctgggagtccctgagactctcctgtgcagcctctggattcaccttnagtgctttggcatcccacgtcggggtcccgccaggcctccgaggccgaagggggctaggaggtgggtgctagtttatatcatatgagtagggaaagtaaaatnttaaattagtgggataccgtcggtagaaggggccctattccacctatctaccagagactaactaccaaagaacacgagtagatacgtagacaaatgaacagccgtagagacgcgtggggacncggtctggtagttagtttacgttggtcgacggttaggacggcgggctagggaaccaaacgtacacgttcccgttaaggttttaaccggg

SEQ ID NO: 298200 - DNA, 534 bp, Homo sapiens
  misc_feature: GZ8MTXP01BU9W6.19.26.C04.1.454.CMB.2.raw
  modified_base (278)..(278): a, c, t, g, unknown or other
  misc_feature (278)..(278): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
  modified_base (530)..(530): a, c, t, g, unknown or other
  misc_feature (530)..(530): n is a, c, g, or t
  modified_base (532)..(532): a, c, t, g, unknown or other
  misc_feature (532)..(532): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccaccaggctccaggcaaggggctagagtgggtggcagttatatcatatgatggagtaaaatatatanggagactccgtgaaggccattcaccatctccagagacaattcccaaagaacacagtggatctagcaaaatgaacagaccctgaagagcgtggggacacgggctgtgtattactgtgcgagagcggctggcaaactacataccaatttacgggggtttggaacgtcgtggggaccaaaggggccacggtcatccgtctccccagcctcaccaagggcccatccggcttccccnggcnccctgcctccaggccncncg

SEQ ID NO: 298201 - DNA, 556 bp, Homo sapiens
  misc_feature: GZ8MTXP01DW418.19.26.C04.1.454.CMB.2.raw
  modified_base (301)..(301): a, c, t, g, unknown or other
  misc_feature (301)..(301): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
tcagtactctcgtgcacgaccggtgctcgatttagtctagcgactttggggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggagcgtggtccagcctgggagtccctgagactctcctgtgcagcctctggattcaccttcagtagcttggcatccacgtcgggtcccncaggctccgaggcaagggggctaggaggtgggtgctagttatatcatatgatggaagtaaatntaatangganactcgtgaagggccattcacatctcagagaacaataccaaagaacacgagtaggatcgtaggaacaaatgaaacgagacctagaggagcgtggggacgacgggctggtgttattacgttggtcgcggagcggttcggcgtacgggaacctaacgtacgacttccgttaacgtttaaccgggg

SEQ ID NO: 298202 - DNA, 769 bp, Homo sapiens
  misc_feature: GZ8MTXP01DU7P7.19.26.C04.1.454.CMB.2.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaagtaaatatattangganactcggtgaaggcattcaccatctccagacgacaatccaaagaacacagtggatctagacaaatgaaacagacctaggaacggagccgggtagggggaaccacggggtcttgggttagtaagtttacgtggtaggcggaagacgggtacgggcgttacgggaccaaaaccgttaaccgaattaccccgttaaagggtttttaaccggggggggttttacggggtaaacccggtttcgggttaccggggggggaaccccgtaaaacggggggaaccccgtaaacgggggttacctaacgtttccccgggtacccctttccccccgaaaccgggtcccccttaccccgaaaccccgggaaacccgggggttccccctaaacgggttccccgggtttccccgtttcccccccgggttacgggtcccccgtcccccgttcggttaccccgtacccggaaacggggtcccgaaccccgttaaacccccgg

SEQ ID NO: 298203 - DNA, 539 bp, Homo sapiens
  misc_feature: GZ8MTXP01AB4UV.19.26.C04.1.454.CMB.2.raw
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattcccaaagaacacagtggatctgacaaatgaacagaccctgaacgagcctggggacacgggctgtgtattactgtgcgagagcggctggcaacgtacatccattacggggtttgacgttctggggccaaggccaggtcatcgtctcccagccctccacaacgggcccagtccggttcttccccgttggccgccctgcctccgaggaacgcaacccg

SEQ ID NO: 298204 - DNA, 589 bp, Homo sapiens
  misc_feature: GZ8MTXP01DGV4O.19.26.C04.1.454.CMB.2.raw
  modified_base (275)..(275): a, c, t, g, unknown or other
  misc_feature (275)..(275): n is a, c, g, or t
  modified_base (553)..(553): a, c, t, g, unknown or other
  misc_feature (553)..(553): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaggtaaaatanattatggagactccgtgaaggccgattcaccatctccagagacaattccaaagaacacagtggatctgacaaatgaaacagaccctagaagagcgtagggggacacgggctgtagtatttactagtggacgagaggcggctgggacaaactacgactccaagtttacgggggtttggacggttacgtcgggggacctaaagggacccacgggtacagtccgtcctccccaggccctacccgaccgtaacgggccctaacgtccggttccttcccccgnggcccggccctcgcctccgacgggcgccgaaccccg

SEQ ID NO: 298205 - DNA, 525 bp, Homo sapiens
  misc_feature: GZ8MTXP01EAKSE.19.26.C04.1.454.CMB.2.raw
  modified_base (362)..(362): a, c, t, g, unknown or other
  misc_feature (362)..(362): n is a, c, g, or t
  modified_base (409)..(409): a, c, t, g, unknown or other
  misc_feature (409)..(409): n is a, c, g, or t
  modified_base (419)..(419): a, c, t, g, unknown or other
  misc_feature (419)..(419): n is a, c, g, or t
  modified_base (443)..(443): a, c, t, g, unknown or other
  misc_feature (443)..(443): n is a, c, g, or t
  modified_base (449)..(449): a, c, t, g, unknown or other
  misc_feature (449)..(449): n is a, c, g, or t
  modified_base (465)..(465): a, c, t, g, unknown or other
  misc_feature (465)..(465): n is a, c, g, or t
  modified_base (487)..(487): a, c, t, g, unknown or other
  misc_feature (487)..(487): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggttttcctcgttagctctttaagaggtgtccagtgtcaggtgcacctggtggagtcgtgggggagcgtggtccagcctgggagtccctgagactctcctgtgcagcctctggattcaccttcagtagctttggcatccacgtcgggtccgccaggctccgaggcgaagggggctaggagtgggtgcagttatatcatatgatggaagtaaaatntaattagtggagactccggtagaacggggccattcaccatctcaganacaatacaanaacacagtagatctggaacaatanacagcngagagcgtggacgcgngtgtgttattagttgtgcgagngcggcgtacgaacactacactaacgttaacgttaacgg

SEQ ID NO: 298206 - DNA, 548 bp, Homo sapiens
  misc_feature: GZ8MTXP01DMQ5Z.19.26.C04.1.454.CMB.2.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (404)..(404): a, c, t, g, unknown or other
  misc_feature (404)..(404): n is a, c, g, or t
  modified_base (409)..(409): a, c, t, g, unknown or other
  misc_feature (409)..(409): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaccgtggtggagtcgtggggggaggcgtggtccaggcctgggagtccctgagactctcctgtgcagcctctggattcaccttcagtagcttggcatccacgtgggtcccnccaggcctccgaggcgaagggggctaggaggtggggtgcagttatatcatatgataggaagtaaaatntaattangganactcgtagaagggcatcacatcncaganacaattaccaaagaacacagtagatactaggacaaatagaaacagccgtagaagacgcgtaggggacacggctgtgttattacgttgtggcgaggcgcgggctggaactaacctacttactccgttaaggtttaacggg

SEQ ID NO: 298207 - DNA, 562 bp, Homo sapiens
  misc_feature: GZ8MTXP01BL0BA.19.26.C04.1.454.CMB.2.raw
  modified_base (484)..(484): a, c, t, g, unknown or other
  misc_feature (484)..(484): n is a, c, g, or t
  modified_base (534)..(534): a, c, t, g, unknown or other
  misc_feature (534)..(534): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccgaggcaaggggctagagtgggtgcagttatatcatatgatggaaggtaaaatatattatggagactcgtagaaggccattcacatctccagagacaattccaagaacacagtgatctgacaaatgaacagacctgaagagcgtggggacacggctgtgtattacgtgtgcgagagacggctggacaactacatacctagtttacgggggtttggacgttcgtcgggggaccaaggggaccacggtccatccgtcctccccngccctccgaccgaacgggccccagttccggttcccttccccgttggcccncccgtgcctccgaggtcgccgtaacccg

SEQ ID NO: 298208 - DNA, 565 bp, Homo sapiens
  misc_feature: GZ8MTXP01BG50Z.19.26.C04.1.454.CMB.2.raw
  modified_base (276)..(276): a, c, t, g, unknown or other
  misc_feature (276)..(276): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatanattatggagactccgtgaaggccgattcacatctccagagacaattccaagaacacagtggatctgacaaatgaacagacctgaagagcgtggggacacggctgtgtattactgtgcgagagacggctggcaacgtacatcctaagttacgggggtttggacggtcgtacggggaccaaggggacccagggtccatccgtcctccccgacgccctcccaccgaaacgggccccaagtccgggttcccttccccgttggcccgccctgcctccgacggcgccgtaacccg

SEQ ID NO: 298209 - DNA, 560 bp, Homo sapiens
  misc_feature: GZ8MTXP01BAXUE.19.26.C04.1.454.CMB.2.raw
  modified_base (350)..(350): a, c, t, g, unknown or other
  misc_feature (350)..(350): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcacttcagtagctttggcatccacgtcgggtcccgccaggcctccgaggcgaagggggctaggaggtgggtgctagttatatcatangataggaagtaaaatntaaattagngganacgtccggtaggaacgggccgtattccacctatcctacagagacaattaccaagaacacagtggatctaggacaaatgaacagcctgagagcgtggggacacggctggtgttattacgttggtcgcggagcggcggaacgtgggaacctaacgtacgacttcccgttaagtttaaccgggg

SEQ ID NO: 298210 - DNA, 553 bp, Homo sapiens
  misc_feature: GZ8MTXP01EGOKN.19.26.C04.1.454.CMB.2.raw
  modified_base (302)..(302): a, c, t, g, unknown or other
  misc_feature (302)..(302): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (381)..(381): a, c, t, g, unknown or other
  misc_feature (381)..(381): n is a, c, g, or t
  modified_base (479)..(479): a, c, t, g, unknown or other
  misc_feature (479)..(479): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggagtccctgagactctcctgtgcagcctctggattcaccttcagtagctttggcatccacgtcgggtcccnccaggcctccgaggcgaagggggctaggaggtggggtgctagttatatcatatgataggaagtaaatntaattangganactcgtagaacgggcattcacatctacagagacaataccaaagacacagtgatcgtaggacaaatgaaacgagcctagagagcgtaggggacacgggntggtgttattacgttgtcggacgaggcggcggctcgggaacctaacgtacacgttccgttaagtttaaccgggg

SEQ ID NO: 298211 - DNA, 583 bp, Homo sapiens
  misc_feature: GZ8MTXP01BQH5I.19.26.C04.1.454.CMB.2.raw
  modified_base (273)..(273): a, c, t, g, unknown or other
  misc_feature (273)..(273): n is a, c, g, or t
  modified_base (283)..(283): a, c, t, g, unknown or other
  misc_feature (283)..(283): n is a, c, g, or t
  modified_base (385)..(385): a, c, t, g, unknown or other
  misc_feature (385)..(385): n is a, c, g, or t
  modified_base (546)..(546): a, c, t, g, unknown or other
  misc_feature (546)..(546): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggagtaaaatntattatgganactccgtgaagggccattcacatctccagacgacaattcccaagaacacagtggatctgacaaatgaacagacctagaagagcgtgggggacacgggctgtntattactgtgcgaggagcggactgggacaaacgtacattccgtaagtttacgggggtttggacggttcgtgggggaccaacggggtaccgacggttcacgtccgtccgtccccaggccctacccgaccgaacgggcccctaagtccggttcctttccccgnggtcccgccctggacctccgacggaacgccaacccgg

SEQ ID NO: 298212 - DNA, 626 bp, Homo sapiens
  misc_feature: GZ8MTXP01DSWGZ.19.26.C04.1.454.CMB.2.raw
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggcctgggagtccctgagactctcctgtgcagcctctggattcaccttnagtagctttggcatccacgtgggtcccnccaggcctccgaggccgaaagggggctaaggaggtgggtgctagttatatcatatgatggaaagtaaaatntaaattatgggatacgtccggtagaaacgggccgtaattccacctatacctaccaagaacgaacaaacttaccaaaagaaacgaacgaagtaggaatacgtagggaacaaaagtacgaaacgacgaccgtaggaacgtaggcgtagggggaaccaacgggtcttaaggttagttaagtttacgttggtaggacggaggacggcgggaacgtagggaacctaaacgtacacttaacccgttaacgttttaaccgggg

SEQ ID NO: 298213 - DNA, 655 bp, Homo sapiens
  misc_feature: GZ8MTXP01DRECJ.19.26.C04.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (306)..(306): a, c, t, g, unknown or other
  misc_feature (306)..(306): n is a, c, g, or t
  modified_base (327)..(327): a, c, t, g, unknown or other
  misc_feature (327)..(327): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtcctgagactctcctgtgcagcctctggattcacttcagtagctttggcatccacgtgggtccncaggctccgaggcaaggggctagagtgggtgcagttanatcatatgatggaagtaaaatatatatggagactcgtgaaggccgatcacatcncagagacaatccaaagaacanagtggatctgacaaaatgaaacagacctagaagagcgtgggggacacggcgtgtgtattacgtgtagcgagagcggctaggacaaacttacaatacctagtttacggggttggacggttcgagggggaccaaagggggtaccacgggtactaacgtcccgtaccgtccccgaacgtccccgtaacccaacccggtaaaaccgggggttccccctaaacgggtttccccgggtttaccccctttcccccccgggttgggaacccccggtcccccgttcggaccccgttacccgggaaccgggggtaaccaaccccggtaaacccccggg

SEQ ID NO: 298214 - DNA, 608 bp, Homo sapiens
  misc_feature: GZ8MTXP01CQHBJ.19.26.C04.1.454.CMB.2.raw
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (336)..(336): a, c, t, g, unknown or other
  misc_feature (336)..(336): n is a, c, g, or t
  modified_base (368)..(368): a, c, t, g, unknown or other
  misc_feature (368)..(368): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctgattcacttnagtgcttggcatccacgtgggtcccncaggcctccgaggcgaaggggctaggagtgggtgcagttanatcatatgataggaagtaaaatgtaaattagnggaacgtacgtaccggtaggaacggggtcctaattccgacctatcctaccgaagacgaactaaacttacccaaagaaccaacgtagtacggatacgtaggaactaaagtgaaacagccgtaggacgacgcggtaggggacacggtcgtgtagttagttacgttggtcggacggttaggcggccgggtcgtacgggaacctaaacttaccgacgttaaccccgttaaggttttaaccgggg

SEQ ID NO: 298215 - DNA, 533 bp, Homo sapiens
  misc_feature: GZ8MTXP01CKPEG.19.26.C04.1.454.CMB.2.raw
  modified_base (302)..(302): a, c, t, g, unknown or other
  misc_feature (302)..(302): n is a, c, g, or t
  modified_base (371)..(371): a, c, t, g, unknown or other
  misc_feature (371)..(371): n is a, c, g, or t
  modified_base (383)..(383): a, c, t, g, unknown or other
  misc_feature (383)..(383): n is a, c, g, or t
  modified_base (403)..(403): a, c, t, g, unknown or other
  misc_feature (403)..(403): n is a, c, g, or t
  modified_base (406)..(406): a, c, t, g, unknown or other
  misc_feature (406)..(406): n is a, c, g, or t
  modified_base (488)..(488): a, c, t, g, unknown or other
  misc_feature (488)..(488): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggacttcaccttcagtagctttggcatcccacgtggggtccccnccaggcctccgaggccaaagggggctaggaggtggggtggcagttatatcatatgatggaagtaaaatntaaattatgganactcgtagagggccatcacntcncagagacaattaccaaagaacacagtggatctaggacaaatgaaacagcctgagagcgtggggacacggctgtgttattacngtgcgagngcggntggaacacgtacactccgttaagtttaacggg

SEQ ID NO: 298216 - DNA, 730 bp, Homo sapiens
  misc_feature: GZ8MTXP01A82AP.19.26.C04.1.454.CMB.2.raw
  modified_base (655)..(655): a, c, t, g, unknown or other
  misc_feature (655)..(655): n is a, c, g, or t
  modified_base (673)..(673): a, c, t, g, unknown or other
  misc_feature (673)..(673): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcactggtggagtcgtgggggagcgtggtccagcctgggagtccctgacgtctctcgtgtcgcacgtcctcgtagtacttcctaccgttcgaagtcgtctttggactaccgtacccgacggttccgggtccccgacgacggtccctaccggaaggacggaacgggggtctaagggtaggggttgggggtacgacgtttaagtttaatacgttacagttagtacggtaagttacggggtaaaagttaaaatagttaaagttaacgaaggggaaactaccgttacccgggaaggggaaccggggacccttaattacccaaacctcttacccgaaccgaaggtaactaaaccttaaacgttaaccccgaaaagtaaacccgaaacggtacggttaaggtacttaccgtaagggaaacctaaaagtacgaaacgtacgtccgagacgacgtcgggtagggaccctaggtntaagggtattacttcggnggtagacgaggcggcgtcgacgaactaactcgttacgtaacgttaacggttaacggg

SEQ ID NO: 298217 - DNA, 574 bp, Homo sapiens
  misc_feature: GZ8MTXP01EJJP2.19.26.C04.1.454.CMB.2.raw
  modified_base (214)..(214): a, c, t, g, unknown or other
  misc_feature (214)..(214): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (282)..(282): a, c, t, g, unknown or other
  misc_feature (282)..(282): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttatatcatatgatggagtaaaatnattangganactccgtgaaggccattcaccatctccagagacaattccaaagaacacagtggatctgacaaaatgaaacagaccctgaacgagcgtaggggacacgggctgtgtatactgtgcgagagcggctggacaactacatccagtttaacgggggtttgacgtcgtcgggggaccaaaggggccctacggtcactccggtacctcccccaggccctccaaccgaaacggggcccaattccgggttcccttcccccgttgggcccgcccctggccctccgaggaaccgcgaaccccg

SEQ ID NO: 298218 - DNA, 525 bp, Homo sapiens
  misc_feature: GZ8MTXP01A5WBL.19.26.C04.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
  modified_base (361)..(361): a, c, t, g, unknown or other
  misc_feature (361)..(361): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (442)..(442): a, c, t, g, unknown or other
  misc_feature (442)..(442): n is a, c, g, or t
  modified_base (467)..(467): a, c, t, g, unknown or other
  misc_feature (467)..(467): n is a, c, g, or t
  modified_base (481)..(481): a, c, t, g, unknown or other
  misc_feature (481)..(481): n is a, c, g, or t
  modified_base (487)..(487): a, c, t, g, unknown or other
  misc_feature (487)..(487): n is a, c, g, or t
  modified_base (492)..(492): a, c, t, g, unknown or other
  misc_feature (492)..(492): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtggggagcgtggtccagcctgggagtccctgagactctcctgtgcagcctctggattcaccttnagtagcttggcatccacgtgggtccnccaggcctccgaggcaagggggctaggagtgggtgcagttanatcatatgataggaagtaaaatntaattatcgggatactcgtagaagggccatcacntcncagagacaatccaaagacacgagtgatctggacaaatcgaaacngcctgaacgagcgtggggacacggntgtgttatacttgngcgagngcggntggaacaacgtacactccgttaagtttaacggg

SEQ ID NO: 298219 - DNA, 547 bp, Homo sapiens
  misc_feature: GZ8MTXP01E0DCV.19.26.C04.1.454.CMB.2.raw
  modified_base (523)..(523): a, c, t, g, unknown or other
  misc_feature (523)..(523): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaaagaacacagtggatctgacaaatgaaacagacctgaagagcgtagggggacacgggctgtgtattactgtgcgagagcgggctgggacaacgtacataccagtttacgggggttggacgtcgtggggccaagggccaggtcatcgtctcccagccctccacgacggcccagtccggttccttccccgttggcccnccctgcctccgaggcgcgaacccg

SEQ ID NO: 298220 - DNA, 703 bp, Homo sapiens
  misc_feature: GZ8MTXP01CBMLU.19.26.C04.1.454.CMB.2.raw
  modified_base (215)..(215): a, c, t, g, unknown or other
  misc_feature (215)..(215): n is a, c, g, or t
  modified_base (276)..(276): a, c, t, g, unknown or other
  misc_feature (276)..(276): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccnccaggctccgaggcaaggggctagagtgggtgcagttatatcatatgatggaagtaaatanattatggagactcgtagaagggccgattcaccatctcagagaacaattcccaaagaacacagtgatctacgacaaaatgaaacagaccctaggaagagcgtgggggacacgggtctgtgtattactggtgcggaagaggcggcgtagggaccaaacgtactaacgtaccgtaacgttttaccggggggtttagggtaaccggttcggttacggggggacccgaaacgggggacccgtacggggtacctacgttcccggttaccctcccccgaacggtcccccttaaccccgaaaccccgggtaaaaccccgggggttcccctaaaccggtttccccgggttcccccgtttccccccggttccggggtccccggtcccccgttcggcccgttacccggaccgggtaaccgggcccctaaacccccggg

SEQ ID NO: 298221 - DNA, 594 bp, Homo sapiens
  misc_feature: GZ8MTXP01B0KIM.19.26.C04.1.454.CMB.2.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (538)..(538): a, c, t, g, unknown or other
  misc_feature (538)..(538): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggacggtccctgagactctcctgtgcagcctctggattcaccttcagtagctttggcatccacgtcgggtcccnccaggcctccgaggcgaagggggctaggnggtgggtgctagttanatcatatgataggaagtaaatntaaattagngganacgtcgtagaacgggcctattccacatcctacgagacgaactaaacttaccaaagaacacgtagtaggtatacgtaggaactaaatacgaaacacgccgtaggagacggcgtaggggacgacggtcgtggtgttagttacgttgtaggcggacgngggccggtcgtcggtaaccaaccgtacgttacgtaacccgttaaggtttaaccggg

SEQ ID NO: 298222 - DNA, 560 bp, Homo sapiens
  misc_feature: GZ8MTXP01B9SIR.19.26.C04.1.454.CMB.2.raw
  modified_base (492)..(492): a, c, t, g, unknown or other
  misc_feature (492)..(492): n is a, c, g, or t
  modified_base (531)..(531): a, c, t, g, unknown or other
  misc_feature (531)..(531): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaagggggctaggagtggggtggcagttatatcatatgatggaaggtaaaatatattatggagactccggtgaagggccgattcaccatctccagagacaattccaaagaacacagtggatctacgacaaatgaacagacctgaagagcgtggggacacgggctgtgtattactgtgcgagagcggctggacaacgtacataccagtttacgggggtttggacggtctgggggaccaagggaccgacggtcagtccgtcctccccngccctccaccgaacggcccacgtccggttccttccccgnggcccgccctgcctcgacgcgccaacccg

SEQ ID NO: 298223 - DNA, 572 bp, Homo sapiens
  misc_feature: GZ8MTXP01BXXXE.19.26.C04.1.454.CMB.2.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctggattcaccttcagtagctttggcatcccacgtcgggtccccncgaggcctccgaggcgaagggggctaggaggtgggtgctagttatatcatatgatggaagtaaatntaaattangganacgtcgtagaacgggccatccacatctcagagacaatacaagaacacgagtgatctaggactaaagtcgaaacgagccgtagaagacggcgtagggggacctacgggtcgtggtgttatttacgttggtaggcggaggcggccgggtctgggaacctaaacgtaccacgttcccgttaagttttaaccgggg

SEQ ID NO: 298224 - DNA, 599 bp, Homo sapiens
  misc_feature: GZ8MTXP01A358R.19.26.C04.1.454.CMB.2.raw
  modified_base (215)..(215): a, c, t, g, unknown or other
  misc_feature (215)..(215): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (552)..(552): a, c, t, g, unknown or other
  misc_feature (552)..(552): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccnccaggctccaggcaaggggctagagtgggtgcagttanatcatatgatggagtaaatanatatggagactccgtgaaggcgattcacatctccagagacaattccaaagaacacagtgatctgacaaatgaaacagcctagaagagcgtaggggacacgggctgtgtattacgtgtgacgagagcggctggacaactacgaactccgtaagtttacgggggtttcggacggttcggtacgggggaccgaacggggaccacgggtcacgtccgtcctccccgacgccctaccgacccgtaaacgggcccctaacgttcccggttcccgtttcccccgnggtcccgtcccctcggccctacccgacgggcgaacccgtaaccccgg

SEQ ID NO: 298225 - DNA, 659 bp, Homo sapiens
  misc_feature: GZ8MTXP01DN2KJ.19.26.C04.1.454.CMB.2.raw
  modified_base (303)..(303): a, c, t, g, unknown or other
  misc_feature (303)..(303): n is a, c, g, or t
  modified_base (332)..(332): a, c, t, g, unknown or other
  misc_feature (332)..(332): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcacctggtggagtcgtgggggagcgtggtccaggcctgggagtccctgagactctcctgtgcagcctctggattcacttcagtagctttggcatcccacgtcgggtcccnccaggcctccgaggcgaagggggctaggngtggggtgcagttanatcatatgataggaagtaaaatntaaattagtgganacgttccgtagaaacggggcctattccacctatctaccaagacgaacaaacttacccaaagaaccaacgagtaggattaccgtagggaactaaaagttacgaaaaccgacggacccgtaggaaggaacggccggtaaggggggaacctaccggggtacgttgggtttacgttaagtttaccgttcgggttaggaccgggaagggcgggaccggggtcgttagggaacccgtaaaccgtacttaacgttaaccccgttaaagtttttaacccggggg

SEQ ID NO: 298226 - DNA, 571 bp, Homo sapiens
  misc_feature: GZ8MTXP01CHJQC.19.26.C04.1.454.CMB.2.raw
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
  modified_base (396)..(396): a, c, t, g, unknown or other
  misc_feature (396)..(396): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccacaggctccaggcaaggggctagagtgggtgcagttatatcatatgatggaaggtaaaatatattatggagactccggtgaagggccgattcaccatctccagagacaattccaaagaacacagtggatctacgacaaatgaaacagccctagngagcgtggggacacggctgngtattacgnggtgcgagagcggctggcaactacatccagttacgggggtttgacggttcgtggggacctaagggaccgacggtcactccggtcctccccgagccctccaccgaaacgggccctaacgtccggttcccttccccgttcggcccgccctcgcctccgacggtaaccgccgaacccg

SEQ ID NO: 298227 - DNA, 596 bp, Homo sapiens
  misc_feature: GZ8MTXP01CX0KK.19.26.C04.1.454.CMB.2.raw
  modified_base (282)..(282): a, c, t, g, unknown or other
  misc_feature (282)..(282): n is a, c, g, or t
  modified_base (286)..(286): a, c, t, g, unknown or other
  misc_feature (286)..(286): n is a, c, g, or t
  modified_base (310)..(310): a, c, t, g, unknown or other
  misc_feature (310)..(310): n is a, c, g, or t
  modified_base (390)..(390): a, c, t, g, unknown or other
  misc_feature (390)..(390): n is a, c, g, or t
  modified_base (392)..(392): a, c, t, g, unknown or other
  misc_feature (392)..(392): n is a, c, g, or t
  modified_base (402)..(402): a, c, t, g, unknown or other
  misc_feature (402)..(402): n is a, c, g, or t
  modified_base (412)..(412): a, c, t, g, unknown or other
  misc_feature (412)..(412): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactgggtccaccaggctccgaggcaaggggctaggagtgggtgcagttatatcatatgataggaagtaaatatatanaganactcgtagaggcatcacatctcanagacaataccaaagaacacagtagatctagacaaatgaacagacctagaagagcgtaggggacacggctgtagtattagngngagagagcgnagacaactanactacgtagttacggggttacgacggtacggacgggaccgaacggaccgtacggtactacgtccgtaccctacccgacgtaacccctaccgaaccggtaaccggccccgtacgttcccggttccccgttccccggcggtccccgtcccgtcggcccgtaccggacggtaaccgaacccgaaccg

SEQ ID NO: 298228 - DNA, 543 bp, Homo sapiens
  misc_feature: GZ8MTXP01AB9VB.19.26.C04.1.454.CMB.2.raw
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (359)..(359): a, c, t, g, unknown or other
  misc_feature (359)..(359): n is a, c, g, or t
  modified_base (371)..(371): a, c, t, g, unknown or other
  misc_feature (371)..(371): n is a, c, g, or t
  modified_base (476)..(476): a, c, t, g, unknown or other
  misc_feature (476)..(476): n is a, c, g, or t
  modified_base (489)..(489): a, c, t, g, unknown or other
  misc_feature (489)..(489): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttcagtagctttggcatccactgggtcccncaggctccaggcaagggggctaggnggtgggtgcagttanatcatangatggaagtaaaatntaaattatgganacgtcggtagaacggggcctattccacctatctaccagagacaatccaaagaacacgagtgatctaggacaaatgaacagccgtgacgagccgtggggacacggntgtgttattacgnggtgcggaggcggcggctcgggaactaacgtacacgtccgttaagtttccgggg

SEQ ID NO: 298229 - DNA, 563 bp, Homo sapiens
  misc_feature: GZ8MTXP01AF2BQ.19.26.C04.1.454.CMB.2.raw
  modified_base (276)..(276): a, c, t, g, unknown or other
  misc_feature (276)..(276): n is a, c, g, or t
  modified_base (384)..(384): a, c, t, g, unknown or other
  misc_feature (384)..(384): n is a, c, g, or t
  modified_base (536)..(536): a, c, t, g, unknown or other
  misc_feature (536)..(536): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaaggtaaaatanattatggagactccgtgaaggccgattcacatctccagagacaattccaaagaacacagtggatctgacaaatgaaacagcctgaagagcgtggggacacgggctgtntattactgtgcgagagcggctggacaacgtacatcctaagttacgggggtttggacggtcgtacggggccgaaggggccacggtcagtccgtcctcccccagccctccaccgaacgggcccctagtccgggttcccttcccccgttggcccnccctcgcctccgacggcgccgaacccg

SEQ ID NO: 298230 - DNA, 567 bp, Homo sapiens
  misc_feature: GZ8MTXP01DSR2M.19.26.C04.1.454.CMB.2.raw
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (514)..(514): a, c, t, g, unknown or other
  misc_feature (514)..(514): n is a, c, g, or t
  modified_base (522)..(522): a, c, t, g, unknown or other
  misc_feature (522)..(522): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatcccacgtggggtcccgccaggcctccgaggcaagggggctaggaggtggggtgcagttatatcatatgatagggaagtaaatntaaattangganactccggtagaacgggcattcacatctcagagacaattacaaagacacgagtggatctaggacaaagtagaaacagcctaggagacgcggtggggacgacggtctggtgttagttacgttggtaggcgttaggnggaccggngtacggaactaacgtacttactaacccgttaagttttaaccgggg

SEQ ID NO: 298231 - DNA, 600 bp, Homo sapiens
  misc_feature: GZ8MTXP01C7F75.19.26.C04.1.454.CMB.2.raw
  modified_base (531)..(531): a, c, t, g, unknown or other
  misc_feature (531)..(531): n is a, c, g, or t
tcagtactctcgtgcacgaccggtgctcgatttagtctagcgactttgggtttgggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagcctgggagtccctgagactctcctgtgcagcctctggattcaccttcagtagcttggctatccacgtcgggtcccgcaggcctccgaggcgaaggggctaggaggtgggtgctagttatatcatatgagtaggaagttaaaatattaaagttagtggagtaccgttccggaggaaacgggcctaatccaccatctacagaagaacaaacttaccaaagaacacgagtaggaatcgtaggaacaaagtacgaaacaggcctaggagacggcggtaggggaccacggtctaaggttgttagttacgngtacggcggagacggcgggtcgacggaaccaaactacgttacgttaaccgttaacggttttaaccgggg

SEQ ID NO: 298232 - DNA, 571 bp, Homo sapiens
  misc_feature: GZ8MTXP01C9FW2.19.26.C04.1.454.CMB.2.raw
  modified_base (279)..(279): a, c, t, g, unknown or other
  misc_feature (279)..(279): n is a, c, g, or t
  modified_base (287)..(287): a, c, t, g, unknown or other
  misc_feature (287)..(287): n is a, c, g, or t
  modified_base (395)..(395): a, c, t, g, unknown or other
  misc_feature (395)..(395): n is a, c, g, or t
  modified_base (490)..(490): a, c, t, g, unknown or other
  misc_feature (490)..(490): n is a, c, g, or t
  modified_base (543)..(543): a, c, t, g, unknown or other
  misc_feature (543)..(543): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtggggtccgccaggctccgaggcaagggggctaggagtgggtggcagttatatcatatgatggagtaaatanatatgganactccgtgaaggcattcacatctcagagacaattccaaagaacacagtggatctgacaaatgaaacagacctagaagagcgtagggggacacgggctgtgtattacgngtgcgagagcggctggacaacacactacctaagtttacggggtttcggacgtcgtcggggaccaaacgggacccaggtccagtccgtcctccccngccctccaaccggacggcccctagtcccggttcccgttcccccgttgggcccnccctgccctcgacggtcgccgtaacccg

SEQ ID NO: 298233 - DNA, 634 bp, Homo sapiens
  misc_feature: GZ8MTXP01AXUFM.19.26.C04.1.454.CMB.2.raw
  modified_base (298)..(298): a, c, t, g, unknown or other
  misc_feature (298)..(298): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtgggttttcctcgttgctctttaagaggtgtccagtgtcaggtgcacctggtggagtcgtgggggagcgtggtccagccgtgggagtccctgagactctcctgtgcagcctctggattcacttcagtagctttggcatccacgtcgggtccnccaggcctccgaggcaagggggctaggaggtggggtggctaaggtttatagtacattagtgatagggaaagttaaaatagttaaattagtgggaacgtactccggtaggaaacggggtcctaaattccacctattccaccaaggaacaactaaacttaccaaagaaccagagttagaactcgtaggaaacaataacgaacgacgacgacgacggacggacggtacgggacggtacggtcgtaagttagttagttacgttcggtacggtacggacggcggacggtaacggtacggaaccgtaaccgtacgttacgtaaccgttaacggtttaacggg

SEQ ID NO: 298234 - DNA, 641 bp, Homo sapiens
  misc_feature: GZ8MTXP01EC1B4.19.26.C04.1.454.CMB.2.raw
  modified_base (296)..(296): a, c, t, g, unknown or other
  misc_feature (296)..(296): n is a, c, g, or t
  modified_base (322)..(322): a, c, t, g, unknown or other
  misc_feature (322)..(322): n is a, c, g, or t
  modified_base (458)..(458): a, c, t, g, unknown or other
  misc_feature (458)..(458): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggcctgggagtccctgagactctctgtgcagcctctggattcacttcagtgcttggcatccgacgtgggtcccncaggctccgaggcaagggggctaggnggtggggtgctagttatatcatagtgatagggaagttaaaatctaaaattagtgggaagtaccgtccgggtagaaacggggtcctatttaccacctatcctaccaagaacgaactaaacttaccaaagaaccgaanagtaggaacttacgtaaggggaactaaagtacgaaacgaacgccgtaggagaacggcggtacgggggaccgtaacgggcgttaaggtgttagttaccgttggtaggtacggaaggcggccgggtaacgtacgggtaaccgtaaccgttaccgttacttaaccgttaacggttttaaccggggg

SEQ ID NO: 298235 - DNA, 518 bp, Homo sapiens
  misc_feature: GZ8MTXP01BT6HD.19.26.C04.1.454.CMB.2.raw
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (483)..(483): a, c, t, g, unknown or other
  misc_feature (483)..(483): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagcttggcatccactgggtcccncaggctccaggcaagggggctagngtgggtgcagttanatcatatgatggaagtaaatntaattangganactcgtgaagggcattcacatctcagagacaattaccaagaacacagtggatctaggacaaatagaacagcctgagagcgtaggggacacgggctgtgttatacgttgtgcgagngcggctggcaacgtacactcgttaagtttaacggg

SEQ ID NO: 298236 - DNA, 682 bp, Homo sapiens
  misc_feature: GZ8MTXP01EGE7H.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggttttcctcgttgctctttaagaggtgtccagtgtcaggtgcacctggtggagtcgtgggggagcgtggtccagcctgggaggtccctgagactctcctgtgcagcctctggacttcaccttcagtagctttggctatcccacgtcgggtcccgccaggcctccgaggcgaagggggtctaaggaggtggggtgactaggttatagtcaattatcggaagtaggggaaaggttaaaaattattaaagtttaagtcgggaaagtaaaccgttcccgggtaggaaacgggggtccctaatttacccaccctaatcctaccaaggaacgaaactaaacgttacccaaaaggaaaccaacgagttaggaattacctaggggaacgtaaaacgtaacgaaacgaacgaccgtacggaaggacggacggtacggggaccggacggtcgtgttagttagttacgttgtacggtacggacggacggacggtaacgtacggaaccgtaactaccgttaccgtaaccgttaacggtttaacggg

SEQ ID NO: 298237 - DNA, 565 bp, Homo sapiens
  misc_feature: GZ8MTXP01EKHIC.19.26.C04.1.454.CMB.2.raw
  modified_base (298)..(298): a, c, t, g, unknown or other
  misc_feature (298)..(298): n is a, c, g, or t
  modified_base (363)..(363): a, c, t, g, unknown or other
  misc_feature (363)..(363): n is a, c, g, or t
  modified_base (371)..(371): a, c, t, g, unknown or other
  misc_feature (371)..(371): n is a, c, g, or t
  modified_base (497)..(497): a, c, t, g, unknown or other
  misc_feature (497)..(497): n is a, c, g, or t
tcagtactctcgtgcacgaccggtgctcgatttagtctagcgactttgggtttggggagaggagcccagcactagaagtcggcggtgtttccattcggtgatcagcactgaacacaggggactcaccatggagtttgggctgagctgggttttcctcgttgctcttttaagaggtgtccagtgtcaggtgcacctggtggagtcgtgggggaggcgtggtccagcctgggagtccctgagactctcctgtgcagcctctggattcaccttcagtagcttggcattccacgtgggtccnccaggctccgaggcaagggggctagagtgggtgctagttatatcatagtgataggaagtaaaatntattaagnggaagtacgtccggtagaacggggtcctattcactatctaccagacgaacaattaccaaagaacacgagtagatactagactaaatcgaaacacgcctagaggagcggtcggggactaggctggtnttagttagtggttgacgagaggcggacgtggacaacgtacacgttacctaaggtttcgggttaacggg

SEQ ID NO: 298238 - DNA, 574 bp, Homo sapiens
  misc_feature: GZ8MTXP01EMJID.19.26.C04.1.454.CMB.2.raw
  modified_base (276)..(276): a, c, t, g, unknown or other
  misc_feature (276)..(276): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (368)..(368): a, c, t, g, unknown or other
  misc_feature (368)..(368): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaccgtggtggagtcgtgggggagcgtggtccaggcctggggaggtccctgagactctcctgtgcagcctctggacttcaccttnagtgcttggcatccacgtgggtcccncaggcctccgaggcgaagggggctaggaggtgggtgctagttanatcatatgataggaagtaaatntaattagngganactcgtagaacgggctattcacatctacagagacaactcaaagacacagtgatactaggacaaagtacgaacgagccgtaggagacggtcgtagggggaacacgggtcgttggttacgttattacgttggtcgaccggaggcggaccggcgtacggaaccaactaccgttacttccgttaagtttaaccggggg

SEQ ID NO: 298239 - DNA, 661 bp, Homo sapiens
  misc_feature: GZ8MTXP01D7DBH.19.26.C04.1.454.CMB.2.raw
  modified_base (607)..(607): a, c, t, g, unknown or other
  misc_feature (607)..(607): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggacttcaccttcagtacgcttcggtcactaccaccgtcggggtcccggccccgacggaccgtcccgacggacggaacgggggacggtagagggtgggggtgggtaccgtaggttaattatactagtaagtagtaagtaggtaaagggtaaaaattaaagttaattaagttgggaacgtaacgtaccgtacggtaaggggaccggtacttactacccacgtactacccagaagtaacaaacttacctaaacgaacaaccgagtagtacgtacttaggacgaaatacgaacgaaacgccgtagaaggaacggcggtacgggacgtaacggcgtgtgttagtacgttaggnggacgaggcgccggtgcgaacgtaactacgttacgtaacgttaacggttaacgg

SEQ ID NO: 298240 - DNA, 556 bp, Homo sapiens
  misc_feature: GZ8MTXP01ALBPA.19.26.C04.1.454.CMB.2.raw
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
  modified_base (529)..(529): a, c, t, g, unknown or other
  misc_feature (529)..(529): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaaggtaaaatatattatggagactccgtgaagggccgattcaccatctccagagacaattccaaagaacacagtggatctgacaaatgaaacagccctgaagagcgtgggggacacgggctgtntattactgtgcgagagcggntggcaactacatcctatttacgggggttggacgtcgtcggggaccaagggaccacgggtcatccgtcctccccagccctccaccgaacgggcccagtccggttcccttccccgttggcccnccctcgcctccacggaacgcaaccccg

SEQ ID NO: 298241 - DNA, 563 bp, Homo sapiens
  misc_feature: GZ8MTXP01AC7NG.19.26.C04.1.454.CMB.2.raw
  modified_base (361)..(361): a, c, t, g, unknown or other
  misc_feature (361)..(361): n is a, c, g, or t
  modified_base (368)..(368): a, c, t, g, unknown or other
  misc_feature (368)..(368): n is a, c, g, or t
  modified_base (484)..(484): a, c, t, g, unknown or other
  misc_feature (484)..(484): n is a, c, g, or t
  modified_base (501)..(501): a, c, t, g, unknown or other
  misc_feature (501)..(501): n is a, c, g, or t
  modified_base (537)..(537): a, c, t, g, unknown or other
  misc_feature (537)..(537): n is a, c, g, or t
  modified_base (549)..(549): a, c, t, g, unknown or other
  misc_feature (549)..(549): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatccacgtcgggtcccgcaggctccgaggcaaggggctagaggtgggtggcagttatatcatatgatggaagtaaatntaattanggagactcggtagaagggcattcaccatctaccagagactaaacttaccaaagaacacagtacggattacgaggacaaagtcgaaacagtccgaggagagcggtgggacacgggtntaaggtgttagttacgngtacggcggaagcggcggctggaacctaacccgtanacgttaacccgngttttaaccggggg

SEQ ID NO: 298242 - DNA, 563 bp, Homo sapiens
  misc_feature: GZ8MTXP01C1W7Q.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggagtccctgagactctcctgtgcagcctctggattcaccttcagtagctttggcatccacgtgggtcccgccaggcctccgaggcgaagggggctaggaggtgggtgcagttatatcatatgataggaagtaaatattaattatggagtactccggtaggaacggggccgtattccacctatcctaccagacgaacaattaccaaagaacacagtggatctaggacaaatcgaacagcctaggagacgcgtggggacacggtctggtgttattacgttggtgcggagcggccggtctaggaacctaactacactccgttaagttttaaccgggg

SEQ ID NO: 298243 - DNA, 563 bp, Homo sapiens
  misc_feature: GZ8MTXP01DOU5O.19.26.C04.1.454.CMB.2.raw
  modified_base (266)..(266): a, c, t, g, unknown or other
  misc_feature (266)..(266): n is a, c, g, or t
  modified_base (295)..(295): a, c, t, g, unknown or other
  misc_feature (295)..(295): n is a, c, g, or t
  modified_base (363)..(363): a, c, t, g, unknown or other
  misc_feature (363)..(363): n is a, c, g, or t
  modified_base (407)..(407): a, c, t, g, unknown or other
  misc_feature (407)..(407): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcactggtggagtcgtgggggagcgtggtccagcctgggagtcctgagctctctgtgcagcctctggattcacttnagtagcttggctatccacgtcgggtcccncaggcctccgaggcgaagggggctaggaggtgggtgctagttatatcatatgagtaggaaagtaaatntaaattagtggatactcgtagaacgggctattcacatcacaganacaactacaagaacacagtagatactaggacaaatacgaacagcctaggagagcggtaggggactacggctggtacgttattacgttggtacggacgttaggcggccggtcgtacggaactaactacgttactaaccgttaacggtttaaccgggg

SEQ ID NO: 298244 - DNA, 580 bp, Homo sapiens
  misc_feature: GZ8MTXP01A2W3P.19.26.C04.1.454.CMB.2.raw
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (297)..(297): a, c, t, g, unknown or other
  misc_feature (297)..(297): n is a, c, g, or t
  modified_base (325)..(325): a, c, t, g, unknown or other
  misc_feature (325)..(325): n is a, c, g, or t
  modified_base (366)..(366): a, c, t, g, unknown or other
  misc_feature (366)..(366): n is a, c, g, or t
  modified_base (374)..(374): a, c, t, g, unknown or other
  misc_feature (374)..(374): n is a, c, g, or t
  modified_base (402)..(402): a, c, t, g, unknown or other
  misc_feature (402)..(402): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (419)..(419): a, c, t, g, unknown or other
  misc_feature (419)..(419): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcactggtggagtcgtgggggagcgtggtccagccgtgggagtccctgagactctcctgtgcagcctntgattccacttnagtncttggcatccagtcgggtcccncaggcctccgaggcgaagggggctaggnggtggggtgctagttatatcatatgatagggaaagtaaatntaattagnggatacgtcgagacggcctatcacatcncananactaataccaanaacacagagactctaggaactaaagtacgaacgacgaccgtagaggacggcggtagggggactacgggtcgtggttagttacgttacgttggtacggacggttaggcggcgggtcgtaggaacctaacgtacttacgttcccgttaaggttttaaccgggg

SEQ ID NO: 298245 - DNA, 553 bp, Homo sapiens
  misc_feature: GZ8MTXP01EKCBG.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaaatatattatggagactcgtgaagggccgattcaccatctccagagacaattcccaagaacacagtggatctgacaaatgaacagccctgaagagcgtaggggacacgggctgtgtattacgtgtgcgagagcggctggacaactacataccagtttaggggttggacgtcgtgggggaccaagggaccgacggtcacgttccgtcctccccagccctccgaccgaacgggcccatccggttccttccccttgggccgccctgcctccgaggcgccgaacccg

SEQ ID NO: 298246 - DNA, 631 bp, Homo sapiens
  misc_feature: GZ8MTXP01DQLE8.19.26.C04.1.454.CMB.2.raw
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
  modified_base (594)..(594): a, c, t, g, unknown or other
  misc_feature (594)..(594): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacttcgggtccaccagctccaggcaaggggctaggagtgggtgctagttatatcatatgatggaaggtaaaatatattanggagactcgtgaaggcgattcacatcnccagagacaatccaaagaacacagtggatctagacaaatagaacagccctagaagtaggccgtacgggggactaacggggtctgttagttagttacgtggtaggcggagacgtcgggcttgggaccaaacgtacaacttccgtaagtttacggggggtttggtaaccggtcggtacgggggaccgaaacgggaccctacgggtcacgttccgtccctccccacggccctcccgaacccgaacggggccctacgttcccggttcccgttcccccgcgggtcccnccccgttgcccgtaccgacgggccgcccgaaccccgg

SEQ ID NO: 298247 - DNA, 568 bp, Homo sapiens
  misc_feature: GZ8MTXP01EFN9Q.19.26.C04.1.454.CMB.2.raw
  modified_base (270)..(270): a, c, t, g, unknown or other
  misc_feature (270)..(270): n is a, c, g, or t
  modified_base (298)..(298): a, c, t, g, unknown or other
  misc_feature (298)..(298): n is a, c, g, or t
  modified_base (369)..(369): a, c, t, g, unknown or other
  misc_feature (369)..(369): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggagcgtggtccagcctgggagtccctgagactctcctgtgcagcctctggattcacttnagtagcttggcatccacgtcgggtcccnccaggctccgaggcgaagggggctaggaggtgggtggctagttatatcatagtgagtaggaagtaaaattntaaattacgtggatacgtccggtaggaacgggccgtattccactatctacagagaactaataccaaagaacacgagtagatactaacgaaatagaaacacgacctagagaggacgtaggggacacggtctgtgtattacgtgttgacggagacggcggcgtaaggacaactacacttaccgtaagtttaacgggttcgg

SEQ ID NO: 298248 - DNA, 702 bp, Homo sapiens
  misc_feature: GZ8MTXP01DJZ1L.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccaggcctggggaggtccctgagactctcctgtgcagcctctggattcaccttcagtagctttggcatccacgtgggtcccgccaggcctccgaggcaagggggcttaggaggtgggtgctagttatatcatagtgatagggaaggttaaaatattaaattagtgggaagaccttcccgggtaggaaacgggggccctaagtttccaaccctaatccctacccaaggtaacgaaacctaaaactttacccgaaaagaaaccaacgaagtagggtaacttcccgttagggaactaaaagtacgaaaacgacgacccgtaggaggaacggtcggttacggggggacccaacggggtccttgggttaagtttaacgttaaccgttgggttcggaccgggttaagggacgggacccgggcgtttacgggaacccgtaaaacgttacccttacgtttaaccccgttaaggttttttaaacccggggg

SEQ ID NO: 298249 - DNA, 744 bp, Homo sapiens
  misc_feature: GZ8MTXP01EKR6M.19.26.C04.1.454.CMB.2.raw
  modified_base (218)..(218): a, c, t, g, unknown or other
  misc_feature (218)..(218): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatcccacgtggggtccnccaggctccgagggcgaagggggctaggaggtggggtgctagttanatcatatgatggaaggtaaaatntatatggagactcgtgaaggccattcacatctaccagagactaatacccaaagaacacagtggatctacgacaaaatgaaacacgaccctaggaaggacggcggtacgggggaaccacgggtactggttagttaacgtttacgtggtggacggtaaggaggtgggtcgtacgggactaaactaccgattacccgttaaaggttttaccggggggtttaggaaccggtttcggtacggggggtaacccgaaacgggggtaccccgtaacggggttacctaacggttccccgttccccgtacccccgaacggtcccccttaaccccggaaacccgggtaaccgggggttccccctaaagggtttcccccgggttcccccgtttcccccccggttggggcccccgttccccgttccggcccgttacccccggaaggggttaaccccgccccggtaacccg

SEQ ID NO: 298250 - DNA, 697 bp, Homo sapiens
  misc_feature: GZ8MTXP01AWOBO.19.26.C04.1.454.CMB.2.raw
  modified_base (278)..(278): a, c, t, g, unknown or other
  misc_feature (278)..(278): n is a, c, g, or t
  modified_base (311)..(311): a, c, t, g, unknown or other
  misc_feature (311)..(311): n is a, c, g, or t
  modified_base (347)..(347): a, c, t, g, unknown or other
  misc_feature (347)..(347): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactggtccaccaggctccaggcaagggctagagtgggtgcagttatatcatatgatggaagtaaatatattanggagactcggtgaaggccattcacatctcaganacatcaaagaacacagtgatctagacaaatgaaacngacctagaagagcggtaggggacacgggtctgttagttattacgtggtacggacggaaggaggccgggactacgggaacctaaaccgttactaacgttacccgttaacggttttacggggggtttacggggtaccggttacgggttaccgggggaacccgtaaacgggggtacccgtacggggttaccaaccgttcccggttacccctcccccgtacgtccccctacccgaaacccggaacccggggttcccctaacggttccccgggttcccccgttcccccggttcggggtccccctccccgttcggaccccgtacccggaaggggtccccaacccgtaacccccggg

SEQ ID NO: 298251 - DNA, 571 bp, Homo sapiens
  misc_feature: GZ8MTXP01BQ99H.19.26.C04.1.454.CMB.2.raw
  modified_base (346)..(346): a, c, t, g, unknown or other
  misc_feature (346)..(346): n is a, c, g, or t
  modified_base (373)..(373): a, c, t, g, unknown or other
  misc_feature (373)..(373): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtggggggagcgtggtccagcctgggagtccctgagctctctgtgcagcctctggattcacttcagtagctttggctatcccacgtcgggtcccgccaggcctccgaggcaagggggctaaggaggtggggtgctagttanatcattagtgatagggaaagtaaaatnttaaattagtggagacgtcgtagaacgggcattcacatcacagagacaattaccaagaacacgagtgactcgtggaactaaagtagaacacgccgtggaaggacggcgtagggggacacgggtcgtggttgttattacgttggtgcggagcggcggtctaggctaaactacgttactaaccgttaagtttaaccgggg

SEQ ID NO: 298252 - DNA, 642 bp, Homo sapiens
  misc_feature: GZ8MTXP01B2BC4.19.26.C04.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggagtccctgagactctcctgtgcagcctctggacttcaccttnagtagctttggcatcccacgtcgggtcccncaggcctccgaggcgaagggggctaggaggtggggtgctagttatatcatagtgaagtagggtaaagtaaaatataaattacgngggaatacgtccggtaggaacgggcctaatcccacctatcctaccgagaacgaactaaacttaccaaacgtaacacgtagtacggaataccgtagggaactaaaagtacgaaacacggacccgtaggacggacggcggtagggggaccgtacgggtcgttggtagttacgttacgttggtacggcggaggacgggccgggtaacgtcggaacctaaacgtaccgttaacgttaacccgttaaggttttaaccgggg

SEQ ID NO: 298253 - DNA, 606 bp, Homo sapiens
  misc_feature: GZ8MTXP01BYBFE.19.26.C04.1.454.CMB.2.raw
  modified_base (215)..(215): a, c, t, g, unknown or other
  misc_feature (215)..(215): n is a, c, g, or t
  modified_base (256)..(256): a, c, t, g, unknown or other
  misc_feature (256)..(256): n is a, c, g, or t
  modified_base (260)..(260): a, c, t, g, unknown or other
  misc_feature (260)..(260): n is a, c, g, or t
  modified_base (279)..(279): a, c, t, g, unknown or other
  misc_feature (279)..(279): n is a, c, g, or t
  modified_base (583)..(583): a, c, t, g, unknown or other
  misc_feature (583)..(583): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactgggtccnccaggctccaggcaaggggctagagtgggtgcagttatatnatangatggaagtaaatatatanggagactcggtagaacgggcctattaccaccatctaccgagagaactattacccaaagaaacacgagtgatctacgacaaatgaaacagacctagaagagacgtaggggaccacgggtctgtgttattacgtggtgacgagaggcggcgtaggacaactacgactcgtagtttacgggggttggacgttcggacggggaccgaacgggaccgacgtcacgtccgtcctccccgcgcccctaccgaacccgaacggccctaacgttccggttccccttccccgttcggccccgtcccgtcggccncggacggtaacgcccgtaacccg

SEQ ID NO: 298254 - DNA, 696 bp, Homo sapiens
  misc_feature: GZ8MTXP01A3L86.19.26.C04.1.454.CMB.2.raw
  modified_base (254)..(254): a, c, t, g, unknown or other
  misc_feature (254)..(254): n is a, c, g, or t
  modified_base (261)..(261): a, c, t, g, unknown or other
  misc_feature (261)..(261): n is a, c, g, or t
  modified_base (272)..(272): a, c, t, g, unknown or other
  misc_feature (272)..(272): n is a, c, g, or t
  modified_base (301)..(301): a, c, t, g, unknown or other
  misc_feature (301)..(301): n is a, c, g, or t
  modified_base (354)..(354): a, c, t, g, unknown or other
  misc_feature (354)..(354): n is a, c, g, or t
  modified_base (383)..(383): a, c, t, g, unknown or other
  misc_feature (383)..(383): n is a, c, g, or t
  modified_base (393)..(393): a, c, t, g, unknown or other
  misc_feature (393)..(393): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggacgtccctgagactctcctgtncagcctntgattcacttnagtgcttggctactccacgtcgggtcccncgacggcctaccgaggcgaaagggggctaggacggttggggtgctaagtttanatcatagtcgatagggtaaagtaaaattntaaagttagngggaacgtaccgtccggtaggaacggggtcctaacgttcccacctatccgtaccgagaacgtaactaaacttaccgaaagtaaccgaacgtacggttaggtaacttacgtaacgggtaaactaaaagttaccgaaacgacggtcccgtaagggaaggtaccgggtacggtaacgggggaaccgtacgggtcgtttaaggttaagttacggttacgttcggtacggtaacggagggttacggccggtaacgtacggtaacccgtaacgtaccgttacgttaaccgttaaggttttaacccgggg

SEQ ID NO: 298255 - DNA, 644 bp, Homo sapiens
  misc_feature: GZ8MTXP01DO76O.19.26.C04.1.454.CMB.2.raw
  modified_base (273)..(273): a, c, t, g, unknown or other
  misc_feature (273)..(273): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (370)..(370): a, c, t, g, unknown or other
  misc_feature (370)..(370): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggacgtccctgagactctcctgtgcagcctctgacttcacttnagtagcttggcatccacgtcgggtcccncaggctccgaggcgaagggggctaggaggtgggtgactagttanatcatatgagtaggaaagtaaaatntaattagtgggatacgtccggtaggaacggggtcctaattccacctatcctaccaagaacgaactaaacttaccaaagaaccaacgagtaggaacttaccgtagggaactaaaagtacgaaaccacggacccgtaggaaggaacgggtccggtagggggaacccgtacgggtccgttggttaagttacgtttacgttgggtaggaccgggaggcgggccgggtcgtacgggaacctaacgtacgttacttaacccgttaaggttttaaccgggg

SEQ ID NO: 298256 - DNA, 582 bp, Homo sapiens
  misc_feature: GZ8MTXP01DT9UA.19.26.C04.1.454.CMB.2.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (528)..(528): a, c, t, g, unknown or other
  misc_feature (528)..(528): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagcctgggagtccctgagactctcctgtgcagcctctggattcaccttnagtagctttggctatccacgtcgggtcccnccaggcctccgaggcgaagggggctaggnggtgggtgctagttanatnatatgataggaagtaaatntaattagtgganactccggtagaacgggcctattccactatctacagagacaataccaaagaacacagtagatctaggacaaagtgaaactagcctagaggtaacgcggtaggggacacgggtcttggttagttacttacgttggtacggacggaaggnggccgggctacggaacctaaacgtacacgttaaccgttaaggttttaaccgggg

SEQ ID NO: 298257 - DNA, 674 bp, Homo sapiens
  misc_feature: GZ8MTXP01BTMWT.19.26.C04.1.454.CMB.2.raw
  modified_base (265)..(265): a, c, t, g, unknown or other
  misc_feature (265)..(265): n is a, c, g, or t
  modified_base (311)..(311): a, c, t, g, unknown or other
  misc_feature (311)..(311): n is a, c, g, or t
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgtttgcttcttttaagaggtgtccagtgtcaggtgcaccgtggtggagtcgtgggggagcgtggtccaggccgtgggagtccctgacgactctcctgtgcagcctntgattccaccttcagtagctttggctacgtcccacgtcgggtcccnccgaggcctaccgaggacgaagggggctaggaggtgggtgactagttatatntatagtagagtaggaaagttaaaatnttaaacgttagnggaacgtaccgttccgggtaggaacgggtctaacttccacctatcctacgaagaacgaactaaacgttaaccaaacgtaacgaacgtaggtacggtaacttacgtaacgggaactaaagtaacgaaacgacgtaccgtaggaacggacggcggtacgggggaccgtacgggtcgtggttacgttagtttacgttggtacggacggacggttggaccggtcgtacgggaacctaaccgtacgttaccgttaacccgttaaggttttaaccgggg

SEQ ID NO: 298258 - DNA, 702 bp, Homo sapiens
  misc_feature: GZ8MTXP01B6TA7.19.26.C04.1.454.CMB.2.raw
  modified_base (407)..(407): a, c, t, g, unknown or other
  misc_feature (407)..(407): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcggtgggggagcgtggtccagccgtgggacgtcctgacgtactctccgtgtgcagcctgtgacttccacttcagtacgtcgttggctactccgtacggtccgggtcccgccgaggcctaccggaggacggaacggggctaaggtagggtggggtggactaggtttatacgtacagttagtagtagtaggggtaaattaaaatnttaaagttaagtggaacgtaccgtacgggtagggaaccgggtcctataccctactacttaccgacgaagaacgtaactaaaccgttaaccgaaacgaaaccaacgaagtggtaactaccgtaggggtaaactaaagtacgaaacgacgtccgtaggaaggtacggcgggtaacggggacccgtacggtcgttggttaagttacgttccggttaggtcggacggagggaccggttcggaacgttacggaacctaacctacgttaccgttaaccgtttaacgggttttaacccgggg

SEQ ID NO: 298259 - DNA, 582 bp, Homo sapiens
  misc_feature: GZ8MTXP01AXZIE.19.26.C04.1.454.CMB.2.raw
  modified_base (215)..(215): a, c, t, g, unknown or other
  misc_feature (215)..(215): n is a, c, g, or t
  modified_base (279)..(279): a, c, t, g, unknown or other
  misc_feature (279)..(279): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccnccaggctccgaggcgaaggggctaggagtgggtgcagttatatcatatgatggaagtaaaatanatatggagactccgtgaaggccattcaccatctccagagacaattccaaagaacacagtgatctagacaaatgaaacagccctagaagagcgtaggggacacgggctgtagtattacgtggtagcgagaggcggctggacaactacatacctagttacggggttggacgtcgtacggggaccaaggggaccacgggtcacgtccgtcctccccagtccctaccgaccgaacgggccctacgtcccggttcccgttcccccgttgggcccctcccgtcgcccgtccgaggtaaccgccgaaccg

SEQ ID NO: 298260 - DNA, 521 bp, Homo sapiens
  misc_feature: GZ8MTXP01DNHF0.19.26.C04.1.454.CMB.2.raw
  modified_base (301)..(301): a, c, t, g, unknown or other
  misc_feature (301)..(301): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
  modified_base (376)..(376): a, c, t, g, unknown or other
  misc_feature (376)..(376): n is a, c, g, or t
  modified_base (403)..(403): a, c, t, g, unknown or other
  misc_feature (403)..(403): n is a, c, g, or t
  modified_base (490)..(490): a, c, t, g, unknown or other
  misc_feature (490)..(490): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggaggcgtggtccaggcctgggagtccctgagactctcctgtgcagcctctggattcaccttcagtagctttggcatccacgtgggtcccnccaggctccgaggcaagggggctaggagtggggtgcagttanatcatatgatggaagtaaaatntaattangganactcgtagaaggcatcacatctcaganaacaatacaagaacacagtgatctaggacaaatgaaacagacctgagagcgtgggacacggctgtgttatacttgtgcgagagcggntaggcaacgtacatccgttaagtttaacggg

SEQ ID NO: 298261 - DNA, 644 bp, Homo sapiens
  misc_feature: GZ8MTXP01ESDJP.19.26.C04.1.454.CMB.2.raw
  modified_base (241)..(241): a, c, t, g, unknown or other
  misc_feature (241)..(241): n is a, c, g, or t
  modified_base (269)..(269): a, c, t, g, unknown or other
  misc_feature (269)..(269): n is a, c, g, or t
  modified_base (296)..(296): a, c, t, g, unknown or other
  misc_feature (296)..(296): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcaccgtggtggagtcgtgggggagcgtgtccagccgtgggacgtcctganactctctgtgcagcctctgattcacttnagtagcttgcatccgagtcgggtcccncaggcctaccgaggacgaagggggctaagggaggtgggggtcggactaaggttatatctaaagtagtagagttaggggaaagttaaaaatgtaaaatttacgtgggtaactaccggttaccggtagggaaacgggtccgtattccaactattcaccgaagaacgaactaaattaccaaagaacacgagtagatacgtaggaactaaagtacgaaacgtagaccgagacggagcgggtacggggaactaccgggtgtaaggttgttaacgttacgttgggtaggacggagggcggcggtaacgacgaacctaacgtaccttacttaacccggttaagttttaaccgggg

SEQ ID NO: 298262 - DNA, 681 bp, Homo sapiens
  misc_feature: GZ8MTXP01DH300.19.26.C04.1.454.CMB.2.raw
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (374)..(374): a, c, t, g, unknown or other
  misc_feature (374)..(374): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtggggggagcgtggtccagccgtgggagtccctgagctctcctgtgcagcctntgacttccaccttnagtagcttggcatccagtcggcccncaggcctcgagcgaaggggctaggaggtgggtgactagtttanatacagttagtggaatagggaagtaaaattnttaaagttagtgggaataccgttaccgggtaagggaaacgggtcccgtattacccgaacctataccgtaccgaagtaacgaacctaaacgttaacccaaaagaaaccaacgtacggtaggtacttacgtaacggtaactaaaagttaccgaaacctacgacccgtaggaacggacggtccggtaacggggacgaaccgggtcgttaaggtagttacttaacggttggtacggacggaggacgggttccggtcgtaacgggtaacctaaacgtaccgttacgttaacccgttaacggtttaaccgggg

SEQ ID NO: 298263 - DNA, 550 bp, Homo sapiens
  misc_feature: GZ8MTXP01B1ULJ.19.26.C04.1.454.CMB.2.raw
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (257)..(257): a, c, t, g, unknown or other
  misc_feature (257)..(257): n is a, c, g, or t
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (381)..(381): a, c, t, g, unknown or other
  misc_feature (381)..(381): n is a, c, g, or t
  modified_base (391)..(391): a, c, t, g, unknown or other
  misc_feature (391)..(391): n is a, c, g, or t
  modified_base (395)..(395): a, c, t, g, unknown or other
  misc_feature (395)..(395): n is a, c, g, or t
  modified_base (399)..(399): a, c, t, g, unknown or other
  misc_feature (399)..(399): n is a, c, g, or t
  modified_base (413)..(413): a, c, t, g, unknown or other
  misc_feature (413)..(413): n is a, c, g, or t
  modified_base (480)..(480): a, c, t, g, unknown or other
  misc_feature (480)..(480): n is a, c, g, or t
  modified_base (531)..(531): a, c, t, g, unknown or other
  misc_feature (531)..(531): n is a, c, g, or t
  modified_base (538)..(538): a, c, t, g, unknown or other
  misc_feature (538)..(538): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtggggggaggcgtggtccagcctggggaggtccctgagactctcctgtgcagcctctggattcaccttnagtagctttggcatccacgtgggccnccaggcctcgaggcaaggggctagagtgggtgctagttanatcatatgatggaagtaaaatanatatggagactcgtagaaggcatcacatcncaganacaatccaaagaacacagtgatctgacaaaatgaaacagctagaagagacgtggggaacacgggtntgtatatagngagngagngcgctagacaacanactacgtaagttacggggttggacggtcggacgggaaccgaacggaccgacgtacacgtccgtaccncccacgaaccctacgaaccgacgcctacgtccgttcccgttcccgcgcccncctcgcncgacgcgcaacg

SEQ ID NO: 298264 - DNA, 626 bp, Homo sapiens
  misc_feature: GZ8MTXP01DUHZS.19.26.C04.1.454.CMB.2.raw
  modified_base (273)..(273): a, c, t, g, unknown or other
  misc_feature (273)..(273): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggaggcgtggtccagcctggggagtccctgagactctcctgtgcagcctctggattcaccttnagtagctttggctatcccacgtcgggtcccgccaggcctccgaggcgaagggggctaggaggtgggtgctagttanatcatatgataggaagtaaaatntaaattagtgggaataccgtcggtaggaacggggcctattccactatcctacgaagagaactaattaccaaagaacacagtgatcgtaggaactaaagtagaaacacgtaccgtaggaacggtacgggacggtacgggggaaccgtacgggtcgttggttagttaagtttacgttggtaggacggaaggcggccgggtaacgtacgggaacctaaaccgtacttacgttaacccgttaacggttttaaccgggg

SEQ ID NO: 298265 - DNA, 575 bp, Homo sapiens
  misc_feature: GZ8MTXP01AJJ4P.19.26.C04.1.454.CMB.2.raw
  modified_base (545)..(545): a, c, t, g, unknown or other
  misc_feature (545)..(545): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactggtccaccaggctccaggcaaggggctagagtgggtggcagttatatcatatgatggaggtaaaatatattatggagactccgtgaagggccgattcaccatctccagagacaattccaagaacacagtgatctgcaaatgaaacagcctgaagagcctggggacacggctgtgtattactgtgcgagagcggctggcaactacatacccatttaaccgggggtttggaaccgttcgtacgggggacccaaaggggaccctacgggtcaagtccggtcctcccccagccctaccacccaacggggccccaagtccggttccttcccccgttgggcccncccgtcggcctccgaggcgccgtaaccccg

SEQ ID NO: 298266 - DNA, 553 bp, Homo sapiens
  misc_feature: GZ8MTXP01AT953.19.26.C04.1.454.CMB.2.raw
  modified_base (263)..(263): a, c, t, g, unknown or other
  misc_feature (263)..(263): n is a, c, g, or t
  modified_base (276)..(276): a, c, t, g, unknown or other
  misc_feature (276)..(276): n is a, c, g, or t
  modified_base (284)..(284): a, c, t, g, unknown or other
  misc_feature (284)..(284): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (518)..(518): a, c, t, g, unknown or other
  misc_feature (518)..(518): n is a, c, g, or t
  modified_base (525)..(525): a, c, t, g, unknown or other
  misc_feature (525)..(525): n is a, c, g, or t
  modified_base (544)..(544): a, c, t, g, unknown or other
  misc_feature (544)..(544): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctggggaggtccctgagactctcctgtgcagcctctggattcaccttcagtagctttggcatccactgggtccaccgaggctccgaggcaaggggctaggagtgggtgcagttatatcatangatggagtaaatnatatgganactcgtgaaggccgatcacatctcagagacatccaagacacagtgatctagacaaatgaacngacctagngagcgtaggggacaggctgtntattactggtgcgagagcggactggacaacgtacatacctagttacggggtttggacgtcgtagggggaccaaggggaccacggtacagtccgtacctcccagccctacaccgaacgggccctaagtccggttccttccccgngggcccncccgtgcctccgagggtcnccgtaaccg

SEQ ID NO: 298267 - DNA, 640 bp, Homo sapiens
  misc_feature: GZ8MTXP01BJHPA.19.26.C04.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (377)..(377): a, c, t, g, unknown or other
  misc_feature (377)..(377): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtggggagcgtggtccagccgtgggacggtccctgagactctcctgtgcagcctctggacttcaccttcagtagctttggctatccacgtcgggtccnccgaggcctccgaggcaagggggctaggaggtgggtgctagttanatcatatggatagggtaaagtaaaattnttaaagttacgtggaacgtaccgttaccgggtaggaacggggtcctaagttaccaccgtatcctaccgagaacgtaactaaacttaccaaagtaaccgaacgtaagtaggtactcgtaggaacaaaagtacgaaaccgagcccgtaggaacggacgtacgggtacgggggaccgacgggtcgtaagttggttaacttacgttggcggacgagggcggcggccgtgggaaccaactacgttacttcgttaacggtttaacgggg

SEQ ID NO: 298268 - DNA, 664 bp, Homo sapiens
  misc_feature: GZ8MTXP01AZ4MC.19.26.C04.1.454.CMB.2.raw
  modified_base (306)..(306): a, c, t, g, unknown or other
  misc_feature (306)..(306): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggaggcgtggtccagccgtggggacgtccctgagactctcctgtgcagcctctggattcacttcagtagcttggctactccacgtcgggtcccnccgaggcctccgaggcgaagggggctaggacggtgggggtgactagttatatacgatagtcggaagtagggtaaaggttaaaatgttaaaattagtgggacgtaccgtccgggtaggaacggggtccgtattacccacctatcctaccgagaacactaacttaccaaagaacacagtagatcgtaggaacaaagtacgaaacgacgaccgtggaaacggacggtacgggtcgggggtaacgtacgggtcttaagggttacgttagtttacggttggtacggacgggacgggttaccggcgggtaacgtcggaacctaaacgtacgttaccgttaaccgttaacgggttttaaccgggg

SEQ ID NO: 298269 - DNA, 556 bp, Homo sapiens
  misc_feature: GZ8MTXP01A2Y0N.19.26.C04.1.454.CMB.2.raw
  modified_base (258)..(258): a, c, t, g, unknown or other
  misc_feature (258)..(258): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (380)..(380): a, c, t, g, unknown or other
  misc_feature (380)..(380): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
  modified_base (445)..(445): a, c, t, g, unknown or other
  misc_feature (445)..(445): n is a, c, g, or t
tcagtactctcgtgcacgaccggtgctcgatttagtctagcgactttgggtttggggagaggagcccagcactagaagtcggcggtgtttccattcggtgatcagcactgaacacaggggactcaccatggagtttgggctgagctgggttttcctcgttgctcttttaagaggtgtccagtgtcaggtgcacctggtggagtcgtgggggaggcgtggtccagcctgggagtccctgagactctcctgtgcagcctntggacttcaccttcagtagcttggctatccacgtgggtcccgccaggcctccgagggcaagggggctaggaggtggggtgctagtttatatcatagtgatagggagtaaatntattaanggnctcgtgaaggcctatcacntcncagagacaataccaaagacacagtgatctagacaaatgaaacngccgtagagaggacggtggggaccacgggtctaggtcgttaattacgtggttcgacggaggaggcggcgttggactaactactacttaccgtaacgtttcggggttaacgg

SEQ ID NO: 298270 - DNA, 622 bp, Homo sapiens
  misc_feature: GZ8MTXP01DOXM6.19.26.C04.1.454.CMB.2.raw
  modified_base (264)..(264): a, c, t, g, unknown or other
  misc_feature (264)..(264): n is a, c, g, or t
  modified_base (275)..(275): a, c, t, g, unknown or other
  misc_feature (275)..(275): n is a, c, g, or t
  modified_base (279)..(279): a, c, t, g, unknown or other
  misc_feature (279)..(279): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (373)..(373): a, c, t, g, unknown or other
  misc_feature (373)..(373): n is a, c, g, or t
  modified_base (385)..(385): a, c, t, g, unknown or other
  misc_feature (385)..(385): n is a, c, g, or t
  modified_base (580)..(580): a, c, t, g, unknown or other
  misc_feature (580)..(580): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggagcgtggtccaggccgtgggaggtccctgacgactctcctgtgcagcctntgattcacttnagtncttggcatccatgggtccccncaggctccaggcgaaggggctaggaggtgggtgactagtttanatcaatatggaatagggtaaagtaaaattnttaaatttacgnggaagaccttcccgggtagggaaacgggtcccgtaatttacccaaccacttaccacccgaagaaacgaacctaaattaacccaaagaaacccaagagtaggaatctacggaacaaagtagaaacagccgtagacggaacggcgtcggggaccgacgggtctggtagttattacgttgtggacggagcggcgggtntcggaactaactacacttaaccgttaacggttttaaccgggg

SEQ ID NO: 298271 - DNA, 753 bp, Homo sapiens
  misc_feature: GZ8MTXP01A2TCX.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggagcgtggtccagccgtgggacgtccctgagctctcctgtcgcacgtcctcgtggacttccaccttgagtacgtcgtttggctactcccacggttcggggtccccgaccgaagggtcctacccggaaggggaccggaaaaggggggtcctaagggtaggggttgggggtcggactaaggtttatatacaattagtggaagtaggggaaaagttaaaaatagttaaagttagtcgggaagtacccttaccgggtaggaaaccggggcctaattacccaaccctatacctaccgaaggaacgaaactaaacttacccgaaaagaaaccaacgtaggtaggactacgtacgggaactaaaatacgaaacgacgtcccgtaggaggtaacggccggtaacgggggaaccgaacccggggtcgtttaagggtaacggttttaacttaaccggttgggtcccggggaacgggttagggacgggacccgggtcgtacgggaaccctaaaaccgtacttacttaaccccgttaaggttttaacccggggg

SEQ ID NO: 298272 - DNA, 566 bp, Homo sapiens
  misc_feature: GZ8MTXP01ANMVA.19.26.C04.1.454.CMB.2.raw
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (369)..(369): a, c, t, g, unknown or other
  misc_feature (369)..(369): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctgattcaccttcagtagctttggcatcccacgtcgggtcccncaggcctccgaggcgaaggggctaggaggtgggtgctagttanatcatagtgagtaggaaggtaaaatntaaattagtgggatacgtccggtaggaacggggcccaattcccacctatcctaccagacgaactaattaccaaagaacacgagtaggatcgtaggacaaagtgaaacagccgtgagagcgtggggacacggctgtgttattacgttgtggcggagcggcggcgtggaaccaactacactccgttaaggtttaacggg

SEQ ID NO: 298273 - DNA, 656 bp, Homo sapiens
  misc_feature: GZ8MTXP01CNU06.19.26.C04.1.454.CMB.2.raw
  modified_base (417)..(417): a, c, t, g, unknown or other
  misc_feature (417)..(417): n is a, c, g, or t
  modified_base (546)..(546): a, c, t, g, unknown or other
  misc_feature (546)..(546): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctgagactctcctgtgcagcctctggattcaccttcagtagctttggcatcccacgtggggtcccgccaggctccgaggcgaaggggctaggaggtgggtggctagttatatcatatgataggaagtaaaatatatagtggagactcggtagaaggccattcaccatctacagagacaattaccaaagaacacgagtgatctacgacaaatgaaacacgacctagaagaggcgtaggggacacggtctagtacgttattacgnggtgcggaaggcggcggctacggactaaactactaacgtacctaaggtttaccgggggtttggaccggttcggtacgggggaacccgaaacggggacccgagggttccacgttcccgaccctcccccgngtcccctaacccgaccggtaaccgggcccctaacggttcccggttccccgttccccggttcggccccgtccccgtcgcccgtaccggaacgggtcccgccgtaaccccgg

SEQ ID NO: 298274 - DNA, 657 bp, Homo sapiens
  misc_feature: GZ8MTXP01BGAOG.19.26.C04.1.454.CMB.2.raw
  modified_base (310)..(310): a, c, t, g, unknown or other
  misc_feature (310)..(310): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggaggcgtggtccaggccgtgggacgtccctgagactctcctgtgcagcctctggacttccaccttcagtagctttggctactccacgtcgggtcccnccaggcctccgaggcgaagggggtctaaggaggtggggtgactagttatatcaattagtagagttaggggaaagttaaaatgttaaattaacgtggaacgtaccgtccgggtagggaacgggtcctattacccaacctactacctaccgaagaacgaactaaacttaccaaagaacacgagtagaactcgtaggaactaaagtacgaaacgacgacccgtaggaacggacggtcggtacggggaacctacgggtgtaaggttacgttagttacgttggtaggacggacggcggcggtaacgtcggaacctaactacgttacgttaacccgttaaggttttaaccggg

SEQ ID NO: 298275 - DNA, 682 bp, Homo sapiens
  misc_feature: GZ8MTXP01ERCGL.19.26.C04.1.454.CMB.2.raw
  modified_base (288)..(288): a, c, t, g, unknown or other
  misc_feature (288)..(288): n is a, c, g, or t
  modified_base (292)..(292): a, c, t, g, unknown or other
  misc_feature (292)..(292): n is a, c, g, or t
  modified_base (296)..(296): a, c, t, g, unknown or other
  misc_feature (296)..(296): n is a, c, g, or t
  modified_base (302)..(302): a, c, t, g, unknown or other
  misc_feature (302)..(302): n is a, c, g, or t
  modified_base (313)..(313): a, c, t, g, unknown or other
  misc_feature (313)..(313): n is a, c, g, or t
  modified_base (316)..(316): a, c, t, g, unknown or other
  misc_feature (316)..(316): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctgagactctcctgtgcagcctctggattcaccttcagtagcttttggcatcccacgtcggggtccgccagggcctccgaggcgaagggggctaggaggtgggtgctagttatatcatatgatggaagtaaatnatangganactcgngaggcatcacntcncaganacaataccaagaacanagtgatctacgacaaatgaaacngacctagaagagcgtaggggacacgggtctgtgttactacgtggtcgacgaggacgcgggtcgtaggaaccaaactacgtaacgttaccgttaacggttttacggggggtttacggacccggggttacggtacggggggaacccgaaaacgggggtcccgtaaccgggttccgtaaccgttccccgtaccccgtccccgacccgtccccgaaaccccgaaccgggtaaccccgttccgtaacccggttccccgtttccccggcccggttcccggaacccctccggtcccgtccgacggaccggtaaccgccccgtaacccgg

SEQ ID NO: 298276 - DNA, 538 bp, Homo sapiens
  misc_feature: GZ8MTXP01ATZQS.19.26.C04.1.454.CMB.2.raw
  modified_base (214)..(214): a, c, t, g, unknown or other
  misc_feature (214)..(214): n is a, c, g, or t
  modified_base (283)..(283): a, c, t, g, unknown or other
  misc_feature (283)..(283): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
  modified_base (515)..(515): a, c, t, g, unknown or other
  misc_feature (515)..(515): n is a, c, g, or t
  modified_base (519)..(519): a, c, t, g, unknown or other
  misc_feature (519)..(519): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccgaggcgaaggggctaggaggtgggtggcagttatatcatatgatggagtaaaatatatanggagactcgtgaggcattcacatctcagagacaattccaaagaacacagtagatcgtgacaaagtgaaacngacctgaagagcgtaggggacacggctgtagtatacgtgtgcgagagcggctggacaactnactctagttacggggttggacgtcgtacggggaccaagggccaacggtcacgtccgtcctcccgagccctacgaccgacggccagtccgttccttcccgngccncctgctcgagtcgcaaccg

SEQ ID NO: 298277 - DNA, 659 bp, Homo sapiens
  misc_feature: GZ8MTXP01BPVRG.19.26.C04.1.454.CMB.2.raw
  modified_base (271)..(271): a, c, t, g, unknown or other
  misc_feature (271)..(271): n is a, c, g, or t
  modified_base (374)..(374): a, c, t, g, unknown or other
  misc_feature (374)..(374): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggagtccctgagactctcctgtgcagcctctggattcaccttnagtagctttggcatccacgtcgggtcccgccaggcctccgaggcgaagggggctaaggaggtggggtgctagttatatcatatgagtagggaaagttaaaatntaaattagtgggaagtaccgtccggtaggaaacggggtccctaatttcccaacctatcctaccaagaacgaacctaaacttacccaaaagaaaccaacgaaggtaggtaattaccgtagggaactaaaagtacgaaacgacgccgtaggaaggaacggcggtagggggaaccacgggtcttaaggttagttacgtttacgttggttacggaccggaaggacggccgggtaactcgggaacctaaaacgtaccttacgttaaccccgttaaggtttttaaccgggg

SEQ ID NO: 298278 - DNA, 559 bp, Homo sapiens
  misc_feature: GZ8MTXP01CIFRK.19.26.C04.1.454.CMB.2.raw
  modified_base (407)..(407): a, c, t, g, unknown or other
  misc_feature (407)..(407): n is a, c, g, or t
  modified_base (477)..(477): a, c, t, g, unknown or other
  misc_feature (477)..(477): n is a, c, g, or t
  modified_base (519)..(519): a, c, t, g, unknown or other
  misc_feature (519)..(519): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaggtaaaatatatatggagactcgtgaagggccattcaccatctccaagagacaattcccaaagaacacagtggatctagacaaatgaaacagaccctagaagagcgtggggacacgggctgtgtattactgtgcgagagcgntggcaactacatccagtttacgggggttggacgtcgtggggaccaagggcccaggtcatccggtctcccngccctcaccgaacgggcccctagtcccggttcctttccccgnggcccgccccttggaccctccgacgggcgcccgtaacccg

SEQ ID NO: 298279 - DNA, 570 bp, Homo sapiens
  misc_feature: GZ8MTXP01DMVG6.19.26.C04.1.454.CMB.2.raw
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtcaaccaggctccaggcaaggggctagagtgggtgcagttatatcatatgatggaggtaaaatatatatggagactcgtgaaggcatcaccatcnccaganacaattccaaagaacacagtggatctgacaaaatgaaacagcctagaagagctagaggacacgggctagtgttattacgtgtgcgaggacggtatagcagcgtcggttccgggtttgacggtacggtggggaccgacgggtaacccgtcggtcaccggttcctccgtcacgccctccaaccgaacgggcccacgttccgtcccttccccgttcggcccaccccttcccaccaacgcgccaccgtcggttcgggggaacc

SEQ ID NO: 298280 - DNA, 568 bp, Homo sapiens
  misc_feature: GZ8MTXP01DOXAP.19.26.C04.1.454.CMB.2.raw
  modified_base (271)..(271): a, c, t, g, unknown or other
  misc_feature (271)..(271): n is a, c, g, or t
  modified_base (373)..(373): a, c, t, g, unknown or other
  misc_feature (373)..(373): n is a, c, g, or t
  modified_base (381)..(381): a, c, t, g, unknown or other
  misc_feature (381)..(381): n is a, c, g, or t
  modified_base (386)..(386): a, c, t, g, unknown or other
  misc_feature (386)..(386): n is a, c, g, or t
  modified_base (461)..(461): a, c, t, g, unknown or other
  misc_feature (461)..(461): n is a, c, g, or t
  modified_base (526)..(526): a, c, t, g, unknown or other
  misc_feature (526)..(526): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggagcgtggtccagcctgggagtccctgagactctcctgtgcagcctctggattcaccttnagtagctttggcatcccacgtgggtcccgccaggcctccgaggcgaagggggctaaggaggtgggggtggctaggttatatcatatgataggaagtaaaatntaaattanggtanctccgtagagggcgtatcacatctcagagaactaattaccaagaacacagtaggatctaggacaaatagaaacgngcctgagaagcgtaggggactacgggctggttgttaagttcttggtcgcggttaggaggccgggngtcgggcaactacacgttaacccgttaaggtttttaaccggg

SEQ ID NO: 298281 - DNA, 602 bp, Homo sapiens
  misc_feature: GZ8MTXP01ALUXW.19.26.C04.1.454.CMB.2.raw
  modified_base (311)..(311): a, c, t, g, unknown or other
  misc_feature (311)..(311): n is a, c, g, or t
  modified_base (336)..(336): a, c, t, g, unknown or other
  misc_feature (336)..(336): n is a, c, g, or t
  modified_base (342)..(342): a, c, t, g, unknown or other
  misc_feature (342)..(342): n is a, c, g, or t
  modified_base (344)..(344): a, c, t, g, unknown or other
  misc_feature (344)..(344): n is a, c, g, or t
  modified_base (350)..(350): a, c, t, g, unknown or other
  misc_feature (350)..(350): n is a, c, g, or t
  modified_base (352)..(353): a, c, t, g, unknown or other
  misc_feature (352)..(353): n is a, c, g, or t
  modified_base (358)..(358): a, c, t, g, unknown or other
  misc_feature (358)..(358): n is a, c, g, or t
  modified_base (376)..(376): a, c, t, g, unknown or other
  misc_feature (376)..(376): n is a, c, g, or t
  modified_base (384)..(384): a, c, t, g, unknown or other
  misc_feature (384)..(384): n is a, c, g, or t
  modified_base (412)..(412): a, c, t, g, unknown or other
  misc_feature (412)..(412): n is a, c, g, or t
  modified_base (433)..(433): a, c, t, g, unknown or other
  misc_feature (433)..(433): n is a, c, g, or t
tcagtactctcgtgcacgaccggtgctcgatttagtctagcgactttgggtttggggagaggagcccagcactagaagtcggcggtgtttccattcggtgatcagcactgaacacagaggacctcaccatggagtttgggctgagcttgggtttttcctcgttgcttcttttaagaggtgtccagtgtcaggtgcaccgtggtggagtcgtgggggagcgtggtccagccgtgggagtccctgagctctcctgtgcagtcctcgtggacttccacctttcgagttacgctttggacatcccagtcgggccncaggctccgaggcgaagggctaggnggtggngntagtanannatagngagtaggtaaagtaaatntaattagnggactcgtcggaggacggtcatccactntcacgagagactaactacaanacagagtgactcgagaactaacgtagaacacgtcgaggacggtacgacgggtagggaccgacggtcgttaaggttacgttacgttacgttgggtacggacggacgggcgggccggtaacgtacggtaaccctaacgtaccttaccgttaaccgttaacggtttaacggg

SEQ ID NO: 298282 - DNA, 714 bp, Homo sapiens
  misc_feature: GZ8MTXP01BB74S.19.26.C04.1.454.CMB.2.raw
  modified_base (282)..(282): a, c, t, g, unknown or other
  misc_feature (282)..(282): n is a, c, g, or t
  modified_base (314)..(314): a, c, t, g, unknown or other
  misc_feature (314)..(314): n is a, c, g, or t
  modified_base (348)..(348): a, c, t, g, unknown or other
  misc_feature (348)..(348): n is a, c, g, or t
  modified_base (652)..(652): a, c, t, g, unknown or other
  misc_feature (652)..(652): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcactggtggagtcgtgggggagcgtggtccaggccgtggggacgtccctgacgtacttctcctgtcgcagtcctctggacttccaccttnagtagctttggctactcccacgtcgggccccncgaggcctaccgaggacgaaagggggcttaaggngggtggggtacgacgtaagtttactagtctaagtagtagaagttaagggaaacgttaaaaaattgttaaaagtttacgtgggaacgtaacccgttacccggggtaagggaaaccggggtccttaaatttacccaaccctacgttacccgtaccgaagtaacgtaaactaaacgttaacccaaaacggtaaaccaacgtaacggtaggaacttaccgtaggaaactaaaacgtacgaaacgaacgtaccgtaaggagaacggtcggtaacggggacgtaccggtgtaaggttacgttagttacgnggtacgacgaggcggcggaacgtacggaacaaccgtacacgttccgttaaggtttaaccggg

SEQ ID NO: 298283 - DNA, 680 bp, Homo sapiens
  misc_feature: GZ8MTXP01E0IXP.19.26.C04.1.454.CMB.2.raw
  modified_base (302)..(302): a, c, t, g, unknown or other
  misc_feature (302)..(302): n is a, c, g, or t
  modified_base (374)..(374): a, c, t, g, unknown or other
  misc_feature (374)..(374): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggagtccctgagactctcctgtgcagcctctgacttcacttcagtagctttggcatcccacgtcgggtcccnccaggcctccgaggcgaaggggctaggaggtggggtgctagttatatcatatgagtagggaaagttaaaatnttaaacttagtgggaacgtaaccgttccgggtaagggaaacgggggtccctaatttacccaaccctagtaccctacccgaaagaacgaaactaaacttaacccgaaaagaaacctaacgagtaggaacttaccgtaggaacctaaaagtacgaaaccgacgtacccgtaggaaggacggtcgggtacggggaccgacgggtcgttggttagtttaacgttacgttgggtacgaccgggaggcgggccggtaacgtacgggaacctaaacgtaccttacgttaacccgttaaggttttaaccggggg

SEQ ID NO: 298284 - DNA, 566 bp, Homo sapiens
  misc_feature: GZ8MTXP01DJVLO.19.26.C04.1.454.CMB.2.raw
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (365)..(365): a, c, t, g, unknown or other
  misc_feature (365)..(365): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtggggggagcgtggtccagcctgggagtccctgagactctcctgtgcagcctctggattcacttcagtagcttggcatccacgtcgggtcccncaggcctccgaggacgaagggggctaggaggtgggtgcagttanatcatatgataggaagtaaatntaattanggatacgtcgagacgggcattccacatctacgagagaacaatacaaagacacgagtgatcgtaggacaaagtgaaacgagccgtaggacgaggcggtgggggaacacggtctggtagttagttacgttggtcgcggaggttcggcggtctagggaacctaacgtacttacgttcccgttaagttttaaccgggg

SEQ ID NO: 298285 - DNA, 542 bp, Homo sapiens
  misc_feature: GZ8MTXP01EJXRZ.19.26.C04.1.454.CMB.2.raw
  modified_base (274)..(274): a, c, t, g, unknown or other
  misc_feature (274)..(274): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggagtaaaatanatatgagactccgtgaaggccattcaccatctccagagacaattccaaagaacacagtggatctagacaaaatgaaacagaccctagaacgaagctgggggacacgggcttagtgtattactgtgcgagagcggctggacaactacatacatttacgggggttgacgtgtggggaccaaggggccaggtcatccgtctcccagcctcccacgaacggccacgtcgttccgttccccgttggcccgccctcgctccgagcgccaacccg

SEQ ID NO: 298286 - DNA, 711 bp, Homo sapiens
  misc_feature: GZ8MTXP01C89OO.19.26.C04.1.454.CMB.2.raw
  modified_base (334)..(334): a, c, t, g, unknown or other
  misc_feature (334)..(334): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcactggtgagtcgtgggggagcgtggtccaggccgtggggacgtccctgacgactctcctgtgcagcctctgacttcaccttcagtagctttggcactccacgtcgggtccgccaggcctccgaggcgaagggggctaggnggtggggtgctagttatatcatagtcgagtaggaagtaaaaatattaaattagtggaagtaccgttaccgggtaggaacgggtcccgtattcccgaacctatcctaccgaagaacgaaacctaaacgttacccaaaagaaccaacgtagttaggaacttacgtaagggaaactaaaagttacgaaaaccgacggtcccgtaagggaaggtaacgggtaccggttacggggggaaccgtaacgggtccgttaagggttaagtttaaacggttttacggttgggttacgggccgggaaagggcgggaccgggtaaccgtaacgggtaacctaaaaccgtacgttaaccgttaaccggttaaaggtttttaacccggggg

SEQ ID NO: 298287 - DNA, 580 bp, Homo sapiens
  misc_feature: GZ8MTXP01EW47I.19.26.C04.1.454.CMB.2.raw
  modified_base (272)..(272): a, c, t, g, unknown or other
  misc_feature (272)..(272): n is a, c, g, or t
  modified_base (330)..(330): a, c, t, g, unknown or other
  misc_feature (330)..(330): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
  modified_base (417)..(417): a, c, t, g, unknown or other
  misc_feature (417)..(417): n is a, c, g, or t
  modified_base (497)..(497): a, c, t, g, unknown or other
  misc_feature (497)..(497): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcacctggtggagtcgtgggggagcgtggtccagccgtgggaggtccctgagactctctgtgcagcctctgattcacttnagtagcttggctatccagtcgggtcccgccaggcctccgaggcgaagggggcttaggnggtggggtgctagttatatcatatgatagggaagtaaaatnttaaattagtgganactcggtagaagggtccattcacatcacaganactaactacaaagaacacagtgaatcgaggtaacaaagtacgaaacgacgccgtaggagacggcgtaggggactacggtntggttagttagttagttcggagaacggaggacgggcggtcgcggtaaccaacgtacttactaaccgttaaggttttaaccggg

SEQ ID NO: 298288 - DNA, 556 bp, Homo sapiens
  misc_feature: GZ8MTXP01D29N7.19.26.C04.1.454.CMB.2.raw
  modified_base (214)..(214): a, c, t, g, unknown or other
  misc_feature (214)..(214): n is a, c, g, or t
  modified_base (252)..(252): a, c, t, g, unknown or other
  misc_feature (252)..(252): n is a, c, g, or t
  modified_base (279)..(279): a, c, t, g, unknown or other
  misc_feature (279)..(279): n is a, c, g, or t
  modified_base (288)..(288): a, c, t, g, unknown or other
  misc_feature (288)..(288): n is a, c, g, or t
  modified_base (306)..(306): a, c, t, g, unknown or other
  misc_feature (306)..(306): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccncaggctccaggcaaggggctagagtgggtgctagttanatcatatgatggaagtaaatatattangagactcgngaaggccgattcacatcnccagacgacaattccaaagaacacagtggatctgacaaaatgaaacagacctgaagagcgtaggggacacgggctgtgtattacgtgtgcgagagcggctaggacaagtacatccgtaagtttacggggttaggacggttcgtcgggaccgaacgggccacggtcacgtcgtcctccccagtccctacacgacgggcccagtcccggttccttccccgttggccgtccctgcctccgagaacgccaaccg

SEQ ID NO: 298289 - DNA, 699 bp, Homo sapiens
  misc_feature: GZ8MTXP01DSX9I.19.26.C04.1.454.CMB.2.raw
  modified_base (266)..(266): a, c, t, g, unknown or other
  misc_feature (266)..(266): n is a, c, g, or t
  modified_base (289)..(289): a, c, t, g, unknown or other
  misc_feature (289)..(289): n is a, c, g, or t
  modified_base (298)..(298): a, c, t, g, unknown or other
  misc_feature (298)..(298): n is a, c, g, or t
  modified_base (319)..(319): a, c, t, g, unknown or other
  misc_feature (319)..(319): n is a, c, g, or t
  modified_base (342)..(342): a, c, t, g, unknown or other
  misc_feature (342)..(342): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatcccacgtcggggtccgccaggcctccgagggcgaagggggctaggaggtgggtggctagttanatcatatgataggaagtaaaatntatatgganactcgtgaaggcatcacatcnccagagacaattccaaagaacanagtggatctacgacaaatgaaacagaccctagaaggaggcggtagggggaacacggggtcgttaggtagttaatttacgtggtaggcgaaggtagggcgggacgttaggaccaaacgttacacttaccgtaacggttttacgggggtttacgggaaccggttcggtacgggggaccgaaacgggggtaccctaacggggttactacggttcccgttcccgtacccccgacgtcccctacccgaaaccggaaaccggggccccttaaccggttcccgggtttcccctttccccccgggttcgggcccccgtccccgttccggcccgtacccgaacggggtcccgcccgttaaccccgg

SEQ ID NO: 298290 - DNA, 689 bp, Homo sapiens
  misc_feature: GZ8MTXP01AWRTT.19.26.C04.1.454.CMB.2.raw
  modified_base (315)..(315): a, c, t, g, unknown or other
  misc_feature (315)..(315): n is a, c, g, or t
  modified_base (414)..(414): a, c, t, g, unknown or other
  misc_feature (414)..(414): n is a, c, g, or t
  modified_base (606)..(606): a, c, t, g, unknown or other
  misc_feature (606)..(606): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttggggttttcctcgttgcttcttttaagaggtgtccagtgtcaggtgcaccgtggtggagtcgtgggggagcgtggtccaggccctggggacgtccctgacgactctcctgtgcagcctctggacttccaccttcagttagctttggctactcccgacgtcgggtcccnccgtaggcctaccggaggccgaaagggggtctaagggaggttggggtggctaagtttatatcaattagtagagtaggtaaagtaaaatgtaaattaagngggaataccgttcggtaagggaaccggggtcctaaagtttcccaaccgtactacctaccgaagaacgaaacgtaaacttaccgaaaagaacaacgagtacggattcaggaacaaagtacgaaacgtacgaccgtaggaaacgtacggcggtaagggggacctacgggtacgttgttaagtttacgtttacgngggttacggcggttaggacggttccggaacgtacgggaactaaccggtaattaccggtaacgtttaacggttttaaccggggg

SEQ ID NO: 298291 - DNA, 699 bp, Homo sapiens
  misc_feature: GZ8MTXP01D7FIS.19.26.C04.1.454.CMB.2.raw
  modified_base (410)..(410): a, c, t, g, unknown or other
  misc_feature (410)..(410): n is a, c, g, or t
tcagtactctcgtgcacgaccggtgctcgatttagtctagcgactttgggtttggggagaggagccccagcactagaagtcggcggtgtttccattcggtgatcagcactgaacacagaggactcaccatggagtttgggctgagctgggttttcctcgttgcttcttttaagaggtgtccagtgtcaggtgcaccgtggtggagtcgtgggggagcgtggtccagccgtgggagtccctgacgactctctgtcgcagcctctaggacttcaccttcagtacgcgtttggctatcccacgtcgggtcccgaccgaggcctaccgagggccgaaagggggtctaaggagggttgggggagacgtaaggttatactacaattagtaggaagttaggggaaaagttaaaaatnttaaagttaagtgggactaacccgtaccgggtagggaaaccggggtcctagttacccaacctatcctaccgaagaacgaactaaacttaccgaaagaacaacgaagttaggaattaccgtagggtaaactaaagtaacgaaacgacgtaccgtaggaggaaacggtcgggtagggggaaccgaacgggtcgttaaggttagttaaacgttacgttggtacggacggaaggcggacggcgtaacggaactaaacctacgttaacttaacccgttaaggttttaaccgggg

SEQ ID NO: 298292 - DNA, 773 bp, Homo sapiens
  misc_feature: GZ8MTXP01A7VR4.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggagcgtggtccagccgtgggagtccctgagctctcctgtgcagtcctctggattccacttcagtagctttggctactccacgtcgggtcccgcaggcctaccgaggacgaaagggggctaggaggttgggtcgactaggttactatacaattagtaggaagtaggggtaaagttaaaaattagttaaaactttaaggtgggtaaacgtacccgttacgggtaacggggtaaacgggggtccctaaactttaccccaacccttaacgttaccccgttaaccccggaaagggtaaacctaaaacccgttaaaacctttaacccggaaaaacggtaaacccgaaccggttaaaggtaacgggtaacttaccgtaaggaaacccgtaaaagtttaaccggaaaccgtaacggacccgttaagggaacgggacggtacccgggtaagggggaccgtaaccgggtgttaaggttacgtttaagtaccgttggtaggacggttagggcggccggtaacgtacgggaacctaacgtacgttacttaacccgtttaagggtttaaccgggg

SEQ ID NO: 298293 - DNA, 640 bp, Homo sapiens
  misc_feature: GZ8MTXP01ALQMS.19.26.C04.1.454.CMB.2.raw
  modified_base (214)..(214): a, c, t, g, unknown or other
  misc_feature (214)..(214): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctaggagtgggtgcagttatatcatatgatggaagtaaatatattagtggagtactccggtagaacgggccgtatttccaccatcctaccagagaacaattaccaaagaacacagtgactctacgacaaatgaaacagaccctaggaagagcgtagggggacacgggtctgtagttattacgtggtgcggaggagcgggcgtaggaccaaactacacgttaccgtagtttacggggggtttggacggttcggacgggggaccgaacggggacccaacgggtcaacgttccgtacctccccgagcccctaccgaccggaaccgggccccacggttcccggttccccttcccccggttcgggccccgtccccgttcgccccgtcccggacggtccgcccgtaaccccgg

SEQ ID NO: 298294 - DNA, 665 bp, Homo sapiens
  misc_feature: GZ8MTXP01C6AVW.19.26.C04.1.454.CMB.2.raw
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (298)..(298): a, c, t, g, unknown or other
  misc_feature (298)..(298): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggagtccctgagactctcctgtgcagcctctggattcacttnagtncttggcatccacgtcgggcccnctaggcctccgaggccgaagggggctaaggaggtggggtcgactaggtttatatcaattagtcgaagtagggaaagttaaaatgttaaattagtcgggaataccgtaccgggtagaacgggctaattccacctatctacgaagacgaaactaaacttaccgaaagtaacgactaagtaggaacttaccgtagggaaacctaaaagtacgaaaccgacgtacccgtaggaacgtaacggccggtacgggggaaccaccgggtcgttaaggtagttaagtttaaccggttggttacggccggaaggcggccgggtcgtacgggaacctaaaccgtaccttacgttaaccgttaacggttttaaccgggg

SEQ ID NO: 298295 - DNA, 688 bp, Homo sapiens
  misc_feature: GZ8MTXP01DLAEE.19.26.C04.1.454.CMB.2.raw
  modified_base (386)..(386): a, c, t, g, unknown or other
  misc_feature (386)..(386): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggagtccctgacgactctcctgtgcagcctctggattccaccttcagtagctttggctactcccacgtcgggtcccgcaggcctccgaggcgaagggggctaggaggtgggtgctagttatatcatatcgatagggaagttaaaatagttaaattagnggagtaccgttccgggagaacggggcctaatttcccgaacctatcctaccgaagaacgaactaaacttaccaaagtaacaacgaaggtggtaacttaccgtagggaactaaaagtacgaaacgtacgacccgtaggaacggacggtccggtacgggggaaccgtacccgggtacgttgggtttaaggtttaaacgtttaacggttgggttaggaccgggaagggttacgggttccggggtaaccgtacgggaacctaaaaccggtacttacgtttaacccgttaacggtttttaaccggggg

SEQ ID NO: 298296 - DNA, 595 bp, Homo sapiens
  misc_feature: GZ8MTXP01DCJCA.19.26.C04.1.454.CMB.2.raw
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
  modified_base (329)..(329): a, c, t, g, unknown or other
  misc_feature (329)..(329): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtggggtccgccaggctccgaggcgaaggggctaggaggtgggtgcagttatatcatatgatggagtaaaatatattanggagactcgtgaaggcatcacatcncagagacaatccaagacanagtgatctcgacaaatgaacagcctgaagagcgtggggacacggctgtgtattacgtgtgcgagagcggctggacaactacatacctaagtttacggggttggacggtcgtacggggaccgaacggggaccgacggtacacgtccgttacctccccgagtccccgtccaacccgtaaacggggcccctaacggtcccggttaccccgttcccccgttcgggtcccgtcccctcggccctaccggacggtccgcccgtaaccccggg

SEQ ID NO: 298297 - DNA, 571 bp, Homo sapiens
  misc_feature: GZ8MTXP01BAB47.19.26.C04.1.454.CMB.2.raw
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (313)..(313): a, c, t, g, unknown or other
  misc_feature (313)..(313): n is a, c, g, or t
  modified_base (545)..(545): a, c, t, g, unknown or other
  misc_feature (545)..(545): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaagtaaaatntattatgganactccgtgaaggcgattcacatctcaganacaatccaagaacacagtggatctgacaaatgaacagacctgaagagcgtagggggacacgggctgtagtattactggtgcgagagcggcgtggacaatacatcctagtttacgggggttggacggtcgtcgggggaccaaacggggaccctaacgggtcaacgtccgtaccttccccaggtcccctaccgaccgaacgggccctacgtccggttccttccccgttggcccncccgtgacctccgaggcgccaacccg

SEQ ID NO: 298298 - DNA, 612 bp, Homo sapiens
  misc_feature: GZ8MTXP01EMIR7.19.26.C04.1.454.CMB.2.raw
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggctccaggcaaggggctaggagtgggtgcagttatatcatatgatggaagtaaaatntatangganactcgtgaaggcatcaccatctcagagacaatccaagaacacagtgatctagacaaatgaacagcctagaagagcgtggggactacgggctgtagtattactggtgcgagagcggctagggacaactacgacttccgaagtttacgggggtttggacggttcggacgggggtaccaaacggggcctaacggggtcctaacttccggtaccctacccccgaaggtcccctacccgaaccggtaaacggggcccctacggttcccgggttccccttccccggttcgggccctccccgtcgccctcccgagggtaaccgcccgtaacccg

SEQ ID NO: 298299 - DNA, 675 bp, Homo sapiens
  misc_feature: GZ8MTXP01ADJCY.19.26.C04.1.454.CMB.2.raw
  modified_base (301)..(301): a, c, t, g, unknown or other
  misc_feature (301)..(301): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctggattcaccttcagtagctttggctatccacgtcgggtcccncaggcctccgaggcgaagggggctaggaggtgggtgactagttatatcatagtgagtagggaaagttaaaatgttaaattagtgggactaccgttccgggaggaacggggtcctaattcccacctatacctaccgaagaacgtaactaaacttacccgaaagtaaaccaacgtaggtaggacttacgtacgggaactaaagttacgaaaccgacggtacccgtaggaacggaacggtccgggtacgggggaaccgtccgggtcgttaaggttaaggttacgtttaccgttaggtacggacggaggacgggttccgggtcgtacggaaccctaaaccgtaccgttaacgttcccgttaaggttttaacccggggg

SEQ ID NO: 298300 - DNA, 608 bp, Homo sapiens
  misc_feature: GZ8MTXP01A4NKM.19.26.C04.1.454.CMB.2.raw
  modified_base (263)..(263): a, c, t, g, unknown or other
  misc_feature (263)..(263): n is a, c, g, or t
  modified_base (353)..(353): a, c, t, g, unknown or other
  misc_feature (353)..(353): n is a, c, g, or t
  modified_base (377)..(377): a, c, t, g, unknown or other
  misc_feature (377)..(377): n is a, c, g, or t
  modified_base (390)..(390): a, c, t, g, unknown or other
  misc_feature (390)..(390): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcacctggtggagtcgtgggggaggcgtggtccaggccgtgggagtccctgagactctcctgtgcagcctntggattcaccttcagtagctttggctatccacgtcggggtacccgccaggcctccgaggcgaagggggctaggagtggggtgctagttanatcatatgagtaggaagtaaaatntaaattagtgganaccgtccgtaggaagggtccgattcacactctaccagacacaacttaccaaagtaacacgagtaggatcgtaggactaaagtagaacgacgaccgagaggacggacggtcgggaacggccggaacgtgggttagttacggttaattggtggacggacggngggacgggtccgagggaaccaacgtaccttacgtaaccgttaacggttttaaccgggg

SEQ ID NO: 298301 - DNA, 615 bp, Homo sapiens
  misc_feature: GZ8MTXP01A5WIL.19.26.C04.1.454.CMB.2.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
  modified_base (306)..(306): a, c, t, g, unknown or other
  misc_feature (306)..(306): n is a, c, g, or t
  modified_base (311)..(311): a, c, t, g, unknown or other
  misc_feature (311)..(311): n is a, c, g, or t
  modified_base (321)..(321): a, c, t, g, unknown or other
  misc_feature (321)..(321): n is a, c, g, or t
  modified_base (356)..(356): a, c, t, g, unknown or other
  misc_feature (356)..(356): n is a, c, g, or t
  modified_base (602)..(602): a, c, t, g, unknown or other
  misc_feature (602)..(602): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccacgtgggtccncaggctccgaggcaaggggctaggagtggggtgcagttatatnatatgatggagtaaaatatatanggagatcgtgaaggcatcacatcncaganacaatcaaanaacacagtgatctagacaaaatgaaacagcctagngagcgtggggacacgggctgtacgtattactgtgcgagagcgggctaggactaaacgtactacgtacctagtttacggggttaggacggttacgtgggggacccaaaggggcccctagggtaccacgttccggtccctaccccgtacgccccttaccgaaccccggtaaacggggccccttaacgtcccgggttcccgttcccccgttgggccccgtccccgtcgccccttaccgacggggtaacncccgtaaccccgg

SEQ ID NO: 298302 - DNA, 628 bp, Homo sapiens
  misc_feature: GZ8MTXP01AHZMF.19.26.C04.1.454.CMB.2.raw
  modified_base (254)..(254): a, c, t, g, unknown or other
  misc_feature (254)..(254): n is a, c, g, or t
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (274)..(274): a, c, t, g, unknown or other
  misc_feature (274)..(274): n is a, c, g, or t
  modified_base (294)..(294): a, c, t, g, unknown or other
  misc_feature (294)..(294): n is a, c, g, or t
  modified_base (372)..(372): a, c, t, g, unknown or other
  misc_feature (372)..(372): n is a, c, g, or t
  modified_base (384)..(384): a, c, t, g, unknown or other
  misc_feature (384)..(384): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttggggttttcctcgttgcttcttttaagaggtgtccagtgtcaggtgcacctggtggagtcgtgggggagcgtggtccagcctgggagtccctgagctctcctgtgcngcctntgattcacttnagtncttggcatccacgtgggccncaggctcgaggcaagggggctaggaggtgggtgactaggttatatcgaattagtcgatggggaaaggttaaaaaattnttaaagttacgngggaacgtaccgtaccgggtaggaacggggtcctattaccacctactcctacgaagaacgaactaacttaccaaagaacagtagtagatcgaggaactaagtagaacgacgacgtaggaggacggacggtaggggaccgacggtcgttaaggttacgttagttacggttaggtcgggacggacggacggccgggtaacgtacggaacctaactacgttacgttaaccgttaacggtttaacggg

SEQ ID NO: 298303 - DNA, 700 bp, Homo sapiens
  misc_feature: GZ8MTXP01B9HSH.19.26.C04.1.454.CMB.2.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
  modified_base (374)..(374): a, c, t, g, unknown or other
  misc_feature (374)..(374): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacgtggtggagtcgtgggggagcgtggtccagccgtgggagtcctgagactctcctgtgcagcctntggattcacttnagtgcttgcatccagtcgggtccncgaggcctccgaggcgaagggggctaggaggtggggtagactagtttatatcaattagtggaatagggaaagttaaaaatnttaaagttagtcgggaaagtaccgtacccgggtaagggaaacggggtcccctaattacccaacctaactacctaccgaagtaacgaaacctaaacgttaacccaaaacggaaaccaacgtaaggtacggtaattaccgtaagggaaactaaaagtacgaaaaccgaacggtcccgtaagggaacggtaacggaccgggtaacgggggaacccgtaaacggggtcgttaagggttaacgtttaagtttaaccgttggtacggacggttaaggcggcggtaacgtaggaacctaaactacgttacgtaaccgttaaggttttaacggg

SEQ ID NO: 298304 - DNA, 526 bp, Homo sapiens
  misc_feature: GZ8MTXP01DFI3W.19.26.C04.1.454.CMB.2.raw
  modified_base (296)..(296): a, c, t, g, unknown or other
  misc_feature (296)..(296): n is a, c, g, or t
  modified_base (321)..(321): a, c, t, g, unknown or other
  misc_feature (321)..(321): n is a, c, g, or t
  modified_base (336)..(336): a, c, t, g, unknown or other
  misc_feature (336)..(336): n is a, c, g, or t
  modified_base (359)..(359): a, c, t, g, unknown or other
  misc_feature (359)..(359): n is a, c, g, or t
  modified_base (464)..(464): a, c, t, g, unknown or other
  misc_feature (464)..(464): n is a, c, g, or t
  modified_base (488)..(488): a, c, t, g, unknown or other
  misc_feature (488)..(488): n is a, c, g, or t
  modified_base (493)..(493): a, c, t, g, unknown or other
  misc_feature (493)..(493): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttcagtagctttggcatccactgggtccncaggcctccaggcaagggggctagnggtgggtgcagttanatcatatgatgggaagtaaaatntaattatggagactccggtgaacgggcattcacatctcagagacaattcaagaacacagtggatctaggacaaatgaacagcctggagagcgtggggacacgggntgtgttagttacttgtggcgaggngcggngtggcaactacgattccgttaagtttaaccggg

SEQ ID NO: 298305 - DNA, 619 bp, Homo sapiens
  misc_feature: GZ8MTXP01CNWWE.19.26.C04.1.454.CMB.2.raw
  modified_base (217)..(217): a, c, t, g, unknown or other
  misc_feature (217)..(217): n is a, c, g, or t
  modified_base (258)..(258): a, c, t, g, unknown or other
  misc_feature (258)..(258): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccacgtggggtccnccaggctccgaggcgaaggggctaggagtgggtgcagttanatcatatgatggaagtaaaatatattatggagactccgtagaaggcattcaccatctcagagacaattaccaaagaacacagtaggatctacgacaaaatgaaacagacctagaagagcgtaggggacacggctgtgttattacgtgtgcgagacggcggctggacaactacatccgtaagtttacgggggttcggtacggttcggtacgggggaccaaacggggaccctacggtacactccggtccctccccgacgcccctacccaacccggaacgggcccctaacgttcccggttccccgttcccccggttcggccccgtacccgtcgccctacccgacggaaccgcccgtaaccccgg

SEQ ID NO: 298306 - DNA, 601 bp, Homo sapiens
  misc_feature: GZ8MTXP01BQAJL.19.26.C04.1.454.CMB.2.raw
  modified_base (270)..(270): a, c, t, g, unknown or other
  misc_feature (270)..(270): n is a, c, g, or t
  modified_base (293)..(293): a, c, t, g, unknown or other
  misc_feature (293)..(293): n is a, c, g, or t
  modified_base (362)..(362): a, c, t, g, unknown or other
  misc_feature (362)..(362): n is a, c, g, or t
  modified_base (551)..(551): a, c, t, g, unknown or other
  misc_feature (551)..(551): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggcctgggagtccctgagactctcctgtgcagcctctggattcacttnagtgcttgcatccacgtggtccncaggcctccgaggcgaagggggctaggaggtgggtgctagttatatcatatggatagggaagtaaaatntaaattagtgggatacgtccggtaggaaacggggcctaattccacctatcctaccgaagacgaactaaacttaccaaagaaccacgagtaggaatcgtaggaacaaaagtcgaaacgacgccgtaggacgaacggcggtagggggaccacgggtctaaggttgttaagttacgttggtacgcggacggnggcggtcgtaggaaccaaacgtacgacgttccgttaagttttaaccgggg

SEQ ID NO: 298307 - DNA, 680 bp, Homo sapiens
  misc_feature: GZ8MTXP01DDK0M.19.26.C04.1.454.CMB.2.raw
  modified_base (297)..(297): a, c, t, g, unknown or other
  misc_feature (297)..(297): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttcagtagcttggcatccacgtcgggtccncaggcctccgaggcgaagggggctaggaggtgggtggacagttatagtcagtggtagagtagggaagttaaaatagtaaagttaagtgggacgtaaccgtccggtaggaaacgggccgtaattccgacctacttaccgtaccaaggaacgtaaactaaacgtttaacccaaaggaaacccaacgtaaggtacggtaattaccggttagggaacctaaaagtacgaaaaccgtacggtacccgttaggaacggaacggtcgggtacgggggaccgtaacgggtcgttaaggttaggttaacttacggttggtcggtcggaaggttcggccggaacgtacggaacctaaacgtacttacgttcccgttaacggttttaacggggg

SEQ ID NO: 298308 - DNA, 649 bp, Homo sapiens
  misc_feature: GZ8MTXP01BRZRT.19.26.C04.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
  modified_base (354)..(354): a, c, t, g, unknown or other
  misc_feature (354)..(354): n is a, c, g, or t
  modified_base (388)..(388): a, c, t, g, unknown or other
  misc_feature (388)..(388): n is a, c, g, or t
  modified_base (396)..(396): a, c, t, g, unknown or other
  misc_feature (396)..(396): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcacttcagtagctttggcatccacgtgggtccnccaggctccaggcaaggggctaggagtgggtgctagttatatcatatgatggaagtaaatntattangganactcgtagaggcatcacatctacagagactaatccaaagaacanagtgatcgtacgacaaatcgaaacngaccctagaagtagcgtaggggacacggtctgtntagttacnggtcgcgagaggcggactaggactaactacgattacccgtaaggtttacgggggttaggtaccggttcggtacggggaccgtaaacgggtacccgtacggtacctacgtcccggtaccctccccgacgtccccgtacccaaacccggtaaacccggggccccttaaacgggtccccggttcccccttcccccggacggggtcccccctccccggttcgaccccgtaccggacggtaacccgccccgtaacccg

SEQ ID NO: 298309 - DNA, 636 bp, Homo sapiens
  misc_feature: GZ8MTXP01A6GH7.19.26.C04.1.454.CMB.2.raw
  modified_base (370)..(370): a, c, t, g, unknown or other
  misc_feature (370)..(370): n is a, c, g, or t
  modified_base (407)..(407): a, c, t, g, unknown or other
  misc_feature (407)..(407): n is a, c, g, or t
  modified_base (620)..(620): a, c, t, g, unknown or other
  misc_feature (620)..(620): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggagcgtggtccagcctgggaggtccctgagactctcctgtgcagcctctggattcaccttcagtagctttggcatccactggggtccaccagggctccgaggcgaaggggctaggagtgggtgcagttatatcatatgatggaagtaaaatatattactggagactccggtagacgggccattcacatctacagagacaatccaagaacacagtgatctagactaaatgaacagacctgaagngcgtaggggactacggctgtacgtattacgtggtagnggagacggacggcgtaggacctaaacgtactacgttacgtaacggttttacgggggtttacgggtacggggtttccggggacccgaaacggggtacccgaccggttacaccgttccgtccgtaccccgagccccgtaaccacgaaccgggcccttacggtccggttccctttccccggcggttcccgcccgttcgccgtcccgagggttaccnccgttaacccgtccgg

SEQ ID NO: 298310 - DNA, 663 bp, Homo sapiens
  misc_feature: GZ8MTXP01BFIPZ.19.26.C04.1.454.CMB.2.raw
  modified_base (259)..(259): a, c, t, g, unknown or other
  misc_feature (259)..(259): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
  modified_base (388)..(388): a, c, t, g, unknown or other
  misc_feature (388)..(388): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggagcgtggtccagccgtgggagtccctgagactctcctgtgcagcctntgattcacttnagtgcttgctatccagtcgggtccncaggcctcgaggccaagggggctaggaggtggggtcgactaaggttatatcaagttatggagttagggaaagttaaaatgttaaaacgttagngggaacgtaccgttaccgggaggaaacggggtcctaatttcccacctatcctaccgaagacgtaactaaacttaccaaagtaacacgagtaggatacgtaggaactaaagtacgaaacacgccgtaggacggacggcggtacgggggaaccacgggtcgttaaggtaacggtttacgttacgttggtaaccgggcggttaacgggcgggttccgggtaacgacggtaacctaaaccgtacgttaccgttaaccggtttaacgggtttaaccgggg

SEQ ID NO: 298311 - DNA, 680 bp, Homo sapiens
  misc_feature: GZ8MTXP01B7ECZ.19.26.C04.1.454.CMB.2.raw
  modified_base (312)..(312): a, c, t, g, unknown or other
  misc_feature (312)..(312): n is a, c, g, or t
  modified_base (604)..(604): a, c, t, g, unknown or other
  misc_feature (604)..(604): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacgtggtggagtcgtgggggaggcgtggtccaggccgtgggacgtccctgacgactctcctgtgcagcctctggattccccacttcagtacgcttggctactcccgacgtcgggtcccncgaggcctccgaggcgaaggggctaggaggtgggtgctagttatatactagtatggaagtagggtaaagttaaaatgttaaattagtgggaacgtaccgtccggtagggaacgggtccgtaacttaccacctatacctaccgaagtaacgaaactaaacgttacccaaaagtaaaccacgtaaggtacggtaacttccgttaaggggaaactaaaagtacgaaaccgtaagacccgtaggaagtacgggcggtacgggggaacctacgggtgttaaggtagtttacgttagngggtaggacggagcgggttccggtaagtacggtaactaaaccgtacttaacgttccggttaagttttaaccggggg

SEQ ID NO: 298312 - DNA, 771 bp, Homo sapiens
  misc_feature: GZ8MTXP01AMSMZ.19.26.C04.1.454.CMB.2.raw
  modified_base (269)..(269): a, c, t, g, unknown or other
  misc_feature (269)..(269): n is a, c, g, or t
  modified_base (315)..(315): a, c, t, g, unknown or other
  misc_feature (315)..(315): n is a, c, g, or t
  modified_base (708)..(708): a, c, t, g, unknown or other
  misc_feature (708)..(708): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcacctggtggagtcgtgggggagcgtggtccaggcccgtggggacggtccctggagaccttctcctgtgcagcctntggattccaccttcagtacgctttggctactccacgtcgggtcccnccgaggcctccgaggcgaaggggtctaggaggtgggggtagcgtaaggttactagtcaattagtagtaaggttagggaaaaggtttaaaaattattaaagtttaagttaaggggaaacgttaacccggttacccggttaggggaaaccgggggtccccttaacgtttacccaaaccctacgtttacccgtaacccgtaaaggaaccggtaaaacttaaaaccgtttacccgaaaaaacgaaacccgtaaacgttaaacgggtttaacgggaattaccgttaacggggaaactaaaacgttacgaaaaccgtaacggaccgtaggaaggacgggtaccggtacgggggaacgaccgggtcgtaaggtttgttaagtttacgttgggttaccggnggttaacgggcgttaccggtcgtagaaccgtaactacgacttaacgttaacgttttaacgggg

SEQ ID NO: 298313 - DNA, 716 bp, Homo sapiens
  misc_feature: GZ8MTXP01A5BV7.19.26.C04.1.454.CMB.2.raw
  modified_base (272)..(272): a, c, t, g, unknown or other
  misc_feature (272)..(272): n is a, c, g, or t
  modified_base (432)..(432): a, c, t, g, unknown or other
  misc_feature (432)..(432): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgtttgcttcttttaagaggtgtccagtgtcaggtgcaccgtggtggagtcgtgggggagcgtggtccaggccgtggggacggtcccctggacgtacctctcctgtgcagtcctntggacttcaccttcgagtagctttggctactcccacgttcgggtcccgcccgaggccctaccgagggccgaagggggctaagggaggtgggggtggactaaggtttactagtctaattagtagtaagttagggtaaagttaaaaattagttaaatttagngggtaaacgaccgttaccgggtagggaacggggtccgtaatttcccgaacctacgtacctaccgaacgaactaactaaacgttacccaaagaaaccaacgtaggtacggtactaaccgtaggaaactaaagtacgaaaccgaacgtacccgtaaggaacggaacgtccggtaagggggaccgtacggtacgtggttaacgttagtttacgttggtacggcgttaacggcgccggtaacgtcgggaactaactacgttacgttaacccgttaagtttaaccgggg

SEQ ID NO: 298314 - DNA, 812 bp, Homo sapiens
  misc_feature: GZ8MTXP01CZ5QN.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggaggcgtggtccaggcctggggacgtccctgacgaccttctcctgtgcagcctctgattcaccttcagtagctttggcagtcccacgtcgggtccccgccaggcctaccgaggacgaaagggggctaagggaggttgggggtacgggtactaaggttttataacgtacgtaattaagtacggtaagttaaggggttaaaggttaaaaaaatttagtttaaaagtttaagtggggaaacgtaaccgtttacccgggtaaggggaaaccgggggtacccctaaagtttaccccaacccgtaacgttccctaacccgaaagaacgtaaacctaaaactttaacccgaaaaggaaacccaacgtaaggttacggtaagttcctaacgggggtaaacaaaacgttacggaaaaccgtaacggcccgtagggtaacggaaccgggtccgggtacgggggtaaacccggtaacgggttccgttaaggttacggtttaaacggtttaccgttagggttacgggaccgggttaaaggacgggcggtaactacggggtaacctaaaaccgtacgttaaccttaacccggttaaggtttttaacccggggg

SEQ ID NO: 298315 - DNA, 639 bp, Homo sapiens
  misc_feature: GZ8MTXP01ASG8S.19.26.C04.1.454.CMB.2.raw
  modified_base (277)..(277): a, c, t, g, unknown or other
  misc_feature (277)..(277): n is a, c, g, or t
  modified_base (305)..(305): a, c, t, g, unknown or other
  misc_feature (305)..(305): n is a, c, g, or t
  modified_base (381)..(381): a, c, t, g, unknown or other
  misc_feature (381)..(381): n is a, c, g, or t
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcacgtggtggagtcgtgggggagcgtggtccaggccgtgggacgtccctgagactctcctgtgcagcctcgtgacttcaccttnagtagctttggctatccacgtcgggccncaggcctccgaggcgaagggggctaggacggtgggtagactagttatatcatagtgaagtaggtaaagttaaaatnttaaacgttagtaaggaactaccgtaccggtaggaacgggtcctaattacccacctactcctacgaagaacgaactaaactaccgaaagtaacacgtagtagatacgtacgggaactaaaagtacgaaactacgccgtaggaacggacgacggtacggggacgaccggtgtaagtagttattacgngtacggnggacgacgggttcgaacgtacggtaacctaacgtacgttacttaacggttaacggtttaacgggg

SEQ ID NO: 298316 - DNA, 633 bp, Homo sapiens
  misc_feature: GZ8MTXP01BHQH7.19.26.C04.1.454.CMB.2.raw
  modified_base (355)..(355): a, c, t, g, unknown or other
  misc_feature (355)..(355): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccaccgaggctccgaggcaagggggctaggaggtgggtgctagttatatcatatgagtggaagtaaaatatattatggagactcgtgaagggcattcacatctcagagacaatccaaagacacagtgatctgacaaatgaacngacctgaagagcgtaggggacacggctgtagtattacgtgtgacgagagcggcgtacggacaactacacttaccgtaagtttacggggggttggaaccggttcggtacgggggaccgaacggggacccgacggtccaacgttcccggtaccctcccccgacggtcccctaacccgaaccggaaccgggcccctaacggttccccggttccccgttcccccggttgggccccgtccccgtaacgcccgtacccggaacgggtccgaacccgaaccccgg

SEQ ID NO: 298317 - DNA, 620 bp, Homo sapiens
  misc_feature: GZ8MTXP01AC2K8.19.26.C04.1.454.CMB.2.raw
  modified_base (215)..(215): a, c, t, g, unknown or other
  misc_feature (215)..(215): n is a, c, g, or t
  modified_base (522)..(522): a, c, t, g, unknown or other
  misc_feature (522)..(522): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccacgtggtccnccaggcctccgaggcgaaggggctaggaggtgggtgctagttatatcatatgatggaagtaaatatattatggagactcgtagaacgggccattcaccatctacagagacattcccaaagaacacagtgatctcgacaaagtcgaacagaccctagaagtaacggcgggtacggacgtcgtagtagtagttactgtggtacgaggagcggcgtcgacgaactaccacgtacgtacgttacggttacggggtggtaccggtcggggaccggacggaaccgccgtacgtacgaccgtccgtccccaccnccggtcccaaccgttacggacccgttaccgtccggtcccgttcccccgttccggccgtcccgttcgccgtccgacgaacgcccgttaaccgaacccgg

SEQ ID NO: 298318 - DNA, 654 bp, Homo sapiens
  misc_feature: GZ8MTXP01CKOI8.19.26.C04.1.454.CMB.2.raw
  modified_base (290)..(290): a, c, t, g, unknown or other
  misc_feature (290)..(290): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
  modified_base (404)..(404): a, c, t, g, unknown or other
  misc_feature (404)..(404): n is a, c, g, or t
  modified_base (406)..(406): a, c, t, g, unknown or other
  misc_feature (406)..(406): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccacgtcggtccaccaggcctccgaggacgaaggggctaggaggtggggtgctagttatatcatatgagtaggaagtaaatatatanggagactcgtgaggcatcacatcncaganacaataccaagacacagtagactctagacaaatgaacncgacctaggaagcgcggacggggacacggtctagtagttatcgtggngngagacggcgcgtaggactaactacacgttacgtaacggttttacgggggttcggaccggttcggtaccggggaccgaacgggtacccacgggttactacgtcccgtacccgtaccccgcgaaccccgtaaccgaccggtaacccgggttcccttaaccggttccccggttaccccgtttcccccggcgggtccccgtccccgttcgaccccgtaccggacggggtaacccttaaccccgtaaccccgg

SEQ ID NO: 298319 - DNA, 642 bp, Homo sapiens
  misc_feature: GZ8MTXP01B89R9.19.26.C04.1.454.CMB.2.raw
  modified_base (341)..(341): a, c, t, g, unknown or other
  misc_feature (341)..(341): n is a, c, g, or t
  modified_base (391)..(391): a, c, t, g, unknown or other
  misc_feature (391)..(391): n is a, c, g, or t
  modified_base (576)..(576): a, c, t, g, unknown or other
  misc_feature (576)..(576): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggagcgtggtccagccgtgggagtccctgagctctcctgtgcagcctctggattccacttcagtagctttggctactcccgacgttcgggtccccgccgaggccctaccgaggcgaaagggggtctaaggnggtggggtgctagtttatatacagtatggaactagggtaaagttaaaatnttaaagttaacgtgggaataccgtccgggtagaacggggtccctattaccacctatcctacgaagaacaactaaacttaccgaaagtaaccactaggtaggactaccgtaggaactaaagtacgaaacgtacgaccgtaggacggaggtccggtaggggacctacggtgttgtacgttattacgnggtacggcgaggttcggcggtctacggaactaacgtacgttacgtaaccgttaagttttaacgggg

SEQ ID NO: 298320 - DNA, 653 bp, Homo sapiens
  misc_feature: GZ8MTXP01DOFEX.19.26.C04.1.454.CMB.2.raw
  modified_base (257)..(257): a, c, t, g, unknown or other
  misc_feature (257)..(257): n is a, c, g, or t
  modified_base (269)..(269): a, c, t, g, unknown or other
  misc_feature (269)..(269): n is a, c, g, or t
  modified_base (295)..(295): a, c, t, g, unknown or other
  misc_feature (295)..(295): n is a, c, g, or t
  modified_base (382)..(382): a, c, t, g, unknown or other
  misc_feature (382)..(382): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggtttttcctcgttgcttcttttaagaggtgtccagtgtcaggtgcactggtggagtcgtgggggagcgtggccagccgtgggagtccctgagctctctgtgcagcctntgacttcacttnagtgcttggcatccagtcgggtcccncaggcctcgaggcgaagggggctaggaggtgggtgactagttatatcatagtacggagtagggaaagttaaaatcgtaaagtttagngggaacgtaccgttaccgggtagggaaaccggggtcctaattcccgaacctactacctaccgaagaacgtaactaaacttacccgaaagaaactaacgagtaggacttaccgtaagggaactaaaagtacgaaacgacgtacccgaggaacggacgacggtacggggaaccgtacgggtcttaaggttagttagtttacgttgggtcggacggaggttcggccgggtctacggaactaacgtacttacttccgttaacgttttaaccgggg

SEQ ID NO: 298321 - DNA, 726 bp, Homo sapiens
  misc_feature: GZ8MTXP01D655L.19.26.C04.1.454.CMB.2.raw
  modified_base (304)..(304): a, c, t, g, unknown or other
  misc_feature (304)..(304): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggacgtcctgagtactctcctgtgcagcctctggacttcacttcagtagcttgctactccacgtcgggtccccncgtacggcctaccggaggcggaaacgggggtctaagggcgggttgggggtcgggtactaagggtttatactcaagttatagaggttaagggtaaagttaaaattagttaaagttagtaaggggaactaccgggttaccggtagggaaaaccggggtcccgtaattacctaccctactacctaccgaacggaactaaacgtaaaacttaaccgaaacgaaacccgtagaaacgtacggtaacttaccgtaggtaaaccgtaaaagtaaccgaaacgtaccgtaaccgtaggaacggaacggtacgggtacggggaacgtaaccggtgttaaggttacgttaagttaccgttggtacggacggaaggttcggcgggtaactagggaacctaacgtacttacgttcgttaacggttttaacgggg

SEQ ID NO: 298322 - DNA, 672 bp, Homo sapiens
  misc_feature: GZ8MTXP01CKSCP.19.26.C04.1.454.CMB.2.raw
  modified_base (368)..(368): a, c, t, g, unknown or other
  misc_feature (368)..(368): n is a, c, g, or t
  modified_base (377)..(377): a, c, t, g, unknown or other
  misc_feature (377)..(377): n is a, c, g, or t
  modified_base (409)..(409): a, c, t, g, unknown or other
  misc_feature (409)..(409): n is a, c, g, or t
  modified_base (598)..(598): a, c, t, g, unknown or other
  misc_feature (598)..(598): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtggggggagcgtggtccagccgtgggagtccctgacgactctctgtgcagtcctcgtggattccaccttcaggtacgctttggctactcccagttcgggtcccacaggcctacccgagggtaccgaagggggtcctaggaggtggggtgactaggtttanatcgattanacgagtaggaaagttaaaatcgtaagtttagngggaatccgtccggtagaacggggcctatcccactatcctacgagtaacgaactaaacttacccgaaagaaaccaacgagtagggtaacttaccgtaggggaaacttaaaagtgaaaccgacgccctagggaaggtaacggccggttacgggggaaactccgggtgtaaggttcgttaagtttaccggnggtacggacggacggttcggccgggtaactacggtaactaacgtacgttacgttaaccggttaacggtttcggg

SEQ ID NO: 298323 - DNA, 758 bp, Homo sapiens
  misc_feature: GZ8MTXP01B3VRF.19.26.C04.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (345)..(345): a, c, t, g, unknown or other
  misc_feature (345)..(345): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccacgtcgggtccaccaggcctccgaggcaaggggctaggaggtgggtgctagttatatcatatgataggaagtaaaatatattangganactccgtagaacggcattccaccatcacaagacgaacaataccaaagaacanagtaggatcgtagacaaagtagaaaccagtaccgtaggaagaaggcggtagggggaacccgtagggtacgttggttagttaacttacggtggtagggaccggaaggacgggaccggtcgttacgggacctaaaaccttacgaacctttaccgtaaaggttttaccggggggtttacggggaacccgttacgggtacgggggaaccccgaaacgggggaccccgttaacgggtaccctaaacgtccccggttaccccgtaccccccgaacgggtcccccttaaccccggaaaccggtaaacccggggcccccttaaacgggttcccccgggtttcccccttaccccccgggttcggggtaaccccctcccgttaacgccccgtaccggacggaacccgttaaccccgaacccgg

SEQ ID NO: 298324 - DNA, 662 bp, Homo sapiens
  misc_feature: GZ8MTXP01ALV0I.19.26.C04.1.454.CMB.2.raw
  modified_base (560)..(560): a, c, t, g, unknown or other
  misc_feature (560)..(560): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggagcgtggtccagccgtgggacggtccctgacgcctctcctgtcgcagcctctggattccaccttcagtacgctttggctactccacgtcgggtcccgccaggcctccgaggaccgaagggggtctaagggacggtgggtagtactagtttatatacagtagtgaagtaggaaagttaaaatgttaaattagtgggagtaccgtacggtaggaacggtcctacttcacctatacctacgaagacgaactaacttaaccgaaacgaaaccaacgagtacgaattaccgtaggaactaaagtacgaaaccgtacgaccgttaggacggacggacggtacgggggaaccncgggtcgtaaggttacgttacgttacgttggtacggacggaggcggttaccggcgtacggaactaacctacgttaacgttcccgttaaggttttaaccgggg

SEQ ID NO: 298325 - DNA, 637 bp, Homo sapiens
  misc_feature: GZ8MTXP01AM48B.19.26.C04.1.454.CMB.2.raw
  modified_base (260)..(260): a, c, t, g, unknown or other
  misc_feature (260)..(260): n is a, c, g, or t
  modified_base (305)..(305): a, c, t, g, unknown or other
  misc_feature (305)..(305): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagccgtgggagtccctgagactctcctgtgcagcctntggattccaccttcagtacgcttggctactccacgtcgggtcccnccgaggcctccgaggcgaagggggctaggaggtgggtcgactagttatatcatagtagtagtaggtaaagtaaaatgttaaacttagtggacgtaccgtaccggtaggaacgggtccaattccacctactcaccgtagaacgaactaacttaccgaaagaaccagtaggtgtaactcgtacggaacaaagtacgaaacacggtaccgtaggaaggacggtcggtagggggaaccgtacggcgttaaggtagttacgttacgttgtacggaccggaggacggcggaaccgtaggaacctaactcgttacgtaaccgttaaggtttaaccgggg

SEQ ID NO: 298326 - DNA, 635 bp, Homo sapiens
  misc_feature: GZ8MTXP01DBA0I.19.26.C04.1.454.CMB.2.raw
  modified_base (254)..(254): a, c, t, g, unknown or other
  misc_feature (254)..(254): n is a, c, g, or t
  modified_base (282)..(282): a, c, t, g, unknown or other
  misc_feature (282)..(282): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccaccaggctccgaggcaaggggctagagtgggtgcagttanatcatatgatggaagtaaaatatattanggagactcggtgaagggccgattcaccatctccagagacaattacccaaagaacacagtggatctacgacaaaatgaaacagacctagaagagcgtagggggacacgggctgtgtattacgtgtgcgaggacgcggctggacaacgtacatacctaagtttacgggggtttggacgttcggacggggtaccgaacggggaccacgggtaccacgttaccggtccctccccgaacgcccctacccgaacccggaaccggggcccctacgttccccgggttccccgtttccccccggttcgggcccccgtccccgtcggcccgttacccgacgggtaaccgccccgtaaccccgg

SEQ ID NO: 298327 - DNA, 718 bp, Homo sapiens
  misc_feature: GZ8MTXP01B4IRE.19.26.C04.1.454.CMB.2.raw
  modified_base (309)..(309): a, c, t, g, unknown or other
  misc_feature (309)..(309): n is a, c, g, or t
  modified_base (359)..(359): a, c, t, g, unknown or other
  misc_feature (359)..(359): n is a, c, g, or t
  modified_base (403)..(403): a, c, t, g, unknown or other
  misc_feature (403)..(403): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaccgtggtggagtcgtggggggagcgtggtccaggcctggggagtccctgacgtactctcctgtcgcagcctctggattccaccttcagtagctttggctatccgacgtcgggtccnccaggcctccgaggcgaagggggctaaggacgtggggtagctaggtttanatcattagtgtaagtaggtaaaggtaaaattgtaaagttaacgngggaaactaccgtaccggtaggaaacggggccctagtttacccaacctattaccgtacaaggtaactaactaaaacgttacccgaaaaggtaaaccctaagtaggtaacggtaacttccgtaaggggtaaccaaaagttcgaaaaccgacggtaccgttagggaacggacggtccggtacgggggaacctacggggtaccttggtttaacggttaaagtttcggttggttacgggcggaaggaccggttcgggtaaccgtacggtaacctaaaccggttacccaacttaacccggttaacgttttaacccggggg

SEQ ID NO: 298328 - DNA, 674 bp, Homo sapiens
  misc_feature: GZ8MTXP01C70RW.19.26.C04.1.454.CMB.2.raw
  modified_base (178)..(178): a, c, t, g, unknown or other
  misc_feature (178)..(178): n is a, c, g, or t
  modified_base (310)..(310): a, c, t, g, unknown or other
  misc_feature (310)..(310): n is a, c, g, or t
  modified_base (339)..(339): a, c, t, g, unknown or other
  misc_feature (339)..(339): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgactttgggtttgggggagaggagccccagcactagaagtcggcggtgtttccattcggtgatcagcactgaacacagaggactcaccatggagtttgggctgagtcttgggtttttcctcgttgcttcttttaagnggttgtccagtgtcaggtgcacgtggtggagtcgtggggggagcgtggtccagccgtgggagtccctgacgactctcctgtgcagcctgtggtattccacttcagtagctttggcatccacgtcgggtcccncaggcctccgaggcgaagggggctaaggngtggggtgctagttanatcatagtgagtagggaagttaaaatgttaaattagtggaacgtacgtaccgggtagaacggggcctattcccacctatcctacgagaacgaactaaattaccgaaagaacctaacgagttaacggaacttaccgtaagggaacctaaaagtacgaaaccgacggtacccgaggaggaacggcgggtaacgggaaccgtaaccgggtcgtttaagggtcgtttaaagtttacgttggttacggcggttaacggcgggaccgtggttaccggaacctaacggtaacttaccgttaaccggttaaacgttttaaccggggg

SEQ ID NO: 298329 - DNA, 881 bp, Homo sapiens
  misc_feature: GZ8MTXP01BEYZP.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggagcgtgtccagccgtgggacgtccctgacgctctcctgtcgcagcctcgtgtacttccacttcgagttacgtcgtttggacctactcccgacggttccggggtccccgaccgacgggtccctacccggaagggtaccggaaaacggggggtccttaaagggggtaggggttcggggggtacggtaacgttaaggtttaacttaacgtacgtaaagttagttacggggtaaacgttaagggggtaaaaagttaaaaatttacgttaaaaagtttaacggtaacgggggtaaacgtaaacccgggttaccgggtaaaggggtaaacccgggggtacccttaaacgtttaccccctaaacccgttaccgttacccgtaaaccccgaaaggtaaaccggtaaaccttaaaaacccgttaaaccggaaaaacggtaaaacccgtaaaggtaaaccgggttagggtaaacctttacgtaaaccggggtaaactaaaaacgttaacggaaaccgtaacggtacccgttaggaaacggtacggaaccgggtacggggggtaaaccctaacgggtccgtttaagggtagtttaacgttaccggttggacggtaaccggaggcggacggtcgtacgaactaacgtacttacgtaaccgtttaacgggtttaaccggg

SEQ ID NO: 298330 - DNA, 663 bp, Homo sapiens
  misc_feature: GZ8MTXP01B9BKZ.19.26.C04.1.454.CMB.2.raw
  modified_base (361)..(361): a, c, t, g, unknown or other
  misc_feature (361)..(361): n is a, c, g, or t
  modified_base (576)..(576): a, c, t, g, unknown or other
  misc_feature (576)..(576): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacgtggtggagtcgtgggggagcgtggtccagccgtgggacgtccctgacgactctcctgtgcagcctctggacttccaccttcagtagcttggcactccacgtcgggtcccgcaggcctaccgaggcgaagggggctaggagggtggggtagactaggttatactanaattagagtagtagggtaaagttaaaatgttaaagttacgtgggaacgtaccgttaccgggtagggaacgggtcccgtaattacccaaccctatacctaacgaagaaacgtaaactaaactttaacccgaaaagaaccaacgaagtacggtactacgtagggaaactaaagtacaaacgagtaccgtagaaggtacgcggtagggacgtacggtntaaggttagttagttacgttgtaggacggaagttcggcggtcgacggtaactaaccgtacttacgtaacgttaaggtttaaccgggg

SEQ ID NO: 298331 - DNA, 711 bp, Homo sapiens
  misc_feature: GZ8MTXP01BQ70O.19.26.C04.1.454.CMB.2.raw
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtggggagcgtggtccagccgtgggagtccctgagactctcctgtgcagcctctggattcaccttnagtgctttggcatccacgtcgggtccncgaggcctccgaggcgaaggggctaggaggtgggtgctagttatactgtaattgtagtagtagggtaaaggttaaaattagtaaagtttacgtgggtacgtaacccgttccggtagggaaaccgggtcgtaactttcccacctacgtacctacgaacgaacgtaaactaacgttaaccaaagtaaccgaagtaacggtaggtactttaccgtaggggaactaaaaagtcgaaacccgtacgacccgtacggaaggtaaacggcgggttaacgggggaccctaaacgggtcgttaagggttagttaaaccgttacggttacggggtcgggtacggacgggacgggaccgggtaacggtacggtaaccgtaaccgtaacgttaaccgttaaccggtttaacggtttaaccgggg

SEQ ID NO: 298332 - DNA, 837 bp, Homo sapiens
  misc_feature: GZ8MTXP01B9Z84.19.26.C04.1.454.CMB.2.raw
  modified_base (214)..(214): a, c, t, g, unknown or other
  misc_feature (214)..(214): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactggtccncaggctccgaggcaaggggctaggaggtgggtgctagttatatcatatgatagggtaagtaaatatattagtgggagactcggtaggaacggtccgtattcacctatcctccaaggaacgaactaacgtttacccaaaacgaacctaacgaggtaggaaacttcgtacgaacctaaagtacgaaaccgacgtaacccgtagggaaggacgggacgggtacgggggaacctaccggggtcgttagggttacgtttaactttaacggttaggtcggaacggggtaacggacgggtaccggggtacgttacggggtaaccttaaacgttaacctaaccgttaaccgttaacgggttttaaccggggggttttacggggtaacccggttcgggggtacccgggggtaacccgggaaaccgggggtaacccgtaaaccgggttaccgtaccgttcccggttaccccgttacccccgaccgttaaccccgtaaccccgaaacccggtaacccgggttaccccgtaccggttccccgggtttccccgtttcccccccggttcgggtcccccggtaccccgttcccggtcccgtaccccggacggggtaacccgccccggtaacccccggg

SEQ ID NO: 298333 - DNA, 624 bp, Homo sapiens
  misc_feature: GZ8MTXP01AY6W9.19.26.C04.1.454.CMB.2.raw
  modified_base (320)..(320): a, c, t, g, unknown or other
  misc_feature (320)..(320): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (524)..(524): a, c, t, g, unknown or other
  misc_feature (524)..(524): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagccgggttttcctcgttgcttcttttaagaggtgtccagtgtcaggtgcaccgtggtggagtcgtgggggagcgtggtccagccgtgggacgtccctgacgactctcctgtcgcacgtcctcgtggtacttccaccttcgagtacgtcttggcctacttcccgacgtcgggtccccnccgacggcctaccgaggacgaaggggctaggaggtgggtagctaagttatatcatatagagtaggaaagttaaatnttataagnggaatacgtcggtagacgggctatcacctatcacgagacactaactacaaagacacgtagtgtaactctagaactaaatagaacgacgccgtaggaacgaggcggtagggacctacggtnttggtaattaacgttcgaggttcgacggtaggacggttcggactaacgggaacctaacgtacgtacgttacccggtttaaggtttcccggggttaacggg

SEQ ID NO: 298334 - DNA, 635 bp, Homo sapiens
  misc_feature: GZ8MTXP01B999S.19.26.C04.1.454.CMB.2.raw
  modified_base (253)..(253): a, c, t, g, unknown or other
  misc_feature (253)..(253): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacgtccctgagactctcctggtncagcctcgtggacttccgaccttcgaggtacgtctttaggctacgtcccagtcgggtcccgccacggctccgaggtcgaaaggggtctagagggtggtagactagttanactanatagtagaggtaggtaaagtaaatgtaaagttagtggactacgtacggtaggacggactactacactactacgacacgacgtaacaactacaaacaacacgtagtagtactacgtacgaactaaagtacgaacgacgaccgaggaacggacgtaccggtacggaccgtacggtgtaaggtaacgttacgttacgttggtacgtaacggaggcggaccggtcgtacgaaccgtaactaccgttacgttaaccgttaacggtttaaccgg

SEQ ID NO: 298335 - DNA, 609 bp, Homo sapiens
  misc_feature: GZ8MTXP01A4G7X.19.26.C04.1.454.CMB.2.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (360)..(360): a, c, t, g, unknown or other
  misc_feature (360)..(360): n is a, c, g, or t
  modified_base (367)..(367): a, c, t, g, unknown or other
  misc_feature (367)..(367): n is a, c, g, or t
  modified_base (380)..(380): a, c, t, g, unknown or other
  misc_feature (380)..(380): n is a, c, g, or t
  modified_base (385)..(385): a, c, t, g, unknown or other
  misc_feature (385)..(385): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttnagtagctttggcatccactgggtccnccaggctccaggcaaggggctagagtgggtgcagttatatcatangatggaggtaaaatnattatggagtactcgtagaacgggcctattcaccatctaccagacgactaattccaaagaaccacagtgactctgacaaatgaacncgactgngagcggagggacncggtntgtatatacgtggtgagagcggtacggacgtagacaacgtactacttacgttaaggttacggggttacggacggttccggacggggtacccaacggggtaccctacggtaccacgtcccgtacctcccgaacggtccctaccgaaccgaccgggttcctaccggttcccgttcccgttccccgcgaacccgccgtcgacccaccggacggtccgccgtaacccg

SEQ ID NO: 298336 - DNA, 603 bp, Homo sapiens
  misc_feature: GZ8MTXP01A4NNC.19.26.C04.1.454.CMB.2.raw
  modified_base (187)..(187): a, c, t, g, unknown or other
  misc_feature (187)..(187): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctgagactctcctgtgcagcctctggattcaccttnagtagctttggcatccatggtccnccaggctccgaggcaaggggctagagtgggtgcagttatatcatatgatggagtaaatanattatggagactccggtgaagggtccgatttcaccatctccagagacaattccaagaacacagtgatctgacaaatgaacngactgngagctggggacacgggctgtagtattacgtgtgcgagaggcggctcggcaactacgataccgtagttacgggggtttggacggttcgacgggggtccgaaggggtaccgacgggtcacgttccggtaccttcccccgaagtccctacccgacccgaacggggccccaacgtcccggttcccgttacccccggttgggcccgtcccgtaacggccttaccgacgggtaaccgaaccgtaaccccgg

SEQ ID NO: 298337 - DNA, 911 bp, Homo sapiens
  misc_feature: GZ8MTXP01BEJVJ.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacgtggtggagtcgtggggagcgtggtccaggcctgggacgtccctgacgactctcctgtgcagcctctggacttccaccttgagtagctttggctatcccgagtcggtcccgccaggtccctacgaggcgaagggggtctaagggagggtggggtacggactaaggtttataactcgaaagttagtggaagttagggggtaaaaggttaaaaatttacgttaaaagtttacggtaagggtaaaccggtaacccgttaccggggttaaacggggaaaacgggggtcccctaaacgtttttacccaaaccccgttacttacccgtacccgaaacggtaaaccgtaaacccttaaaaacccggtttaacccgaaaaaggtaaaacccgaaaccggttaaagggttaaccgggtaaattttaacccggggaacgaaaaccggtaaaaaacgttaaacccgggtaaaaacctaaccgggaaccccgttagggaaaggggaaacccggtttaccgggggtaaaccgggggtaacccgtaacgggggtccgtttaacggggtttaggttttaaaccgtttaaccgggttgggtttaaacccgggggtccgggaaaagggggttccggggaacccggggtttcccgtaacgggggaacccttaaaaccgggttaaacttaaccccgggttttaacccggttttaaagggggtttttaaccccggggg

SEQ ID NO: 298338 - DNA, 723 bp, Homo sapiens
  misc_feature: GZ8MTXP01AY9WV.19.26.C04.1.454.CMB.2.raw
  modified_base (259)..(259): a, c, t, g, unknown or other
  misc_feature (259)..(259): n is a, c, g, or t
  modified_base (274)..(274): a, c, t, g, unknown or other
  misc_feature (274)..(274): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccatgggtccaccaggctccaggcaaggggctagagtgggtgcagttatatcatangatggaagtaaaatntattatggagactcgtgaagggccattcacatctaccagagacaatacccaaagaaacacagtggatctagactaaaangaacacgactaggaagacgcgggtacggggaccacggtcgtagttacgttaagttacgtggtacgggacggaaggacgggtaccgggtacgtacggaaacctaaacgttaacgtaaccgttaaccgttaaacggttttaacggggggtttcggggtaaccgggtttcgggtaccgggggaacccgaaacggggtaacccgtaccggtaccgtacgttcccggtaccctaccccgaccggtaacccctacccgaaacccggtaaacccgggaccccgtacggttaccccggttcccccgttcccccggttcgggccccgtccccgtaacggtcccgtaccccggaaacgggtcccgaacccgtaaccccgg

SEQ ID NO: 298339 - DNA, 546 bp, Homo sapiens
  misc_feature: GZ8MTXP02I8IEX.19.26.C04.1.454.CMB.2.raw
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
  modified_base (357)..(357): a, c, t, g, unknown or other
  misc_feature (357)..(357): n is a, c, g, or t
  modified_base (485)..(485): a, c, t, g, unknown or other
  misc_feature (485)..(485): n is a, c, g, or t
  modified_base (490)..(490): a, c, t, g, unknown or other
  misc_feature (490)..(490): n is a, c, g, or t
  modified_base (533)..(533): a, c, t, g, unknown or other
  misc_feature (533)..(533): n is a, c, g, or t
  modified_base (544)..(544): a, c, t, g, unknown or other
  misc_feature (544)..(544): n is a, c, g, or t
tcagtactctcgtgcacgaccggtgctcgatttagtctagcgactttgggtttgggctgagcgtgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggaagtaaatatattatggagactcgtgaaggccgattcacatcncagagacaattccaaagaacacagtggatctagacaaatgaacagccngagagcgtgggggacacgggctgtgtattagtgtgcgagagcggcgtggacaactacactacctacgttacggtttacggtacgtcgttcggggacgaacggaccgacggtacgacgtcgtcctcccncgccnccaccacggaccgactccgtccgtccctccgccgccgtcgccncgacgacgacncg

SEQ ID NO: 298340 - DNA, 506 bp, Homo sapiens
  misc_feature: GZ8MTXP02HVWC3.19.26.C04.1.454.CMB.2.raw
  modified_base (294)..(294): a, c, t, g, unknown or other
  misc_feature (294)..(294): n is a, c, g, or t
  modified_base (317)..(317): a, c, t, g, unknown or other
  misc_feature (317)..(317): n is a, c, g, or t
  modified_base (333)..(333): a, c, t, g, unknown or other
  misc_feature (333)..(333): n is a, c, g, or t
  modified_base (354)..(354): a, c, t, g, unknown or other
  misc_feature (354)..(354): n is a, c, g, or t
  modified_base (364)..(364): a, c, t, g, unknown or other
  misc_feature (364)..(364): n is a, c, g, or t
  modified_base (388)..(388): a, c, t, g, unknown or other
  misc_feature (388)..(388): n is a, c, g, or t
  modified_base (393)..(393): a, c, t, g, unknown or other
  misc_feature (393)..(393): n is a, c, g, or t
  modified_base (395)..(395): a, c, t, g, unknown or other
  misc_feature (395)..(395): n is a, c, g, or t
  modified_base (403)..(403): a, c, t, g, unknown or other
  misc_feature (403)..(403): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (422)..(422): a, c, t, g, unknown or other
  misc_feature (422)..(422): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggtttcctcgttgctctttaagaggtgtccagtgtcaggtgcacctggtggagtctgggggagcgtggtccagcctgggaggtccctgagactctcctgtgcagcctctggattcaccttcagtagctttggcatccactgggtccncagctcgaggcaaggggctaggnggtgggtgctagttanatcatatgatggaagtaaatntattatgganactcgtagaagggcattcacatcncagananactacaanaacacagagatntnanaanagaacagacagagagcgagggacgacgcgtgtgtattacgtgtcgcgacgagcggcgtcgacgactactactactacgttacgg

SEQ ID NO: 298341 - DNA, 546 bp, Homo sapiens
  misc_feature: GZ8MTXP02HIRI9.19.26.C04.1.454.CMB.2.raw
  modified_base (306)..(306): a, c, t, g, unknown or other
  misc_feature (306)..(306): n is a, c, g, or t
  modified_base (512)..(512): a, c, t, g, unknown or other
  misc_feature (512)..(512): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccgccaggctccaggcaaggggctagagtgggtggcagttatatcatatgatggagtaaaatatatatggagactcgtgaaggccgatcaccatcncagagacaatccaaagaacacagtggatctgacaaaatgaaacagcctgagagctgggggacacggctgtgtattactgtgcgagagcggctggcaaactacataccatttacgggtttggacgtctgggggacccaaagggaccacggtcatccgtctcccccagccctccaccaaacgggccccaatccggtcctttcccccgngggcccgcccgtcgacctccgacgacgacgaccg

SEQ ID NO: 298342 - DNA, 554 bp, Homo sapiens
  misc_feature: GZ8MTXP02G9OPM.19.26.C04.1.454.CMB.2.raw
  modified_base (282)..(282): a, c, t, g, unknown or other
  misc_feature (282)..(282): n is a, c, g, or t
  modified_base (356)..(356): a, c, t, g, unknown or other
  misc_feature (356)..(356): n is a, c, g, or t
  modified_base (521)..(521): a, c, t, g, unknown or other
  misc_feature (521)..(521): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgactttgggtttgggctgagcgtgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggagtaaatatatatganactcgtgaaggccattcaccatctccagagacaattccaaagacacagtgatctgacaaatgaaacagcctagngagcgtgggggacacgggctgtagtattacgtgtgcgagagcggctggacaactacataccgtagttacggtttggacgtcgtcgggggaccaaggggaccacgggtcacgtccgtacctccccgagtccctccaccgaacgggcccatccggtcccttcccccngggccccgccgtcgcctccgacggacnccaccg

SEQ ID NO: 298343 - DNA, 548 bp, Homo sapiens
  misc_feature: GZ8MTXP02I4HKY.19.26.C04.1.454.CMB.2.raw
  modified_base (302)..(302): a, c, t, g, unknown or other
  misc_feature (302)..(302): n is a, c, g, or t
  modified_base (368)..(368): a, c, t, g, unknown or other
  misc_feature (368)..(368): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (400)..(400): a, c, t, g, unknown or other
  misc_feature (400)..(400): n is a, c, g, or t
  modified_base (405)..(405): a, c, t, g, unknown or other
  misc_feature (405)..(405): n is a, c, g, or t
  modified_base (423)..(423): a, c, t, g, unknown or other
  misc_feature (423)..(423): n is a, c, g, or t
  modified_base (473)..(473): a, c, t, g, unknown or other
  misc_feature (473)..(473): n is a, c, g, or t
  modified_base (505)..(505): a, c, t, g, unknown or other
  misc_feature (505)..(505): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctggacttcaccttcagtagctttggcatcccacgtcgggtcccnccgaggcctccgaggcgaaggggctaggaggtgggtgcagttatatcatatgataggaagtaaatntattangganactcgtagaaggcatcacatcncaganacatccaaagacacgagngatactagactaaatgaacagacctaggacgagcgtaggggacacgggtntacggtagttaagttacgtggtaggcggaagnggcggcgtacggactaacgtacacgtaccgttaggtttacggg

SEQ ID NO: 298344 - DNA, 566 bp, Homo sapiens
  misc_feature: GZ8MTXP02HHX4B.19.26.C04.1.454.CMB.2.raw
  modified_base (214)..(214): a, c, t, g, unknown or other
  misc_feature (214)..(214): n is a, c, g, or t
  modified_base (552)..(552): a, c, t, g, unknown or other
  misc_feature (552)..(552): n is a, c, g, or t
  modified_base (563)..(563): a, c, t, g, unknown or other
  misc_feature (563)..(563): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggaaggtaaaatatattatggagactccgtagaaggccgattcaccatctcagagacaatccaaagaacacagtggatctgacaaatgaacagcctagagagctagggggacacggctgtgtattacgtgtgcgagagcggctggacaactacataccagttaacggtttggtacgtcgtcggggaccgaaacgggaccgaacgggtcacgttccgtccgtccccacggtccctacccgaccgaaacgggcccaacgtccggtactcccccgtggcccgccctcgcccncgacgacgacnccg

SEQ ID NO: 298345 - DNA, 538 bp, Homo sapiens
  misc_feature: GZ8MTXP02GAYKW.19.26.C04.1.454.CMB.2.raw
  modified_base (253)..(253): a, c, t, g, unknown or other
  misc_feature (253)..(253): n is a, c, g, or t
  modified_base (532)..(532): a, c, t, g, unknown or other
  misc_feature (532)..(532): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttanatcatatgatggaggtaaaatatattatggagactccgtgaaggccgattcaccatctcagagacaattccaaagaacacagtggatctgacaaaatgaaacagcctgagagcgtggggacacggctgtgtattactgtgcgagagcggctggacaactacataccattacggttggacgttcgtggggaccaaagggccacggtcatccgtctccccagccctccaccgaacggcccagtccggtcctcccccgtggcccgccctgcctccgacggcncacccg

SEQ ID NO: 298346 - DNA, 579 bp, Homo sapiens
  misc_feature: GZ8MTXP02JRMQZ.19.26.C04.1.454.CMB.2.raw
  modified_base (279)..(279): a, c, t, g, unknown or other
  misc_feature (279)..(279): n is a, c, g, or t
  modified_base (283)..(283): a, c, t, g, unknown or other
  misc_feature (283)..(283): n is a, c, g, or t
  modified_base (294)..(294): a, c, t, g, unknown or other
  misc_feature (294)..(294): n is a, c, g, or t
  modified_base (297)..(297): a, c, t, g, unknown or other
  misc_feature (297)..(297): n is a, c, g, or t
  modified_base (308)..(308): a, c, t, g, unknown or other
  misc_feature (308)..(308): n is a, c, g, or t
  modified_base (312)..(312): a, c, t, g, unknown or other
  misc_feature (312)..(312): n is a, c, g, or t
  modified_base (321)..(321): a, c, t, g, unknown or other
  misc_feature (321)..(321): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcggtggtttcgtcgtaggctctttaagaggtgtccagtgtcaggtgcacctggtggagtcgtgggggagcgtggtccagcctggggaggtccctgagactctcctgtgcagctctgatcacttcatagcttggcnctcncgtcggcgcgngcncgacgcgaggngagnggtggtggngtagtatatatatatagtagtagtaagtaaataatattagtggtagtacgtacgtagacggtacgtactacacctactactacgacgacgaactaactaaccaaacgaaacaacgagtagtagtactacgacaagtagaacgacgacgtagagacggacggtacgggacgacggtacgtacgtagttagttacgtaggtacggtacgacggacggcggcggtacggacgtaacgtacgtacgtaccgttacgttacgg

SEQ ID NO: 298347 - DNA, 521 bp, Homo sapiens
  misc_feature: GZ8MTXP02F8CAO.19.26.C04.1.454.CMB.2.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctggggaggtccctgagactctcctgtgcagcctctggattcaccttcagtagctttggcatccactgggtccnccaggctccaggcaaggggctagagtgggtggcagttanatcatatgatggagtaaatntatatgganactcgngaagggcattcacatctcagagacaattccaaagaacacagtggaatctagacaaatgaaacagaccctgagagcgtggggacacggctagtgtattactggtgcgagaggcggcgtggacaacgtacactaccgtagtttaaccgggg

SEQ ID NO: 298348 - DNA, 639 bp, Homo sapiens
  misc_feature: GZ8MTXP02FIXQT.19.26.C04.1.454.CMB.2.raw
  modified_base (191)..(191): a, c, t, g, unknown or other
  misc_feature (191)..(191): n is a, c, g, or t
  modified_base (249)..(249): a, c, t, g, unknown or other
  misc_feature (249)..(249): n is a, c, g, or t
  modified_base (256)..(256): a, c, t, g, unknown or other
  misc_feature (256)..(256): n is a, c, g, or t
  modified_base (277)..(277): a, c, t, g, unknown or other
  misc_feature (277)..(277): n is a, c, g, or t
tcagtactctcgtgcacgaccggtgctcgatttagtctagcgactttgggtttgggctgagcgtggtttcgtcgtaggctctttaagaggtgtccagtgtcaggtgcacctggtggagtctggggaggcgtggtccagcctgggaggtccctgagactctcctgtgcagcctctggattcaccttcagtanctttggcatccactggtccgccaggctccaggcaaggggctagagtgggtgcagttanatcatangatggaagtaaatatattagnggacgactccggtaggacgggtccattccaccatcctccgagacgacctaacttacccaaaggaaccacgaggtggtactctcgacaactacgaacacgccgtgagacgcggtcgggtacgacgtcgtgttagttattacgttggtggacggacggacggcggcgtcggacgaacctacctactacctacgttacggtttacggtacgtcggtcggggtaccggaccgggaccgtaccggtacgtacgtaccgtcccgtaccccgaccgaccctacccgacccgaaccggacccgaccgtcccgttcccgtcccccgtcccggtcccgcccgtccgtccgtaccgacggaccgaccgacccg

SEQ ID NO: 298349 - DNA, 610 bp, Homo sapiens
  misc_feature: GZ8MTXP02JK8L4.19.26.C04.1.454.CMB.2.raw
  modified_base (257)..(257): a, c, t, g, unknown or other
  misc_feature (257)..(257): n is a, c, g, or t
  modified_base (295)..(295): a, c, t, g, unknown or other
  misc_feature (295)..(295): n is a, c, g, or t
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (356)..(356): a, c, t, g, unknown or other
  misc_feature (356)..(356): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggtttcgtcgtaggctctttaagaggtgtccagtgtcaggtgcacctggtggagtctgggggaggcgtggtccagcctgggaggtccctgagactctcctgtgcagcctntggattcaccttcagtgctttggcatccatgggtcccncngctcgaggcgagggctaggaggtggtgctagttatatcatangagtaggaagtaaaatntaattagtggactacgtccggtaggaacgggtccgtattaccaacctactcctacgaagacgtaactaaacttaccgaaaagaaaccacgtagtacggtaactacgtacgaacgtaaagtaacgaacgaacgacgtacgaggaggacggtacgggacggacggtacgtacggttagttagttacgtaggtacggtacggtacggacggacggcggtacggtacgtaacgtaacgtacgtaccgtacgtttacgg

SEQ ID NO: 298350 - DNA, 522 bp, Homo sapiens
  misc_feature: GZ8MTXP02JR23A.19.26.C04.1.454.CMB.2.raw
  modified_base (297)..(297): a, c, t, g, unknown or other
  misc_feature (297)..(297): n is a, c, g, or t
  modified_base (339)..(339): a, c, t, g, unknown or other
  misc_feature (339)..(339): n is a, c, g, or t
  modified_base (346)..(346): a, c, t, g, unknown or other
  misc_feature (346)..(346): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttcagtagctttggcatccacgtgggtccnccaggcctccgaggcaaggggctagaggtgggtggcagttanatcatangatggaagtaaatntattatgganactcgagaaggccatcacatctcaganacatccaagaacacagtgatctagacaaatgaacagcctagagagcgtaggggacacggctggtagtattacgtgtagcgaggcgcggcgtaggaccaacgtacgactaccgtagtttaccgggg

SEQ ID NO: 298351 - DNA, 632 bp, Homo sapiens
  misc_feature: GZ8MTXP02I7VYG.19.26.C04.1.454.CMB.2.raw
  modified_base (215)..(215): a, c, t, g, unknown or other
  misc_feature (215)..(215): n is a, c, g, or t
tcagtactctcgtgcacgaccggtgctcgatttagtctagcgactttgggtttgggctgagcgtgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggagtaaaatatattatggagactccgtgaagggccgattcaccatctcagagacaattccaaagaacacagtgatctgacaaatgaacagcctagagagcgtagggggacacgggctgtgtattactgtgcgagagcggctggacaactacactacctaagtttacgggtttaggtacgtcgtcgggggaccgaaacggggacccgtaacgggtccaacgttccggtcccttacccccgaacggtcccctaccccgaacccggaaacccggggacccctaacggttcccggttaccccgttccccccgttcgggccccgtcccccgttcggtcccctacccggacgggaccggaccctaacccccgg

SEQ ID NO: 298352 - DNA, 548 bp, Homo sapiens
  misc_feature: GZ8MTXP02I8609.19.26.C04.1.454.CMB.2.raw
  modified_base (253)..(253): a, c, t, g, unknown or other
  misc_feature (253)..(253): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttanatcatatgatggaggtaaaatatattatggagactccgtgaagggccgattcacatctccagagacaattccaaagaacacagtgatctgacaaatgaaacagacctgagagcgtaggggacacgggctgtgtattactgtgcgagagcggctggcaactacgatcctagttacggttggacgtcgtggggaccaagggaccacggtcagtccgtcctccccgagcctccgaccaacgggcccacgtccggtccttcccccgtggccgcccctcgcctccgacggacgcaacccg

SEQ ID NO: 298353 - DNA, 506 bp, Homo sapiens
  misc_feature: GZ8MTXP02GUBHG.19.26.C04.1.454.CMB.2.raw
  modified_base (297)..(297): a, c, t, g, unknown or other
  misc_feature (297)..(297): n is a, c, g, or t
  modified_base (344)..(344): a, c, t, g, unknown or other
  misc_feature (344)..(344): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (395)..(395): a, c, t, g, unknown or other
  misc_feature (395)..(395): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctaggagtgggtggcagttatatcatangatggagtaaatntattangganactcgtgaagggcattcacatctcaganacaatccaagaacacagtgatctgacaaatgaacagcctgagagcgtggggacacggctgtgtattactggtgcgagagcggcgtggacactacgactccgtatttacggg

SEQ ID NO: 298354 - DNA, 523 bp, Homo sapiens
  misc_feature: GZ8MTXP02IFDU3.19.26.C04.1.454.CMB.2.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (359)..(359): a, c, t, g, unknown or other
  misc_feature (359)..(359): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactgggtccnccaggctccaggcaaggggctagagtgggtggcagttanatcatatgatggaagtaaaatntattatgganactcgtgaaggggcattcaccanctcagagacaattccaaagaacacagtggatctagacaaatagaacagcctagagagcgtggggacacgggaactggtagtattactggtgcgacgagcggcgtggacgactacactactacgtttacggg

SEQ ID NO: 298355 - DNA, 598 bp, Homo sapiens
  misc_feature: GZ8MTXP02FSIYZ.19.26.C04.1.454.CMB.2.raw
  modified_base (214)..(214): a, c, t, g, unknown or other
  misc_feature (214)..(214): n is a, c, g, or t
  modified_base (284)..(284): a, c, t, g, unknown or other
  misc_feature (284)..(284): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttatatcatatgatggaggtaaaatatattatgganactccgtgaaggccgattcacatctccagagacaattccaaagaacacagtggatctgacaaatgaaacagcctagagagcgtgggggaccacgggtctgtgtattactgtgcgagagcggctggacaactacatcccaattacggtttggacgttcgtacgggggacctaaacggggaccaacgggtaaactccggtcctacccccgaacgccctaccaaccccgaaaaggggcccccaaagtccgggttcccttcccccgtcggtcccgccccgttcggccttacccgagggacgccgtaccctaacccggg

SEQ ID NO: 298356 - DNA, 426 bp, Homo sapiens
  misc_feature: GZ8MTXP02JB1LQ.19.26.C04.1.454.CMB.2.raw
  modified_base (417)..(426): a, c, t, g, unknown or other
  misc_feature (417)..(426): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagaacacagtgatctgcaaatgaacagcctgagagctggggacacggctgtgtattactgtgcgagagcgggctggcaaggcgcagtagnnnnnnnnnn

SEQ ID NO: 298357 - DNA, 600 bp, Homo sapiens
  misc_feature: GZ8MTXP02IMQYI.19.26.C04.1.454.CMB.2.raw
  modified_base (284)..(284): a, c, t, g, unknown or other
  misc_feature (284)..(284): n is a, c, g, or t
  modified_base (391)..(391): a, c, t, g, unknown or other
  misc_feature (391)..(391): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggagtaaaatatattatgganactccgtgaaggccgattcaccatctccagagacaattccaaagaacacagtggatctgacaaatgaaacagcctagacgagctggggacacgggctgtatattacngtgcgagagcggctggcaaactacataccagttacggtttggacgtcgtgggggacccaaagggaccacgggtcaacgtcgtacctccccacgtccctaccaacccgaaacggggcccctaaacggttcccggttaccctttccccccgtcggggtcccgtcccccgttcggtccccttaccgaccggggtacgacccgtaacccccgg

SEQ ID NO: 298358 - DNA, 525 bp, Homo sapiens
  misc_feature: GZ8MTXP02FTX09.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaaagaacacagtggatctgacaaatgaaacagccctagagagctgggggacacgggctgtgtattactgtgcgagagcggctggcaactacatccattacggtttggacgtcgtagggggaccaagggaccacggtcatcgtactcccagcctcaccacggccatccgtctcccctgcgccctgctcacggacgcaccg

SEQ ID NO: 298359 - DNA, 508 bp, Homo sapiens
  misc_feature: GZ8MTXP02IM6UA.19.26.C04.1.454.CMB.2.raw
  modified_base (297)..(297): a, c, t, g, unknown or other
  misc_feature (297)..(297): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
  modified_base (384)..(384): a, c, t, g, unknown or other
  misc_feature (384)..(384): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggagtccctgagactctcctgtgcagcctctggattcaccttcagtagctttggcatccactgggtccnccaggctccaggcaaggggctagagtgggtgcagttatatcatatgatggagtaaatatattangganactcgtgaaggcattcacntctcagagacatccaagacacagtgatctgacaatgaacagctagagagcgtgggacacggctgtacgtattacgtgtcgacgagagcggcgtcggactaacgtacacgtacctaagtttacgg

SEQ ID NO: 298360 - DNA, 529 bp, Homo sapiens
  misc_feature: GZ8MTXP02GM77C.19.26.C04.1.454.CMB.2.raw
  modified_base (298)..(298): a, c, t, g, unknown or other
  misc_feature (298)..(298): n is a, c, g, or t
  modified_base (338)..(338): a, c, t, g, unknown or other
  misc_feature (338)..(338): n is a, c, g, or t
  modified_base (359)..(359): a, c, t, g, unknown or other
  misc_feature (359)..(359): n is a, c, g, or t
  modified_base (365)..(365): a, c, t, g, unknown or other
  misc_feature (365)..(365): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactgggtccnccaggctccaggcaaggggctaggagtgggtggcagttanatcatatgatggaagtaaatntattanggggactcgtgaagggccattcacatctccagagacaattacaagaacacagtagaatctagacaaatgaacagcctagagagcgtaggggacgacggcgtgtgtattacgtgtgacgagacggcggacgtggacaacgtacatacctagtttacggtttacgg

SEQ ID NO: 298361 - DNA, 572 bp, Homo sapiens
  misc_feature: GZ8MTXP02GX8AG.19.26.C04.1.454.CMB.2.raw
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (407)..(407): a, c, t, g, unknown or other
  misc_feature (407)..(407): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctggggagtccctgagactctcctgtgcagcctntggattcaccttcagtagtctttggcatccacgtcgggtccnccaggcctccgaggcgaaggggctaggaggtgggtgctagttanatcatatgatggaagtaaaatntattagngganactcgtagaacgggcatcacatcacaganacaatacaaagaacacagtgatctagactaaatagaaacagaccgtagagacgacggtaggggaacgacggtcgttaggttagttattacgtggtacggacgaaggacggcggaacgtacgggaacctaaactacgtaacgttaccgtaacggttttaaccgggg

SEQ ID NO: 298362 - DNA, 549 bp, Homo sapiens
  misc_feature: GZ8MTXP02JJT65.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaaatatattatggagactccgtgaaggccgattcaccatctccagagacaattccaaagaacacagtggatctgcaaatgaacagcctgagagcgtggggacacggctgtgtatactgtgcgagagcggctggcaactacataccagttacggtttggacgtcgtgggggaccaagggaccacgggtcagtccgtacctccccaggccctaccgaccgaaacgggccccacgtccgtcccttcccccgtggcccgccctcgcctccgacggcgccacccg

SEQ ID NO: 298363 - DNA, 590 bp, Homo sapiens
  misc_feature: GZ8MTXP02HCKLV.19.26.C04.1.454.CMB.2.raw
  modified_base (275)..(275): a, c, t, g, unknown or other
  misc_feature (275)..(275): n is a, c, g, or t
  modified_base (285)..(285): a, c, t, g, unknown or other
  misc_feature (285)..(285): n is a, c, g, or t
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatntattatgganactccgtgaagggccgattcaccatctccaagagacaattccaaagaacacagtggatctgacaaatgaacagcctagagagcgtgggggacacgggctgtgtattactgtgcgagagcggctggacaaactacactaccagtttacgggttcggtacgtcgtcgggggaccaaaggggacccacgggttcaacgttccgtccctccccgacgtaccctacccgaccgaaacggggccccaacgttcccggtcccttccccccgtggccccgcccgtcgccctaccgaacggccgaccaccccgg

SEQ ID NO: 298364 - DNA, 578 bp, Homo sapiens
  misc_feature: GZ8MTXP02ID8LA.19.26.C04.1.454.CMB.2.raw
  modified_base (286)..(286): a, c, t, g, unknown or other
  misc_feature (286)..(286): n is a, c, g, or t
  modified_base (400)..(400): a, c, t, g, unknown or other
  misc_feature (400)..(400): n is a, c, g, or t
  modified_base (499)..(499): a, c, t, g, unknown or other
  misc_feature (499)..(499): n is a, c, g, or t
  modified_base (542)..(542): a, c, t, g, unknown or other
  misc_feature (542)..(542): n is a, c, g, or t
  modified_base (550)..(550): a, c, t, g, unknown or other
  misc_feature (550)..(550): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagcttttggcatccactggggtccgccaggctccgaggcaaggggctaggagtgggtggcagttatatcatatgatggagtaaatatatatgganactcgtgaaggccgattcaccatctccaagagaacaattaccaaagaacacagtaggatctagacaaatgaacagcctagagacgcgtgggggacacgggctagtgtattacgngtgcgagagcggctggacaacgtacatcctaagtttacggttgggacgttcggtggggaccgaaagggaccgacggtacacgtccgtacctccccgacnccctacccgaccgaacggccccacgtccggtccctttccccgngggtcccnccctcgcctaccgacggacgcccacccg

SEQ ID NO: 298365 - DNA, 515 bp, Homo sapiens
  misc_feature: GZ8MTXP02JI7BU.19.26.C04.1.454.CMB.2.raw
  modified_base (297)..(297): a, c, t, g, unknown or other
  misc_feature (297)..(297): n is a, c, g, or t
  modified_base (337)..(337): a, c, t, g, unknown or other
  misc_feature (337)..(337): n is a, c, g, or t
  modified_base (357)..(357): a, c, t, g, unknown or other
  misc_feature (357)..(357): n is a, c, g, or t
  modified_base (367)..(367): a, c, t, g, unknown or other
  misc_feature (367)..(367): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctaggagtggggtgcagttanatcatatgatggagtaaatntattatgganactcgtgaaggccatcacatctcagagacaatccaagaacacagtggatctagacaaatgaacagacctagagagcgtaggggaccgaggctagtgtattacgtggtgcgacgagcggaacgtggacaactacactccagtttacggg

SEQ ID NO: 298366 - DNA, 396 bp, Homo sapiens
  misc_feature: GZ8MTXP02JGEP8.19.26.C04.1.454.CMB.2.raw
  modified_base (388)..(388): a, c, t, g, unknown or other
  misc_feature (388)..(388): n is a, c, g, or t
  modified_base (392)..(396): a, c, t, g, unknown or other
  misc_feature (392)..(396): n is a, c, g, or t
tcagtactctcgtgcacgaccggtgctcgatttagtctagcgactttgggtttgggggtgtggtggtctccactcccgccttgacggggctgttatctgccttccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgattttcggcggagggaccaagctgaccgtcctaggtcagccccaaggctgccccctggtcactctgttccccgccctcctccacgagagtactgagcgggctggcaaggcgcntagnnnnn

SEQ ID NO: 298367 - DNA, 516 bp, Homo sapiens
  misc_feature: GZ8MTXP02FX4AL.19.26.C04.1.454.CMB.2.raw
  modified_base (298)..(298): a, c, t, g, unknown or other
  misc_feature (298)..(298): n is a, c, g, or t
  modified_base (322)..(322): a, c, t, g, unknown or other
  misc_feature (322)..(322): n is a, c, g, or t
  modified_base (367)..(367): a, c, t, g, unknown or other
  misc_feature (367)..(367): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccnccaggctccaggcaaggggctagngtgggtgcagttatatcatatgatggaagtaaatatattatgganactcgtagaacggcatcacatctcagagacatacaagaacacagtgatctagacaaatagaacagcctagagagacgtaggggacgacggctgtagtattacgtggtagcgagaggcggcgtggacaactacactcctaagtttacggg

SEQ ID NO: 298368 - DNA, 514 bp, Homo sapiens
  misc_feature: GZ8MTXP02GRYO7.19.26.C04.1.454.CMB.2.raw
  modified_base (297)..(297): a, c, t, g, unknown or other
  misc_feature (297)..(297): n is a, c, g, or t
  modified_base (336)..(336): a, c, t, g, unknown or other
  misc_feature (336)..(336): n is a, c, g, or t
  modified_base (343)..(343): a, c, t, g, unknown or other
  misc_feature (343)..(343): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (366)..(366): a, c, t, g, unknown or other
  misc_feature (366)..(366): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctaggagtgggtgcagttanatcatangatggagtaaatntattangganctcgtgaagggcattcacatctcagagacatccaagaacacagtggatctagacaaatgaaacagacctagagagcgtgggggacacggctgtgtattacgtgtacgcgacgagcggcgtggacaacgtacactcctaagtttacggg

SEQ ID NO: 298369 - DNA, 524 bp, Homo sapiens
  misc_feature: GZ8MTXP02HHH9O.19.26.C04.1.454.CMB.2.raw
  modified_base (261)..(261): a, c, t, g, unknown or other
  misc_feature (261)..(261): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (463)..(463): a, c, t, g, unknown or other
  misc_feature (463)..(463): n is a, c, g, or t
tcagtactctcgtgcacgaccggtgctcgatttagtctagcgactttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggaggcgtggtccagcctgggaggtccctgagactctcctgtgcagcctntggattcaccttcagtagctttggcatccactcggggtcccnccaggcctccgaggcaaggggctagagtgggtgcagttanatcatangatggaagtaaatntattangganactcgtagaagggcatcacatctcagagacatccaagaacacagtgatcgtagacaaatgaacagcctagagagcgtaggggacacggntaggtgtattacgtggtcgcgagagcggcgtcggacaacgtacactaccgtagtttacggg

SEQ ID NO: 298370 - DNA, 543 bp, Homo sapiens
  misc_feature: GZ8MTXP02I280C.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaaggccgattcaccatctccagagacaattccaagaacacagtggatctgacaaatgaaacagcctgagagcgtgggggacacgggctgtgtattactgtgcgagagcggctggcaacgtacatccatttacggttggacgtcgtggggaccaagggaccacggtcatcgtctccccagccctaccaccgaacgggcccacgtccggtccttcccccgtggccgccccgtgcctccgacggacgcacccg

SEQ ID NO: 298371 - DNA, 578 bp, Homo sapiens
  misc_feature: GZ8MTXP02JJXAC.19.26.C04.1.454.CMB.2.raw
  modified_base (309)..(309): a, c, t, g, unknown or other
  misc_feature (309)..(309): n is a, c, g, or t
  modified_base (382)..(382): a, c, t, g, unknown or other
  misc_feature (382)..(382): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtgggttttcctcgttgcttcttttaagaggtgtccagtgtcaggtgcacctggtggagtcgtgggggagcgtggtccaggccgtggggacggtccctgacgactctcctgtgcagcctctggattcaccttcagtagctttggctactccacgtcgggtcccnccgaggcctccgaggcgaaggggctaggaggtgggtgctagttatatcgaatagtgagtaggaaagtaaaatnttagttagtcgggaagtaccgtccggtaggaacggggtctattaccacctatcctaccgaaggacaactaactaccaaagaacagagtgactcgtagaacaaatagaacgacgacgagagagacgagggacgacgcgtcgtagtagttacgtgtcgacgacgagcggcgacgacactacactacgtacgtttacgg

SEQ ID NO: 298372 - DNA, 583 bp, Homo sapiens
  misc_feature: GZ8MTXP02GRLR0.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaaagaacacagtggatctgcaaatgaacagcctgagagctgggggacacgggctgtgtattactgtgcgagagcggctggcaacgtacataccattacggtttggacgtcgtgggggacccaaggggacccgacggtcaacgtccgtcctacccccacggccctacccgacccgaaacggggccccaacgtcccggttccttccccccgttgggcccgcccccgttcggcccgttcccgacggacggcctaaccccg

SEQ ID NO: 298373 - DNA, 558 bp, Homo sapiens
  misc_feature: GZ8MTXP02F9KAB.19.26.C04.1.454.CMB.2.raw
  modified_base (299)..(299): a, c, t, g, unknown or other
  misc_feature (299)..(299): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (370)..(370): a, c, t, g, unknown or other
  misc_feature (370)..(370): n is a, c, g, or t
  modified_base (374)..(374): a, c, t, g, unknown or other
  misc_feature (374)..(374): n is a, c, g, or t
  modified_base (400)..(400): a, c, t, g, unknown or other
  misc_feature (400)..(400): n is a, c, g, or t
  modified_base (424)..(424): a, c, t, g, unknown or other
  misc_feature (424)..(424): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagcttggcatcccactgggtcccnccaggctccgaggcaaggggctaggaggtggggtgcaggttatatcatangatggaagtaaaatntattangganactcgtagaagggccattcaccatcncagagacaatccaaagaacacagngatctagacaaatgaaacagacctagagacggcgtagggggaacacgggctaggtagttattacgtggttaggaccgaggacggcgggtaacgtcggacctaaacgtactacgttacccgtaagtttaccgggg

SEQ ID NO: 298374 - DNA, 526 bp, Homo sapiens
  misc_feature: GZ8MTXP02JWKUX.19.26.C04.1.454.CMB.2.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (426)..(426): a, c, t, g, unknown or other
  misc_feature (426)..(426): n is a, c, g, or t
  modified_base (484)..(484): a, c, t, g, unknown or other
  misc_feature (484)..(484): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatcccactggggtccnccaggcctccgaggcgaaggggctaggaggtggggtggcagttatatcatatgatggagtaaaatntattatgganactcgtgaagggccattccacatctcagagacaattccaagaacacgtagnggatctagacaaatgaacagacctagagacgcgtaggggacacggctgtgtattacgngtcgcgagacgcggcgtggacacgtacactactagtttacgg

SEQ ID NO: 298375 - DNA, 527 bp, Homo sapiens
  misc_feature: GZ8MTXP02JD6TF.19.26.C04.1.454.CMB.2.raw
  modified_base (249)..(249): a, c, t, g, unknown or other
  misc_feature (249)..(249): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
  modified_base (403)..(403): a, c, t, g, unknown or other
  misc_feature (403)..(403): n is a, c, g, or t
  modified_base (430)..(430): a, c, t, g, unknown or other
  misc_feature (430)..(430): n is a, c, g, or t
  modified_base (432)..(432): a, c, t, g, unknown or other
  misc_feature (432)..(432): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggtttcgcgttagcgtctttaagaggtgtcagtgtcaggtgcacctggtggagtcgtgggggagcgtggtccagcctgggagtcctgagactctcctgtgcngctctgtntctctcagtgtctgcnctcncgtcggtccgcgcgcncgacgacgaggacgtagaggtggtggtagtagtatatatatagtagagtagtaagtaaatatattagtgtagacgtacgtagacgacgtactacactactacacagacanactacaacgaacacagtagatatagananagacacgacgagagagcgaggacgacgtcgtacgtagtagtacgtgtcgacgacgacgcggtcgtacgacgtactactacgtacgtacgttacgg

SEQ ID NO: 298376 - DNA, 551 bp, Homo sapiens
  misc_feature: GZ8MTXP02IYOMC.19.26.C04.1.454.CMB.2.raw
  modified_base (300)..(300): a, c, t, g, unknown or other
  misc_feature (300)..(300): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (393)..(393): a, c, t, g, unknown or other
  misc_feature (393)..(393): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggaggtccctgagactctcctgtgcagcctctggattcaccttcagtagctttggcatccacgtgggtccnccaggcctccgaggcgaaggggctaggagtgggtgcagttatatcatatgatggaagtaaatntattangganactcgagaggcatcacatcncagagacaattacaagaacacagtagatctagacaaatagaacagacctaggagagacggtaggggaacgacgggtcgtaggttagttaattacgtggtcggacggaggacggcggcgtacgggacctaaactactactaccgtaacgttttacgggg

SEQ ID NO: 298377 - DNA, 535 bp, Homo sapiens
  misc_feature: GZ8MTXP02JL6QB.19.26.C04.1.454.CMB.2.raw
  modified_base (508)..(508): a, c, t, g, unknown or other
  misc_feature (508)..(508): n is a, c, g, or t
  modified_base (530)..(530): a, c, t, g, unknown or other
  misc_feature (530)..(530): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaatatattatggagactcgtgaaggccgattcacatctccagagacaattccaagaacacagtggatctgcaaatgaacagcctgagagctgggggacacggctgtgtatactgtgcgagagcgctggcaactacatccatttacggtttggacgttcgtgggggaccaaggggaccacggtcactccgtactcccagccctcaccgaacggcccactccggtcctccccgtggcccnccctcggcctacccgaggaccncaccg

SEQ ID NO: 298378 - DNA, 562 bp, Homo sapiens
  misc_feature: GZ8MTXP02FP395.19.26.C04.1.454.CMB.2.raw
  modified_base (216)..(216): a, c, t, g, unknown or other
  misc_feature (216)..(216): n is a, c, g, or t
  modified_base (277)..(277): a, c, t, g, unknown or other
  misc_feature (277)..(277): n is a, c, g, or t
  modified_base (287)..(287): a, c, t, g, unknown or other
  misc_feature (287)..(287): n is a, c, g, or t
  modified_base (293)..(293): a, c, t, g, unknown or other
  misc_feature (293)..(293): n is a, c, g, or t
  modified_base (310)..(310): a, c, t, g, unknown or other
  misc_feature (310)..(310): n is a, c, g, or t
  modified_base (315)..(315): a, c, t, g, unknown or other
  misc_feature (315)..(315): n is a, c, g, or t
  modified_base (331)..(331): a, c, t, g, unknown or other
  misc_feature (331)..(331): n is a, c, g, or t
  modified_base (392)..(392): a, c, t, g, unknown or other
  misc_feature (392)..(392): n is a, c, g, or t
  modified_base (492)..(492): a, c, t, g, unknown or other
  misc_feature (492)..(492): n is a, c, g, or t
tcagtactctcgtgcacgaccggtgctcgatttagtctagcgactttgggtttgggctgagcgtgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccnccaggctccaggcaaggggctagagtgggtggcagttatatcatatgatggaagtaaaatntattatgganactcgngaagggccatcacatcncaganacaataccaagaacanagtggatctgacaaatagaacagcctagagagcgaggggacgacgcgtgtgtattatgtgngagagcggcgtggacaactacactacctagttaacggttggtacggtcggtacggggaccggaacgggaccgacggtcgtactccgtccgtcccacgccnccgaaccgaacggaccgtacgtccggtcccgttcccgtccggccgcccgtcgcgccgacgacgccacccg

SEQ ID NO: 298379 - DNA, 522 bp, Homo sapiens
  misc_feature: GZ8MTXP02GGWIT.19.26.C04.1.454.CMB.2.raw
  modified_base (297)..(297): a, c, t, g, unknown or other
  misc_feature (297)..(297): n is a, c, g, or t
  modified_base (324)..(324): a, c, t, g, unknown or other
  misc_feature (324)..(324): n is a, c, g, or t
  modified_base (338)..(338): a, c, t, g, unknown or other
  misc_feature (338)..(338): n is a, c, g, or t
  modified_base (360)..(360): a, c, t, g, unknown or other
  misc_feature (360)..(360): n is a, c, g, or t
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (392)..(392): a, c, t, g, unknown or other
  misc_feature (392)..(392): n is a, c, g, or t
  modified_base (397)..(397): a, c, t, g, unknown or other
  misc_feature (397)..(397): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatccactgggtccnccaggcctccgaggcaaggggctaggngtgggtgcagttanatcatatgatggaagtaaaatntattngganactcgtagagggcattcacatcncaganacaatccaagacacagtgatctgacaaatgaacagcctagacgagcgtagggacacggctggtagttattacgtgtgacgagacggcggcgtacggactaactacactaccgtagtttaccgggg

SEQ ID NO: 298380 - DNA, 584 bp, Homo sapiens
  misc_feature: GZ8MTXP02GX8R2.19.26.C04.1.454.CMB.2.raw
  modified_base (253)..(253): a, c, t, g, unknown or other
  misc_feature (253)..(253): n is a, c, g, or t
  modified_base (350)..(350): a, c, t, g, unknown or other
  misc_feature (350)..(350): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttanatcatatgatggaggtaaaatatattatggagactccgtgaaggccgattcacatctcagagacaattccaaagaacacagtaggatctgacaaatnaaacagcctagagagcgtggggacacggctgtgtaattactgtgcgagagcggctggacaactacacgtacctagtttaacggtttggacgtcgtacgggggaccaaacggggaccacggtctaacgtccgtcctaccccgacgtccctacccaaccgaaaccggggccccaacgtcccgtcccttcccccgtcggcccgtcccctcgccctccgacggaccgccgtaaccccg

SEQ ID NO: 298381 - DNA, 621 bp, Homo sapiens
  misc_feature: GZ8MTXP02JA2VB.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactccgtgaagggccgattcaccatctccagagacaataccaaagaacacagtggatctgacaaatgaaacagcctagaggagcgtaggggacaggctgtgtattactgtagcgagagcggctggacaactacatacctaagtttaccgggtttggaccggttcgtacggggggaccaaagggggacccaacgggtccaagttcccggtacctcccccaacggtccctacccgaacccaaacggggcccctaacgttcccgggtccctttcccccccggcgggccccgtcccccgtacggtacccctacccgaacgggacccgacccgtaacccg

SEQ ID NO: 298382 - DNA, 535 bp, Homo sapiens
  misc_feature: GZ8MTXP02I4GOJ.19.26.C04.1.454.CMB.2.raw
  modified_base (351)..(351): a, c, t, g, unknown or other
  misc_feature (351)..(351): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgactttgggtttgggctgagcgtggtttcctcgttgctctttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaatatattatggagactccgtgaaggccgattcacatctccagagacaattccaagaacacagtggatctgacaaatgaaacngcctgagagcgtggggacacggctgtgtatactgtgcgaggagcggctggcaactacatccattacggttgacgtcgtggggccaaagggaccgacggtcactcgtcctacccacgtcccaccaccgaaacggcccacgtccggtccttccccgnggccgccctggcctccgaggcgacacccg

SEQ ID NO: 298383 - DNA, 641 bp, Homo sapiens
  misc_feature: GZ8MTXP02HJ3ZR.19.26.C04.1.454.CMB.2.raw
  modified_base (306)..(306): a, c, t, g, unknown or other
  misc_feature (306)..(306): n is a, c, g, or t
  modified_base (382)..(382): a, c, t, g, unknown or other
  misc_feature (382)..(382): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagcctgggaggtccctgagactctcctgtgcagcctctggattcaccttcagtagtctttggctactcccacgtcgggtcccnccgaggcctccgaggccgaaggggctaggaggtggggtgctagttatatcatatgaattagggaaagttaaaaatnttaagttagtgggaatactccggtagaaacggggtccaattccaacctatcctaccaaggaacaactaaacttaccaaagaacaacagtagatctagaactaaaagtacgaaacgagacctaggaagacggacggtacgggggaacacgggtcgttaggttacgttaagtttacgtgggttacgaccggaacggtacggcgggtaaccgtagggaacctaaacgtaacctacgtttacccgttaaggttttacccgggg

SEQ ID NO: 298384 - DNA, 645 bp, Homo sapiens
  misc_feature: GZ8MTXP02I7NPB.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaaggccgattcaccatctccagagacaattcccaaagaacacagtggatctgcaaaatgaaacagcctgagagctggggacacgggctttgtattactgtagcgagagcgctggcaactacatccagtttaaccggtttggaacgttcgtcgggggaccgaaacggggacccgtacgggtaccaagttccggtcccttacccccgaaggcccccttacccgaaacccgaaaccgggggcccccaaacgttccccggggttaccctttaccccccccgttggggcccccggtcccccgttacggccccgttacccgaacggggaaccggtcccaaccccgtttaacccccgggg

SEQ ID NO: 298385 - DNA, 542 bp, Homo sapiens
  misc_feature: GZ8MTXP02HH2FF.19.26.C04.1.454.CMB.2.raw
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (372)..(372): a, c, t, g, unknown or other
  misc_feature (372)..(372): n is a, c, g, or t
  modified_base (404)..(404): a, c, t, g, unknown or other
  misc_feature (404)..(404): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagcttggcatccacgtgggtccnccaggcctccgaggcaaggggctaggaggtgggtggctagttanatcatangataggaagtaaaatntatatganactcgagaacgggccattccacatcaccaganaacaatacaaagaacanagtagatntagacaaatagaaacagcctagagacgcggagggacacggtcgtgtagttattacgtgtacgacgagaggcggaacgtcggaaccaacgtaacactaccgtaaggtttacggg

SEQ ID NO: 298386 - DNA, 560 bp, Homo sapiens
  misc_feature: GZ8MTXP02GTUCI.19.26.C04.1.454.CMB.2.raw
  modified_base (284)..(284): a, c, t, g, unknown or other
  misc_feature (284)..(284): n is a, c, g, or t
  modified_base (316)..(316): a, c, t, g, unknown or other
  misc_feature (316)..(316): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggagtaaaatatattatgganactccgtgaagggccgattcaccatctcaganacaatccaaagaacacagtggatctgacaaatgaaacagcctgagagcgtagggggacacgggctgtgtattactgtgcgagagcggctggacaaactacactaccagttacggtttggacgttcgtggggaccaaacgggaccacgggtcacgtcgtcctccccgacgccctaccaaccgaaacgggccccaacgtccggtccttcccccgtggcccgccctcgcctccacggacacgacccg

SEQ ID NO: 298387 - DNA, 727 bp, Homo sapiens
  misc_feature: GZ8MTXP02IJ1CK.19.26.C04.1.454.CMB.2.raw
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggagtccctgagactctcctgtgcagcctctggattcaccttnagtagctttggcatccactgggtcccnccaggcctccgaggcaaggggctaggaggtggggtgctagttatatcaatatgagtgggaagactaaaaagttnttaatttagtagggaacgtaccgtacccgggtaggaaacgggggtccctaaagtttaccaaccctattccctacccgaagaacgtaaactaaaccgtttaacccgaaacggtaaaaccaaaccgtaaggttacgggtaaacttaccgtacggtaaacctaaaagttaacggaaaaccgaaccggacccgttaagggaaacggtaacgggtaccggtaacgggggaccgtaaaccggggtccgtttagggttaggtttaaacgttttaacggttagggttacgggtaaccgggaaggtacgggcggggtaccgttacgggaacctaaaaccgtacgtaacgtaccgtttaaacggg

SEQ ID NO: 298388 - DNA, 598 bp, Homo sapiens
  misc_feature: GZ8MTXP02INVNJ.19.26.C04.1.454.CMB.2.raw
  modified_base (314)..(314): a, c, t, g, unknown or other
  misc_feature (314)..(314): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactggtccaccaggctccaggcaaggggctagagtgggtggcagttatatcatatgatggagtaaaatatattatggagactcgtgaaggccgattcaccatctccaganacaattccaaagaacacagtggatctgacaaaatgaaacagcctgagagcgtagggggacacgggtctggtgtattactgtgcgagngacggcgtggacaaactacatacctaagtttacgggtttacggtacgtcggttcggggacccgtaagggaccacgggtacaacgttccgtcctcccccgaacgtcccctcccgaacccgaaacggccccctaacgttcccggtcccgtttccccccgtcggcccgcccctcggccctaccgacggacgccaaccccg

SEQ ID NO: 298389 - DNA, 583 bp, Homo sapiens
  misc_feature: GZ8MTXP02G8A3E.19.26.C04.1.454.CMB.2.raw
  modified_base (214)..(214): a, c, t, g, unknown or other
  misc_feature (214)..(214): n is a, c, g, or t
  modified_base (338)..(338): a, c, t, g, unknown or other
  misc_feature (338)..(338): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggagtaaatatatatggagactcgtgaaggccgattcaccatctccagagacaattccaaagaacacagtgatcngacaaatgaacagcctgagagcgtgggggacacgggctgtgtattactgtgcgagagcggctggacaactacagtacctagtttaccggtttggacgttcgtacgggggaccgaaacggggaccaacgggtcacgtccggtctcccccaaggccctacccgaccgaaacggggccccaacgttcccgggtccttaccccccgtcggcccgtccccgtcggccctccgacgggcgacctaaccccg

SEQ ID NO: 298390 - DNA, 647 bp, Homo sapiens
  misc_feature: GZ8MTXP02JQ8SA.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggacttcaccttcagtagctttggctatcccacgtcgggtccgccaggcctcccgaggcgaaggggctaggaggtggggtggctaggttatatcatagtgagtagggtaaagtaaaaattgttaatttagtgggtaacgtaaccgttcccgggttaggaacggggtcccgtatttacccgaacctacttccctacccgaagacgaaacctaaacttacccgaaaagaaactaaccgacggtaggtaactcgtaggaacctaaagtacgaaacgacgaccgtaggaacgacggtacggacggggtaccgacggcgttacggtagttagtacgttgggcgacggacgcggcgtaacgacgaacgtactactacgtacgtacggttacgg

SEQ ID NO: 298391 - DNA, 552 bp, Homo sapiens
  misc_feature: GZ8MTXP02HDRNM.19.26.C04.1.454.CMB.2.raw
  modified_base (300)..(300): a, c, t, g, unknown or other
  misc_feature (300)..(300): n is a, c, g, or t
  modified_base (345)..(345): a, c, t, g, unknown or other
  misc_feature (345)..(345): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (447)..(447): a, c, t, g, unknown or other
  misc_feature (447)..(447): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccagcctgggagtccctgagactctcctgtgcagcctctggattcaccttcagtagctttggcatccacgtcgggtccnccaggcctccgaggcgaaaggggctaggaggtgggtgctagttanatcatatgataggaagtaaaatntattatgganactccgtagaacgggcattcaccatctacagagaacataccaaagaacacagtagatacgtgactaaanacgaaacagccgtagacgagcgtaggggacacggctagtagttattacgtggtacgcgaaggcggcggcgtcggactaaactacgactaccgtaagtttaccggg

SEQ ID NO: 298392 - DNA, 567 bp, Homo sapiens
  misc_feature: GZ8MTXP02GYH45.19.26.C04.1.454.CMB.2.raw
  modified_base (283)..(283): a, c, t, g, unknown or other
  misc_feature (283)..(283): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggagtaaaatatatatgganactccgtgaaggccgattcaccatctccagagacaattacccaaagaacacagtggatctgacaaatgaaacagcctagagagcgtgggggacacggctgtgtattactgtgcgagagcgactggacaactacataccagtttaccggttggacgttcgtagggggaccaaaggggccacggtcaacgtccgtcctcccccgagtccctaccaccgtaaacgggccccaagtcccggttccctcccccgtgcccgtccctcgcctaccgacggcgacctacccg

SEQ ID NO: 298393 - DNA, 577 bp, Homo sapiens
  misc_feature: GZ8MTXP02HXS2B.19.26.C04.1.454.CMB.2.raw
  modified_base (304)..(304): a, c, t, g, unknown or other
  misc_feature (304)..(304): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggaggcgtggtccagcctgggaggtccctgagactctcctgtgcagcctctggattcaccttcagtagtctttggctatccacgtcgggtcccnccgaggcctccgaggcgaaggggctaggaggtgggtgctagttanatcatatgataggaagtaaaatntattagnggatactcgtagaagggccattccacatctacagagaacaataccaaagaacacagtagatcgtagactaaatacgaaacacgaccgtagaagaggcggtaggggactacgggcgttaggtagttattacgtggtacgacggtaggacggcggaacgtacggaacctaactactacgttaccgttaaggtttacgggg

SEQ ID NO: 298394 - DNA, 618 bp, Homo sapiens
  misc_feature: GZ8MTXP02HHDSK.19.26.C04.1.454.CMB.2.raw
  modified_base (315)..(315): a, c, t, g, unknown or other
  misc_feature (315)..(315): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaagtaaaatatattatggagactccgtgaaggccgattcacatctccaganacaattccaaagaacacagtgatctagacaaatgaaacagcctagagagcgtaggggacacggctgtgtattacgtgtgcgagacgcggactggacaactacactacctaagtttacgggttggacgttcggtacgggggacccaaacggggacccgacgggttacaacgttccggtaccctccccgaacggtcccctacccgaccgaaaccggggtcccctacggttccccgggtcccctttcccccgcgggaacccccgtccccgttcggcccgtacccgacggaccggtccctaacccgg

SEQ ID NO: 298395 - DNA, 639 bp, Homo sapiens
  misc_feature: GZ8MTXP02JMKUN.19.26.C04.1.454.CMB.2.raw
  modified_base (252)..(252): a, c, t, g, unknown or other
  misc_feature (252)..(252): n is a, c, g, or t
  modified_base (282)..(282): a, c, t, g, unknown or other
  misc_feature (282)..(282): n is a, c, g, or t
  modified_base (352)..(352): a, c, t, g, unknown or other
  misc_feature (352)..(352): n is a, c, g, or t
  modified_base (400)..(400): a, c, t, g, unknown or other
  misc_feature (400)..(400): n is a, c, g, or t
  modified_base (580)..(580): a, c, t, g, unknown or other
  misc_feature (580)..(580): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgttgtccagcctgggaggtccctgagactctcctgtgcagcctctggattcaccttcagtagctttggcatccactgggtccaccaggctccaggcaaggggctagagtgggtgcagttanatcatatgatggagtaaatatattatgganacgtccgtgaaggccgattcacatctcagacgactaatccaagaacacagtggatctagacaaatgaacngcctagagagcgtgggggacaggctgtgtattacgtgtgcgagagcgngtggacaacgtactacttacccgtaagtttacgggtttcggtaacgttcggtacgggggaacccgaaggggacccgtaacggggtctaacgttcccgtcccgtaccccaacggccccttacccgaaacccggaaaccggggtcccctaacggttcccggggttaccccctttcccccggngggcccccgtccccgttacggcccgttacccggaacggtaacccgcccgtaacccccgg

SEQ ID NO: 298396 - DNA, 559 bp, Homo sapiens
  misc_feature: GZ8MTXP02FQJRW.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactcgtgaaggccgattcacatctccagagacaattacccaagaacacagtggatctgacaaatgaacagcctagagagcgtgggggacacggtctttgtattactgtgcgagagcggcgtggcaacgtacatcctagttacggtttggacgtcgtggggaccgaagggaccgacggtcactcgtcctcccacgccctaccaccgaaacgggcccacgtccggtcccttcccccgtggtcccgcccgtcgcctcccgaggacgccaccgtaccg

SEQ ID NO: 298397 - DNA, 623 bp, Homo sapiens
  misc_feature: GZ8MTXP02G18AC.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaaggccgattcaccatctccagagacaattccaagaacacagtgatctgacaaatgaacagcctagagagcgtaggggacacgggctgtacgtattacgtgtgcgagagcggctggacaaacgtacacgtaccgtagtttacgggtttcggaaccgttcggttacgggggacccaaacgggggacccgtaacgggtcaacgtcccgttaccgtacccccgacggtcccctacccgaacccgaaacggggccccaacgttcccgggttcccttcccccgtgggccccgtccccgtcggtccctacccgaacgggaccgacccgtaaccccg

SEQ ID NO: 298398 - DNA, 586 bp, Homo sapiens
  misc_feature: GZ8MTXP02H9BN4.19.26.C04.1.454.CMB.2.raw
  modified_base (214)..(214): a, c, t, g, unknown or other
  misc_feature (214)..(214): n is a, c, g, or t
  modified_base (281)..(281): a, c, t, g, unknown or other
  misc_feature (281)..(281): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttatatcatatgatggagtaaatatatatgganactcgtgaaggccgatcacatctccagagacaattccaaagaacacagtggatctgacaaatgaacagcctgagaggctagggggacacgggctgttatattacgtgtgcgaggagcggctggacaactacatactagtttacgggttggtacgttcgtagggggaccgaacggggaccacggtcacgttccgtcctacccccgacggtccctacccgaaccgaaacgggtccccaacgtcccggtcctttcccccgcggtccccgtcccgtcgccctacccggacggaccgtacccgaaccccg

SEQ ID NO: 298399 - DNA, 548 bp, Homo sapiens
  misc_feature: GZ8MTXP02IDED7.19.26.C04.1.454.CMB.2.raw
  modified_base (299)..(299): a, c, t, g, unknown or other
  misc_feature (299)..(299): n is a, c, g, or t
  modified_base (326)..(326): a, c, t, g, unknown or other
  misc_feature (326)..(326): n is a, c, g, or t
  modified_base (372)..(372): a, c, t, g, unknown or other
  misc_feature (372)..(372): n is a, c, g, or t
  modified_base (467)..(467): a, c, t, g, unknown or other
  misc_feature (467)..(467): n is a, c, g, or t
  modified_base (474)..(474): a, c, t, g, unknown or other
  misc_feature (474)..(474): n is a, c, g, or t
  modified_base (510)..(510): a, c, t, g, unknown or other
  misc_feature (510)..(510): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctggggagtccctgagactctcctgtgcagcctctggattcaccttcagtagctttggcatccactgggtcccnccaggctccgaggcgaaggggctaggnggtggggtggcagttatatcatatgatggaagtaaaatatattagngggagactaccggtagaacggggccgtattccaccatcctaccagagacaatccaaagacacagtgatctgacaaatgaacagcctagagagcgnggggacncggctggtgtattacgtggtagcggagacggtcggngtacggactaaactacgtactaccgtagttttacgggg

SEQ ID NO: 298400 - DNA, 582 bp, Homo sapiens
  misc_feature: GZ8MTXP02GVDCJ.19.26.C04.1.454.CMB.2.raw
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (347)..(347): a, c, t, g, unknown or other
  misc_feature (347)..(347): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggagtaaatntatanganactcgtgaaggcgatcaccatctccagagacaatccaagaacacagtggatctagacaaatgaaacngacctagagagcgtagggggacacgggctgtagtagttactgtgacgagagcggcgtggacaacgtacatacctagttacggtttggacgtcggtcggggacctaaacgggaccacggtcacgtccgtcctaccccgacgtccctacccgaccgaacgggcccctacgtcccggtcccttcccccgtcggcccgtccccgtcggtcccgtaccgacggacctacccgtaaccccg

SEQ ID NO: 298401 - DNA, 591 bp, Homo sapiens
  misc_feature: GZ8MTXP02HPP2W.19.26.C04.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggaggtaaaatntattatggagactcgtgaaggccgattcaccatctccagagacaattccaaagacacagtgatctgacaaatgaaacagcctgagaagctagggggaccagggctagtgtattactgtgcgagagcggctggacaactacatacctagtttacggtttggacgtcgtggggacccaaggggaccacggttcacgtccgtcctcccgacgtccctacccaaccgaaacgggcccctaaacgttcccgggtccctttccccccgtggcccggtcccccttcggccctacccgaacggggaccgtaccctaacccccgg

SEQ ID NO: 298402 - DNA, 511 bp, Homo sapiens
  misc_feature: GZ8MTXP02HJPHK.19.26.C04.1.454.CMB.2.raw
  modified_base (298)..(298): a, c, t, g, unknown or other
  misc_feature (298)..(298): n is a, c, g, or t
  modified_base (337)..(337): a, c, t, g, unknown or other
  misc_feature (337)..(337): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (364)..(364): a, c, t, g, unknown or other
  misc_feature (364)..(364): n is a, c, g, or t
  modified_base (368)..(368): a, c, t, g, unknown or other
  misc_feature (368)..(368): n is a, c, g, or t
  modified_base (487)..(487): a, c, t, g, unknown or other
  misc_feature (487)..(487): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactggggtccnccaggctccaggcaaggggctaggagtgggtgcagttanatcatangatggagtaaaatntattangganactcgtagaaggcattcacatctcagagacaataccaagaacacagtgatctagacaaatgaaacagctagagagcgtaggggacacggctggtagtattacgtgtagcgagacgcggngtcgacactacactactagttcgg

SEQ ID NO: 298403 - DNA, 562 bp, Homo sapiens
  misc_feature: GZ8MTXP02ID9ER.19.26.C04.1.454.CMB.2.raw
  modified_base (276)..(276): a, c, t, g, unknown or other
  misc_feature (276)..(276): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactggggtccaccaggctccaggcaaggggctagagtgggtggcagttatatcatatgatggaggtaaaatntatatggagactccgtgaagggccgattcaccatctccagagacaatttccaaagaacacagtggatctgacaaatgaaacagcctgagagcgtagggggacacggggctttgtattacgtgtgcgagagcggctgggacaactacatccaatttaccgggtttggaccgttcgtggggaccaaagggaccacggtacatcgtctccccgaacgccctaccaccgaacggcccagtccggtcctcccccgtggccgcccgtcgcctccgaggacgccacctaccgg

SEQ ID NO: 298404 - DNA, 525 bp, Homo sapiens
  misc_feature: GZ8MTXP02GCVJ3.19.26.C04.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (333)..(333): a, c, t, g, unknown or other
  misc_feature (333)..(333): n is a, c, g, or t
  modified_base (342)..(342): a, c, t, g, unknown or other
  misc_feature (342)..(342): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (376)..(376): a, c, t, g, unknown or other
  misc_feature (376)..(376): n is a, c, g, or t
  modified_base (390)..(390): a, c, t, g, unknown or other
  misc_feature (390)..(390): n is a, c, g, or t
  modified_base (395)..(395): a, c, t, g, unknown or other
  misc_feature (395)..(395): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttnagtagctttggcatccacgtgggtcccnccaggcctccgaggcaaggggctaggagtgggnggcagttanatcatatgatggaagtaaatntatanganctcgngaggcatcacatcncaganacatccaagaacanagngatctagacaaatgaaacagccgtagagagcgtacggggacacggctggtagtattacgtagtggacggagacggcggcgtcggactaactacactacccgtagttttacggg

SEQ ID NO: 298405 - DNA, 644 bp, Homo sapiens
  misc_feature: GZ8MTXP02HTVXW.19.26.C04.1.454.CMB.2.raw
  modified_base (214)..(214): a, c, t, g, unknown or other
  misc_feature (214)..(214): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttatatcatatgatggaggtaaaatatattatggagactccgtgaaggcgattcaccatctccagagacaattcaaagaacacagtaggatctgacaaatgaacagcctgagagctggggaccacgggctgtgtattactgtgcgagagtcggctggacaaacgtacactaccgtaagtttacgggttttagggaaccggttcggttacgggggacccgaaacgggggtacccgtaaccgggggttacaaacggttcccgtaaccgttcccccgaaacggtcccttacccgaacccgaaaaccgggtccctaaacgttcccgggtcccttttccccccgtcgggcccgtccccgtcggtcccgttacccgaacgggacccgtaccgtaacccccgg

SEQ ID NO: 298406 - DNA, 529 bp, Homo sapiens
  misc_feature: GZ8MTXP02FVMKN.19.26.C04.1.454.CMB.2.raw
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (525)..(525): a, c, t, g, unknown or other
  misc_feature (525)..(525): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttanatcatatgatggagtaaaatntattatgganactcgtgaagggccattcacatctcagagacaattccaaagaacacagtgatctgcaaatgaaacagcctgagagcgtgggggacagggctgtgtattactgtgcgagagcggctggacaaactacatccattaacggtttggacgtcgtggggacaaggggaccacggtcagtcgctccccagcctccaaccgacgggcccacgtcggtcctccccgtcgcgcccctgcctcacggaccncacg

SEQ ID NO: 298407 - DNA, 526 bp, Homo sapiens
  misc_feature: GZ8MTXP02FYKL0.19.26.C04.1.454.CMB.2.raw
  modified_base (340)..(340): a, c, t, g, unknown or other
  misc_feature (340)..(340): n is a, c, g, or t
  modified_base (368)..(368): a, c, t, g, unknown or other
  misc_feature (368)..(368): n is a, c, g, or t
  modified_base (394)..(394): a, c, t, g, unknown or other
  misc_feature (394)..(394): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatcccactgggtccgccaggctccaggcaaggggctaggagtggggtggcagtttanatcatatgatggaagtaaaatatattanggagactcgtgaaggcgatcacatcncagagacaatcaagaacacagtgatctagacaaatcgaaacagaccctagagagcgtagggggaccacgggtctggtagtattacgtgtcgcgacgagcggcgtggaccaactacactaccagtttacgggg

SEQ ID NO: 298408 - DNA, 637 bp, Homo sapiens
  misc_feature: GZ8MTXP02H163J.19.26.C04.1.454.CMB.2.raw
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtggtttcgtcgttagctctttaagaggtgtccagtgtcaggtgcacctggtggagtcgtgggggaggcgtggtccagcctgggaggtccctgagactctcctgtgcagcctntggattcaccttnagtagtcttggactactccacgtcgggccnccgaggcctaccgaggacgaaggggctaggaggtgggtgacgtagttatatatatatagtagtaggtaaaggtaaaataattaagttaagtaggtaagtacgtacgtaggaacggtacgtactactactactactaccgaacgaacgaactaaactaaccaaacgaaacaacgtagtagtacgtacgtagaacgtaaagtaagaacgaacgtacgtagaacggaacggacggtacgggacggacggtacgtacgttagttacgttacgtagtacggacggacggacggacggtaacggtacggaacgtaacgtaacgtacgtacgtaacgttacgg

SEQ ID NO: 298409 - DNA, 536 bp, Homo sapiens
  misc_feature: GZ8MTXP02JCCW6.19.26.C04.1.454.CMB.2.raw
  modified_base (379)..(379): a, c, t, g, unknown or other
  misc_feature (379)..(379): n is a, c, g, or t
  modified_base (385)..(385): a, c, t, g, unknown or other
  misc_feature (385)..(385): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
  modified_base (439)..(439): a, c, t, g, unknown or other
  misc_feature (439)..(439): n is a, c, g, or t
  modified_base (480)..(480): a, c, t, g, unknown or other
  misc_feature (480)..(480): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccaggcctgggaggtccctgagactctcctgtgcagcctctggattcaccttcagtacgctttggcatcccacgtcgggtccgccaggcctccgagggccaaagggggctaaggaggtggggtggctaaggttatatcatatgaatgggaagtaaaatntattangganactcgagagggcatcacatctcaganacaataccaagaacacagtagatntagacaaatagaacagaccgtagagagcgtaggggacacgntggtgtatacgtgtgcgacgagcggcgtggacacgtacactaccgtactttacggg

SEQ ID NO: 298410 - DNA, 619 bp, Homo sapiens
  misc_feature: GZ8MTXP02JS5HW.19.26.C04.1.454.CMB.2.raw
  modified_base (283)..(283): a, c, t, g, unknown or other
  misc_feature (283)..(283): n is a, c, g, or t
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggagtaaatatattatgganactccgtgaaggccgatcacatcncagagacaattccaaagaacacagtggatctgacaaatgaaacngcctagagacgcgtgggggacacgggctgtacgtattacgtgtcgcgaggacgcggctaggactaaactacgaatccgtaagtttaccgggtttagggaccgttcggtacgggggacctaaacggggaccctacgggtcaacggtccgtaccctaccccgacgtccccgtacccaacccggaaacggggccccacggttcccgggtacccctttcccccgcgggccccgtccccgtcgcccgtacccgaacggaccggacctaccccg

SEQ ID NO: 298411 - DNA, 561 bp, Homo sapiens
  misc_feature: GZ8MTXP02GCTG5.19.26.C04.1.454.CMB.2.raw
  modified_base (214)..(214): a, c, t, g, unknown or other
  misc_feature (214)..(214): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctaggagtgggtgcagttatatcatatgatggaaggtaaatatattatggagactccgtgaaggccgattcacatctccagagacaatccaaagaacacagtgatctgacaaatgaacagacctgacgagcgtaggggacacggctgtgtattactgtgcgagagcgctggacaactacactacagttacggtttcggacgtcgtaggggaccaaacgggaccacgggtcacgtccgtctcccccgagccctaccacccgaacgggcccacgtcccggtccttcccccgtcggcccgcccgtcgccctaccgacggaccgaccacccg

SEQ ID NO: 298412 - DNA, 655 bp, Homo sapiens
  misc_feature: GZ8MTXP02JKFDU.19.26.C04.1.454.CMB.2.raw
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (374)..(374): a, c, t, g, unknown or other
  misc_feature (374)..(374): n is a, c, g, or t
  modified_base (381)..(381): a, c, t, g, unknown or other
  misc_feature (381)..(381): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcacctggtggagtcgtgggggagcgtggtccaggccgtggggagtccctgagactctcctgtgcagcctntggattccaccttcagtgtctttggcatcccacgtcgggtcccnccaggcctccgaggcgaaggggctaggaggtgggtgactagttatatcatatgataggaagtaaaatntaattangggactacgtccggtaggaaacggggtccctaattcccaaccctataccgtacccgaagaacgtaaactaaacttacccgaaaagaaaccaacgtagtacgggtaatccgtaggaacctaaaatacgaaacgacgaccgtaggaaggacggtaccggtagggggtaccacggggtacttacgggttagttacgttacggtaggtacggacggacggtaggccggtcgtcgggaacctaaactacgtaacgtacccgttaaggttttaaccgggg

SEQ ID NO: 298413 - DNA, 594 bp, Homo sapiens
  misc_feature: GZ8MTXP02F4215.19.26.C04.1.454.CMB.2.raw
  modified_base (270)..(270): a, c, t, g, unknown or other
  misc_feature (270)..(270): n is a, c, g, or t
  modified_base (301)..(301): a, c, t, g, unknown or other
  misc_feature (301)..(301): n is a, c, g, or t
  modified_base (327)..(327): a, c, t, g, unknown or other
  misc_feature (327)..(327): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (426)..(426): a, c, t, g, unknown or other
  misc_feature (426)..(426): n is a, c, g, or t
  modified_base (446)..(446): a, c, t, g, unknown or other
  misc_feature (446)..(446): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcactggtggagtcgtgggggagcgtggtccagcctgggagtccctgagactctcctgtgcagcctctggacttcaccttnagtagtctttggcatccacgtcggggtcccncaggcctcgaggcgaaggggctaggnggtgggtgcagttatatnatancgagtaggaaagttaaaatataagttagtgggatacgttcggtagaaggggtcctattaccacctatcctacaaganaactaataccaaagaaccanagtgatctagacaaatagaaacagaccgtggaagacgtacggtaggggaaccacgggtcttaggttagttaattacgtggtacggacgaaggcggtcggaacgtcggaacctaaacgtaccacgttacccgtaaggttttaaccgggg

SEQ ID NO: 298414 - DNA, 667 bp, Homo sapiens
  misc_feature: GZ8MTXP02H93TU.19.26.C04.1.454.CMB.2.raw
  modified_base (313)..(313): a, c, t, g, unknown or other
  misc_feature (313)..(313): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggaggtccctgagactctcctgtgcagcctcgtggtacttccacctttcagtacgtctttggctactacccgacgtcgggtccncccgaggcctccgaggacgaaggggctaggaggtggggtgactaggtatagtcaatagtgaagtagggaaagtaaaaattataagttagtcgggaagtaacgtccggtaggaaacggggtccgtaaatttacccaccctaatcctaccgaaggaacaaactaaacttaccaaaagaaaccaacagtaggaaactcgtaaagaactaaataacgaaacgacgacgtaacggaaggacggacggtacgggacggacggtacgttacggttacggttagttacgttaggtacggacggacggacggacggaacggtacgaacgtaacgtaacgtaacgtaacgttaacggttaacgg

SEQ ID NO: 298415 - DNA, 573 bp, Homo sapiens
  misc_feature: GZ8MTXP02GALAY.19.26.C04.1.454.CMB.2.raw
  modified_base (496)..(496): a, c, t, g, unknown or other
  misc_feature (496)..(496): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactccgtgaagggccgattcacatctccaagagacaattccaaagaacacagtggatctcgacaaaatgaaacagacctgagagcgtagggggacacggctgtgtattacgtgtgcgagagcggcgtggacaactacatccgtagttacggttgggacgtcggtcggggaccgaaacgggaccacgggtcacgttccgtcctacccccgngccctaccaaccgaacgggccctacgtccggtcccttccccgtcggcccgtccctcgcctccgacggtcgccacccg

SEQ ID NO: 298416 - DNA, 562 bp, Homo sapiens
  misc_feature: GZ8MTXP02JPPKK.19.26.C04.1.454.CMB.2.raw
  modified_base (301)..(301): a, c, t, g, unknown or other
  misc_feature (301)..(301): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (442)..(442): a, c, t, g, unknown or other
  misc_feature (442)..(442): n is a, c, g, or t
  modified_base (449)..(449): a, c, t, g, unknown or other
  misc_feature (449)..(449): n is a, c, g, or t
  modified_base (509)..(509): a, c, t, g, unknown or other
  misc_feature (509)..(509): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctcctgtgcagcctctggattcaccttcagtagctttggcatcccacgtcgggtcccnccgaggcctccgagggccgaaagggggctaggaggtggggtgctagttanatcatatgagtaggaagtaaaatntaattatgggaagactccggtagaaggggtccattccaccatctacagagacaataccaaagaacanagtgatntagacaaatgaacagaccgtgagagcggtggggacgacggctggtagttagttacgtggnggtacgaggacggcggcgtaggacaacgtacgacttaccgtagtttaccgggg

SEQ ID NO: 298417 - DNA, 583 bp, Homo sapiens
  misc_feature: GZ8MTXP02J1MXJ.19.26.C04.1.454.CMB.2.raw
  modified_base (264)..(264): a, c, t, g, unknown or other
  misc_feature (264)..(264): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattccaccttcagtagctttggcatccactgggtccaccaggctccaggcaaggggctaggaggtgggtggctagttatatcatangatggaagtaaaatatattatggagactccgtagaagggccgattcaccatctccagagacaatccaaagaacacagtgatctgacaaatgaaacngcctagagagcgtggggacacggctgtgtattacgtgtgacgagagcggctaggacaacgtacactccctaagttacggttggacgtcgtcgggggaccaacgggaccgacgggtcacgtccgtcctccccgacgtcccctacccgaccgacgggcccctacggtcccgttcccgttcccccgtcggcccgtcccgtcgccctccgacggtaccgccaccccg

SEQ ID NO: 298418 - DNA, 561 bp, Homo sapiens
  misc_feature: GZ8MTXP02FQHJ8.19.26.C04.1.454.CMB.2.raw
  modified_base (256)..(256): a, c, t, g, unknown or other
  misc_feature (256)..(256): n is a, c, g, or t
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (376)..(376): a, c, t, g, unknown or other
  misc_feature (376)..(376): n is a, c, g, or t
  modified_base (380)..(380): a, c, t, g, unknown or other
  misc_feature (380)..(380): n is a, c, g, or t
  modified_base (554)..(554): a, c, t, g, unknown or other
  misc_feature (554)..(554): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcgaaggggctaggaggtgggtggcagttanatcatatgatggaaggtaaaatatattangganactcgtgaaggcgattcacatctcagagacaattccaagacacagtgatctgacaaatgaacagcctgagagcgtaggggacacggntgtntatctgtgcgagagcggctaggcaactacgatacctagttacggtttacggacgttcgtacggggaccaagggaccgacggtcacgtccgtacctccccgaacgtccctccgaaccgaacgggcccacgtccgttccctcccccgtggcccgtcccgtcgcctccgacggaccnccgaccg

SEQ ID NO: 298419 - DNA, 640 bp, Homo sapiens
  misc_feature: GZ8MTXP02JJMYO.19.26.C04.1.454.CMB.2.raw
  modified_base (257)..(257): a, c, t, g, unknown or other
  misc_feature (257)..(257): n is a, c, g, or t
  modified_base (301)..(301): a, c, t, g, unknown or other
  misc_feature (301)..(301): n is a, c, g, or t
  modified_base (329)..(329): a, c, t, g, unknown or other
  misc_feature (329)..(329): n is a, c, g, or t
  modified_base (375)..(375): a, c, t, g, unknown or other
  misc_feature (375)..(375): n is a, c, g, or t
  modified_base (384)..(384): a, c, t, g, unknown or other
  misc_feature (384)..(384): n is a, c, g, or t
  modified_base (481)..(481): a, c, t, g, unknown or other
  misc_feature (481)..(481): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggagtccctgagactctctgtgcagcctntggattcaccttcagtagtctttggctatcccacgtcgggtccnccaggcctccgaggcgaaggggctaggnggtgggtgctagttatagtcatatgagtagggtaaagttaaaattntaatttagngggtaagacgttaccggtaggaacggggtcctattcccaactatacctaccaagagtaacctaattaccgaaagaacacgtagtagtactccgtaanaacgtaaagtacgaacgacgtaccgtaggaacggtacggacggtacggggaccgtacggtacgttaggttagttacgttacgtaggtacggacggtaacggacggcggtaacgtacggaacctaaacgtacgtaaccgttaccgttaacggtttacggg

SEQ ID NO: 298420 - DNA, 563 bp, Homo sapiens
  misc_feature: GZ8MTXP02J0YKE.19.26.C04.1.454.CMB.2.raw
  modified_base (370)..(370): a, c, t, g, unknown or other
  misc_feature (370)..(370): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccacgtgggtcccgccaggcctccgaggcgaagggggctaaggaggtggggtggctagttatatcatatgatggaagtaaaatntaattatggagactccgtaggaacgggccgtattccacctatcctaccagagacaactaccaaagaacacagtggatctgacaatagaacgagcctaggagagcggtaggggacgacgggctaggtagtagttacgtgtcggacgaggtacggcggcgtacggactaacgtacacgtacctacgtttaccggg

SEQ ID NO: 298421 - DNA, 510 bp, Homo sapiens
  misc_feature: GZ8MTXP02FPW7S.19.26.C04.1.454.CMB.2.raw
  modified_base (337)..(337): a, c, t, g, unknown or other
  misc_feature (337)..(337): n is a, c, g, or t
  modified_base (358)..(358): a, c, t, g, unknown or other
  misc_feature (358)..(358): n is a, c, g, or t
  modified_base (369)..(369): a, c, t, g, unknown or other
  misc_feature (369)..(369): n is a, c, g, or t
  modified_base (400)..(400): a, c, t, g, unknown or other
  misc_feature (400)..(400): n is a, c, g, or t
  modified_base (402)..(402): a, c, t, g, unknown or other
  misc_feature (402)..(402): n is a, c, g, or t
  modified_base (409)..(409): a, c, t, g, unknown or other
  misc_feature (409)..(409): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (417)..(417): a, c, t, g, unknown or other
  misc_feature (417)..(417): n is a, c, g, or t
  modified_base (420)..(422): a, c, t, g, unknown or other
  misc_feature (420)..(422): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
  modified_base (434)..(434): a, c, t, g, unknown or other
  misc_feature (434)..(434): n is a, c, g, or t
  modified_base (443)..(443): a, c, t, g, unknown or other
  misc_feature (443)..(443): n is a, c, g, or t
  modified_base (485)..(485): a, c, t, g, unknown or other
  misc_feature (485)..(485): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatcccacgtgggtccgccaggctccaggcaaaggggctagagtgggtgcagttanatcatatgatggagtaaaatntattatggganactcgtagaagggcattcaccatctcagaananatacaanaananagngannnanaananaananacagagagngagggacgacgcgtagtagtattactgtagcgagagcggcgngacgaacaacactactacgttacgg

SEQ ID NO: 298422 - DNA, 540 bp, Homo sapiens
  misc_feature: GZ8MTXP02JWFRU.19.26.C04.1.454.CMB.2.raw
  modified_base (252)..(252): a, c, t, g, unknown or other
  misc_feature (252)..(252): n is a, c, g, or t
  modified_base (534)..(534): a, c, t, g, unknown or other
  misc_feature (534)..(534): n is a, c, g, or t
  modified_base (537)..(537): a, c, t, g, unknown or other
  misc_feature (537)..(537): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactggtccaccaggctccaggcaaggggctagagtgggtggcagttanatcatatgatggaggtaaaatatattatggagactccgtgaaggccgattcaccatctccagagacaattccaagaacacagtgatctgcaaaatgaaacagcctgacgagctggggacacgggctgtgtatactgtgcgagagcggctggcaactacataccagttacggttggacgtcgtgggggaccaagggacccacgggtcactcgtcctccccagccctccaccgaacgggcccagtccggtcctcccccgtggccgccctggacctcgacggacnccnccg

SEQ ID NO: 298423 - DNA, 629 bp, Homo sapiens
  misc_feature: GZ8MTXP02GKTFO.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatccacgtcgggtcccgccaggctccgaggccgaaggggctaggaggtgggtggcagttatatcatatgatggaaagtaaaatataattagtgggagtacgtaccggtaggaacggggccgtattaccaaccgtactacctacccaagaacgaactaaacttacccgaaagaaaccaacgaagtaggtaatacgttagaactaaaatacgaaacgagacccgtaggaaggacggtacggtacggggaacgacgggtacgtacggttagttacgttaacgtggtcgacggaggacggcgggcgtacggacctaaacgtacctacgtacccgttaaggtttaccgggg

SEQ ID NO: 298424 - DNA, 581 bp, Homo sapiens
  misc_feature: GZ8MTXP02HMOI1.19.26.C04.1.454.CMB.2.raw
  modified_base (273)..(273): a, c, t, g, unknown or other
  misc_feature (273)..(273): n is a, c, g, or t
  modified_base (306)..(306): a, c, t, g, unknown or other
  misc_feature (306)..(306): n is a, c, g, or t
  modified_base (318)..(318): a, c, t, g, unknown or other
  misc_feature (318)..(318): n is a, c, g, or t
  modified_base (377)..(377): a, c, t, g, unknown or other
  misc_feature (377)..(377): n is a, c, g, or t
  modified_base (392)..(392): a, c, t, g, unknown or other
  misc_feature (392)..(392): n is a, c, g, or t
  modified_base (574)..(574): a, c, t, g, unknown or other
  misc_feature (574)..(574): n is a, c, g, or t
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaagtaaatntatatggagactcgtgaggcgatcacatctcanagacaatcaaanacacagtgatctgacaaatgaacagtccagagagcgtagggacaggctgtcgtattacnggtgacgagagcggngtacggactaactacaactacctacgtttacggttggtaccgttacggtacgggggacccgaaacgggtacccgtacgggtactacgtccggttcccaccccgcgtccctacccgacgaaccgggccctacgtcccggttcccttccccgtggaaccccgtcccgcgacctccgacggaccnccgaccg

SEQ ID NO: 298425 - DNA, 567 bp, Homo sapiens
  misc_feature: GZ8MTXP02F2IOM.19.26.C04.1.454.CMB.2.raw
  modified_base (299)..(299): a, c, t, g, unknown or other
  misc_feature (299)..(299): n is a, c, g, or t
  modified_base (353)..(353): a, c, t, g, unknown or other
  misc_feature (353)..(353): n is a, c, g, or t
  modified_base (369)..(369): a, c, t, g, unknown or other
  misc_feature (369)..(369): n is a, c, g, or t
  modified_base (380)..(380): a, c, t, g, unknown or other
  misc_feature (380)..(380): n is a, c, g, or t
  modified_base (526)..(526): a, c, t, g, unknown or other
  misc_feature (526)..(526): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctctggattcaccttcagtagctttggcatccactggggtcccnccaggcctccgaggcgaaggggctaggaggtggggtggctaggttatatcatangataggaagtaaaatntattatggganacgtcgtagaagggccaattccactatcctacagagaacaactaccaaagaacacgagtgatctagacaaatagaaacagacctagaacgagttaccggaggggaacgacggtctaggttagttattacgtggtcgacggaacggnggcggtcgtcggactaactactactaccgtacggtttacgg

SEQ ID NO: 298426 - DNA, 559 bp, Homo sapiens
  misc_feature: GZ8MTXP02IFRNS.19.26.C04.1.454.CMB.2.raw
  modified_base (214)..(214): a, c, t, g, unknown or other
  misc_feature (214)..(214): n is a, c, g, or t
  modified_base (275)..(275): a, c, t, g, unknown or other
  misc_feature (275)..(275): n is a, c, g, or t
  modified_base (311)..(311): a, c, t, g, unknown or other
  misc_feature (311)..(311): n is a, c, g, or t
  modified_base (362)..(362): a, c, t, g, unknown or other
  misc_feature (362)..(362): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgttgtccagcctgggaggtccctgagactctcctgtgcagcctctggattcaccttcagtagctttggcatccactgggtccnccaggctccaggcaaggggctagagtgggtggcagttatatcatatgatggaggtaaaatntattatggagactccgtgaaggccgattcaccatcnccagagacaattcccaagaacacagtgatctgacaaatgaacagcctgagngctgggggacacgggctgtagtattactgtgcgagagcggctggcaactacatccagttacggtttggacgtcgtggggaccaaagggaccgaacggtcaactccgtacctccccgacgtccctaccaccgaacgggcccaacgttcccgtaccttcccccgtggcccgcccgtcgcctccgacggacccacgaccg

SEQ ID NO: 298427 - DNA, 545 bp, Homo sapiens
  misc_feature: GZ8MTXP02HWILH.19.26.C04.1.454.CMB.2.raw
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (359)..(359): a, c, t, g, unknown or other
  misc_feature (359)..(359): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaggtaaaatatattangganactccgtgaaggcgattcaccatctccagagacaattccaaagaacacagtgatctgcaaatgaacagcctgagngctgggggacacgggctgtgtattactgtgcgagagcggctggcaacgtacatcctagtttaacggtttggtacgttcgtcggggaccgaagggaccacggtcatccgtctccccagccctccaccgaaacggcccaacgtccggtccttcccccgtggccgccctcgctccgacggacgcacccg

SEQ ID NO: 298428 - DNA, 581 bp, Homo sapiens
  misc_feature: GZ8MTXP02IN3DX.19.26.C04.1.454.CMB.2.raw
  modified_base (272)..(272): a, c, t, g, unknown or other
  misc_feature (272)..(272): n is a, c, g, or t
  modified_base (282)..(282): a, c, t, g, unknown or other
  misc_feature (282)..(282): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactgggtccaccaggctccaggcaaggggctagagtgggtggcagttatatcatatgatggagtaaatntattatgganactcgtgaggccgattcacatctccagagacaattccaagaacacagtgatctgacaaatgaacagcctgagagctagggggacacgggctgtgtattacngtgcgagagcggctggcaaacgtacacgtacctagtttacggtttgacgttcgtacgggggaccgaaacggggaccacgggtcaacgtccggtcctacccccgaggtccctacccgaaccgaacggggccccaacgtcccggttcccttcccccgtggcccgccccttcggaccctcccgacggtacgacctaacccg

SEQ ID NO: 298429 - DNA, 590 bp, Homo sapiens
  misc_feature: GZ8MTXP02H1R9E.19.26.C04.1.454.CMB.2.raw
  modified_base (251)..(251): a, c, t, g, unknown or other
  misc_feature (251)..(251): n is a, c, g, or t
  modified_base (297)..(297): a, c, t, g, unknown or other
  misc_feature (297)..(297): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (364)..(364): a, c, t, g, unknown or other
  misc_feature (364)..(364): n is a, c, g, or t
  modified_base (374)..(374): a, c, t, g, unknown or other
  misc_feature (374)..(374): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggagcgtggtccagcctgggagtccctgagactctcctgtncagcctctggattcacttcagtagctttggcatccacgtgggtccnccaggcctccgaggcaaaggggctaggagtggggtgctagttanatcatangataggaagtaaaatntattatgganctcggtagaacgggccgtattacaccntacctacagagaactaattacccaaagaacaacagtagatacgtagaacaaaagtacgaaacgacgaccgtagacggaggacggtacggggaaccgacggtcgttacggtagtttaaacgttagttcggtaggacggagacggcggtaacgcggacctaactactacgttaccgttaagttttacgggg

SEQ ID NO: 298430 - DNA, 721 bp, Homo sapiens
  misc_feature: GZ8MTXP02IL838.19.26.C04.1.454.CMB.2.raw
  modified_base (253)..(253): a, c, t, g, unknown or other
  misc_feature (253)..(253): n is a, c, g, or t
  modified_base (357)..(357): a, c, t, g, unknown or other
  misc_feature (357)..(357): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctagacgtctcctctgtcncacgtcctcgtgtacttcctaccttgaagtcgtcgtttggactactcccgacggttccgggccccaccgaggtccctacggaacggacggaacggggtctaggngggtggggtcgagttagttatacgtntaatagtagaagttaggggaaaaagtttaaaattagttaaacgttaggtagggggaactacccggttacgggtaagggaaccgggggtacttacttacccaaaccttatacccgtaccgaaaggtaactaaacttaaccgtaacccgaaaagtaacccaagtacggtagattccgtaagaaactaaacgtacggaaactaccgtcaaggaaggtcgcgggtacgggaaacctcgggctttagggtacttaagttcggtaggaccggacgaagggcgcccgggttaagaccggtaaaactacctaaactccgttaacccgttaaggttttaaccggggg

SEQ ID NO: 298431 - DNA, 575 bp, Homo sapiens
  misc_feature: GZ8MTXP02HO7DD.19.26.C04.1.454.CMB.2.raw
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaaggtaaaatatatatggagactccgtgaaggcattcacatcncagagacaattccaaagacacagtgatctgacaaatgaaacagcctagagagcgtaggggacacggctgtgtattacngtgcgagagcggctggacaacgtacactacctagtttacggtttggacgtcgtacgggggacctaagggacctacgggtcacgtccgtcctaccccgacgtccctacccgaaccgaacgggcccctacgttcccggtcccttcccccgcggcccgcccctcggcctaccgaacggccgtacctaccccg

SEQ ID NO: 298432 - DNA, 709 bp, Homo sapiens
  misc_feature: GZ8MTXP02I2FS7.19.26.C04.1.454.CMB.2.raw
  modified_base (285)..(285): a, c, t, g, unknown or other
  misc_feature (285)..(285): n is a, c, g, or t
  modified_base (333)..(333): a, c, t, g, unknown or other
  misc_feature (333)..(333): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccaccaggctccgaggcaagggggctaggaggtgggtggcagttatatcatatgatggaaggtaaatatatanggagactcgtgaaggcatcacatctccagagacaattaccaagaacanagtgatctcgacaaatgaaacagcctagaggacgcggtggggaaccacgggacgtggttagtaagtttacgtgtaggacgaaggacgcgggccgagggaccaaacgtacacttaccgtaacgttttacggggtttacgggtaccggttacggtacgggggacccgaaaacgggggtacccgaacggggttaccaacgttcccggttacccttaccccccgacggtaccccctacccggaaacccggaaacccgggggtaccccctaacggtttcccccgggttcccctttcccccccggtaccggggtcccccgtacccccggtttccggaccccgttacccggaaaccgggtaccggccccgtaaaacccccggg

SEQ ID NO: 298433 - DNA, 525 bp, Homo sapiens
  misc_feature: GZ8MTXP02FIKKT.19.26.C04.1.454.CMB.2.raw
  modified_base (298)..(298): a, c, t, g, unknown or other
  misc_feature (298)..(298): n is a, c, g, or t
  modified_base (342)..(342): a, c, t, g, unknown or other
  misc_feature (342)..(342): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
  modified_base (396)..(396): a, c, t, g, unknown or other
  misc_feature (396)..(396): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctggggaggtccctgagactctcctgtgcagcctctggattcaccttcagtagctttggcatccactgggtccnccaggctccgaggcaaggggctagagtggggtggcagttatatnatatgatgggaagtaaaatntattatgganactcgtgaaggccgattcacatcnccagagacaatccaaagaacacagtggatctagcaaatgaaacagcctgagagcgtaggggacacgggctggtgttattacgtggtagcgagagcggcgtcggacaaacgtacactaccagtttacggg

SEQ ID NO: 298434 - DNA, 571 bp, Homo sapiens
  misc_feature: GZ8MTXP02HBMIC.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaaggcgattcacatctccagagacaattccaaagaacacagtggatctgacaaatgaaacagcctagagagcgtgggggacacggctgtgtattactgtgcgagagcggcgtggacaactacactaccgtaagtttacggtttgggacgtcgtggggaccgaacgggaccgacggtcacgtccgtacctccccaacgtccctacccaaccgaacggggcccaacgtccgtccttcccccgtggcccgcccgtcgcctccgacggacgacctaaccccg

SEQ ID NO: 298435 - DNA, 547 bp, Homo sapiens
  misc_feature: GZ8MTXP02GQXZC.19.26.C04.1.454.CMB.2.raw
  modified_base (259)..(259): a, c, t, g, unknown or other
  misc_feature (259)..(259): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (344)..(344): a, c, t, g, unknown or other
  misc_feature (344)..(344): n is a, c, g, or t
  modified_base (366)..(366): a, c, t, g, unknown or other
  misc_feature (366)..(366): n is a, c, g, or t
  modified_base (372)..(372): a, c, t, g, unknown or other
  misc_feature (372)..(372): n is a, c, g, or t
  modified_base (375)..(375): a, c, t, g, unknown or other
  misc_feature (375)..(375): n is a, c, g, or t
  modified_base (381)..(381): a, c, t, g, unknown or other
  misc_feature (381)..(381): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (409)..(409): a, c, t, g, unknown or other
  misc_feature (409)..(409): n is a, c, g, or t
  modified_base (471)..(471): a, c, t, g, unknown or other
  misc_feature (471)..(471): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctntggattcaccttcagtagctttggcatccacgtgggtcccnccaggcctccgaggcaaggggctaggnggtggggtgctagttanatcatatgatggaagtaaaatntattanganactcgngaggcatcacatcncaganacatacaanaacacagtgatcagacaagtagaacagaccgtagagacggacggtacgggggacgaccgggntacggttagttacgttacgttggtggacgaggacggcggcgtggactaacgtacacgtacccgtaagtttacgggg

SEQ ID NO: 298436 - DNA, 591 bp, Homo sapiens
  misc_feature: GZ8MTXP02JL4KV.19.26.C04.1.454.CMB.2.raw
  modified_base (284)..(284): a, c, t, g, unknown or other
  misc_feature (284)..(284): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggaggtaaaatatattatgganactccgtgaaggccattcacatctcagagacaattccaaagaacacagtgatctgacaaatgaacagcctgagagctgggggacacgggctgtgtattacgtgtgcgagagcggcgtggacaactacgataccgagtttacggtttggaaccgttcgtacgggggaccctaaacggggaccctaacgggtccacgttccgtacctcccccgaacggccctacccaaccgaaaccggggccccaacgttcccggttcccttcccccgtcggcccgtccccgtcgcctcccgacggaccgaccaccccg

SEQ ID NO: 298437 - DNA, 663 bp, Homo sapiens
  misc_feature: GZ8MTXP02JJKU3.19.26.C04.1.454.CMB.2.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggccgtggggacgtccctgagactctcctgtgcagcctcgtggacttcaccttcgagtacgtctttgctactccgacgtcgggtcccnccgaggtcctccgaggcgaaggggctaggnggtgggtgctagttanatcatangatagggaagtaaaatntaagttagtggacgtcgtaccggtagaacggggcctattccaactatccgtacgaagaagaacctaaacttaccgaaaacgtaacaacgtaggtacggtaactccgtagaactaaaagtacgaaaccgtagacccgtaggaacggacggtacggtacgggggaacctacggggtacgttacggttaggttacttaaccggtggttacggaccgacgggacggtccgggaacgtacgggacctaaaaccggtactaaccgttaccgtaaggttttacccggggg

SEQ ID NO: 298438 - DNA, 573 bp, Homo sapiens
  misc_feature: GZ8MTXP02HXJ59.19.26.C04.1.454.CMB.2.raw
  modified_base (246)..(246): a, c, t, g, unknown or other
  misc_feature (246)..(246): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (301)..(301): a, c, t, g, unknown or other
  misc_feature (301)..(301): n is a, c, g, or t
  modified_base (348)..(348): a, c, t, g, unknown or other
  misc_feature (348)..(348): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctaggaggtgggngcagttatatcatatgatggagtaaatatatanganactcgtgaggcgatcacanctcagagacaattccaaagaacacagtagatctgacaaatgaaaacngcctagagagacgtgggggacacgggctgtgtatactgtgcgagagcgctggacaactacatacctagttacggtttggacgtcgtacggggacccgaaagggaccgacgggtacacgttccggtaccctacccgacgtccctacccgaacgaaccgggccctaaccgtccggtccccttcccccgtggcccgtcccgtcgccctaccgacggtacgaccacccg

SEQ ID NO: 298439 - DNA, 502 bp, Homo sapiens
  misc_feature: GZ8MTXP02I5V7T.19.26.C04.1.454.CMB.2.raw
  modified_base (270)..(270): a, c, t, g, unknown or other
  misc_feature (270)..(270): n is a, c, g, or t
  modified_base (296)..(296): a, c, t, g, unknown or other
  misc_feature (296)..(296): n is a, c, g, or t
  modified_base (328)..(328): a, c, t, g, unknown or other
  misc_feature (328)..(328): n is a, c, g, or t
  modified_base (336)..(336): a, c, t, g, unknown or other
  misc_feature (336)..(336): n is a, c, g, or t
  modified_base (357)..(357): a, c, t, g, unknown or other
  misc_feature (357)..(357): n is a, c, g, or t
  modified_base (363)..(363): a, c, t, g, unknown or other
  misc_feature (363)..(363): n is a, c, g, or t
  modified_base (367)..(367): a, c, t, g, unknown or other
  misc_feature (367)..(367): n is a, c, g, or t
  modified_base (372)..(372): a, c, t, g, unknown or other
  misc_feature (372)..(372): n is a, c, g, or t
  modified_base (383)..(383): a, c, t, g, unknown or other
  misc_feature (383)..(383): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (391)..(391): a, c, t, g, unknown or other
  misc_feature (391)..(391): n is a, c, g, or t
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (419)..(420): a, c, t, g, unknown or other
  misc_feature (419)..(420): n is a, c, g, or t
  modified_base (427)..(427): a, c, t, g, unknown or other
  misc_feature (427)..(427): n is a, c, g, or t
  modified_base (431)..(431): a, c, t, g, unknown or other
  misc_feature (431)..(431): n is a, c, g, or t
  modified_base (455)..(455): a, c, t, g, unknown or other
  misc_feature (455)..(455): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttnagtagcttggcatccacgtgggtccncaggctccgaggcaaggggctaggaggtgggngcagttanatcatatgatggaagtaaatntattangganctcgngaagcatcacntcncanananatacaagacacagngatctagacaannaacagcngagngcgagggacagctgtagtatacgngtcgacgagcggcggcgtacggacaacactactccgtaagtttacgg

SEQ ID NO: 298440 - DNA, 616 bp, Homo sapiens
  misc_feature: GZ8MTXP02JAL1T.19.26.C04.1.454.CMB.2.raw
  modified_base (374)..(374): a, c, t, g, unknown or other
  misc_feature (374)..(374): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (410)..(410): a, c, t, g, unknown or other
  misc_feature (410)..(410): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatcccacgtcggggtcccgccgaggcctccgagggccgaagggggctaggaggtggggtggctagttatatcatatgatggaagtaaatntattangganactcgtgagggcatcacatctcaganacataccaagaacacagtaggaatcgtagactaaatacgaaacagaccgtaggaaggacggtacggtagggggaaccgacgggtaccgttaggttaggttaaacgtttacggtagggttacggacgggtaagggtacggggaccgggtcgtacggggacctaaaccgttaaccgtacgtttacccgttaacggttttaaccggggg

SEQ ID NO: 298441 - DNA, 586 bp, Homo sapiens
  misc_feature: GZ8MTXP02JH3VX.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaaggtaaaatatattatggagactccgtgaaggccgattcacatctcagagacaattcccaaagaacacagtggatctgacaaatgaaacagacctagagagcgtagggggaccaacggggctggtgtaattactggtgcgagagcggctggacaactacatacctagttacgggttggtacgtcgtacgggggaccaaacggggaccacgggtcacgttccgtcctccccgacgccctacccaccgtaacgggaccctacgtcccggttcccttcccccgtcggcccgccccgtcgcctaccgacggaccgcaaccccgg

SEQ ID NO: 298442 - DNA, 541 bp, Homo sapiens
  misc_feature: GZ8MTXP02F6U8A.19.26.C04.1.454.CMB.2.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggaggtccctgagactctcctgtgcagcctctggacttccaccttcagtagctttggcatcccacgtcgggtcccnccaggcctccgaggcgaaggggctaggaggtgggtgctagtttanatcatangatggagactaaaatntattgngganactcgtagaacgggccatcacatcncaganacatacaagacacagtagatctagacaaatagaacacgctagagagcgtaggggacacggctgtagttacttacgtggtcgacgaggacggcggtcgtacggacctaacgtactacgtaccgttaagg

SEQ ID NO: 298443 - DNA, 582 bp, Homo sapiens
  misc_feature: GZ8MTXP02JWR3L.19.26.C04.1.454.CMB.2.raw
  modified_base (364)..(364): a, c, t, g, unknown or other
  misc_feature (364)..(364): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattcccaaagaacacagtggatctgcaaatgaacagcctgagngcgtggggacacgggctgtgtattactgtgcgagagcggctgggacaactacactaccattaaccgggtttggacgtcgtgggggccaaagggaccgaacgggttcaacgttcgtcccgtaccccacggccctcccaacccgaaacggggccccaagtcccgggtcccttccccccgtgggcccgccccttcggcctcccgacggacgcctaaccccg

SEQ ID NO: 298444 - DNA, 654 bp, Homo sapiens
  misc_feature: GZ8MTXP02JH24V.19.26.C04.1.454.CMB.2.raw
  modified_base (364)..(364): a, c, t, g, unknown or other
  misc_feature (364)..(364): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctaggagtgggtggcagttatatcatatgatggaaggtaaaatatattatggagactccgtagaaggccattcacatctcagagacaacttaccaaagaacacgagtggatctacgacaaagtacgaaacngacctagagaagcggtacgggggacaacgggtctaggtgttattacgtgtacgacggaggagcggcgtggactaacgtacacttacctaagtttacgggttaggtaccggttcgtacgggggacccgaaaggggacccgtacgggtcaacgttccgtaccctacccccgagtaccccgtccaaacccggaacggggtcccctaacgttcccggggttccccctttcccccggtcgggcccgtcccccgttacggcccgtacccgaacggggtacccggacctaaccccgg

SEQ ID NO: 298445 - DNA, 697 bp, Homo sapiens
  misc_feature: GZ8MTXP02JY0IB.19.26.C04.1.454.CMB.2.raw
  modified_base (277)..(277): a, c, t, g, unknown or other
  misc_feature (277)..(277): n is a, c, g, or t
  modified_base (281)..(281): a, c, t, g, unknown or other
  misc_feature (281)..(281): n is a, c, g, or t
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcacctggtggagtcgtgggggagcgtggtccagccgtgggacggtccctgagactctcctgtgcagcctcgtgattccaccttnagtntcttgcactccacgtcgggtcccnccgaggcctccgaggacgaaggggctaggnggtggggtgcgtagttatatacaatatagagtaggtaaagttaaaaattgttaattagtcggacgtacttccgggaggaacggggtcctagttccaaccacttcctaaccgagaacgaaactaacttacccgaaaagaaaccacgtagtacggaattaccgtaagaaccgtaaaagtaacgaaaacgaaccggtaccgttaagggaacggtaacgggacgggttacgggggaaccgtaccggggtccgtttacgggttaggtttaacgtttaccgtaagggttcgggtaccggaaggcgggtacggtcgtacgggaactaaaccgtactaaccgttacccgttaacggttttaacccggggg

SEQ ID NO: 298446 - DNA, 595 bp, Homo sapiens
  misc_feature: GZ8MTXP02GFV86.19.26.C04.1.454.CMB.2.raw
  modified_base (295)..(295): a, c, t, g, unknown or other
  misc_feature (295)..(295): n is a, c, g, or t
  modified_base (417)..(417): a, c, t, g, unknown or other
  misc_feature (417)..(417): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagctctcctgtgcagcctctggattcacttcagtgcttggcatccacgtcgggtcccnccaggcctaccgaggacgaaggggctaggaggtggggtgactagttatagtcatatagagtagggaaagtaaaatatattagtgggacgtacgtcggtagaacgggctatcacatcacaganaactataccaagaacagagtgatctagactaaagcgaaacagccgtaggaacgaggacggtaggggacctacgggtcgttacgtaggttaaactttcggaggtacggaccggaaggcggtacgggtcgtacggaccgttaaaccgtaactacgttaacccgttaaggttttaccgggg

SEQ ID NO: 298447 - DNA, 609 bp, Homo sapiens
  misc_feature: GZ8MTXP02JQ3IY.19.26.C04.1.454.CMB.2.raw
  modified_base (256)..(256): a, c, t, g, unknown or other
  misc_feature (256)..(256): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (293)..(293): a, c, t, g, unknown or other
  misc_feature (293)..(293): n is a, c, g, or t
  modified_base (319)..(319): a, c, t, g, unknown or other
  misc_feature (319)..(319): n is a, c, g, or t
  modified_base (357)..(357): a, c, t, g, unknown or other
  misc_feature (357)..(357): n is a, c, g, or t
  modified_base (364)..(364): a, c, t, g, unknown or other
  misc_feature (364)..(364): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagctctcctgtgcagcctntggattcaccttnagtnctttgcatccactgggtccnccaggctccgaggcaaggggctaggngtgggtgctagttatatcatatgataggaagtaaaatntaattangggatactcggtagaagggcctaattcacatctaccagagacaattccaaagaacacagtaggatacgtagaacaaagtagaaacgtacgaccgtaggaacggacgtacggtacgggggaaccgtacgggtaccgttacggttacgttagtttaaccggttaggtcggtaccggaacgggtaacggcgggttccgtagggaacctaaacgtaacctacgttacccgttaagttttaacccggggg

SEQ ID NO: 298448 - DNA, 588 bp, Homo sapiens
  misc_feature: GZ8MTXP02JDHLS.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactccgtgaaggccgattcaccatctccagagacaattacccaaagaacacagtggatctgacaaaatgaaacagcctagagagcgtaggggacacggctagtgtattacgtgtgacgagagcggctggacaacgtacatccgagtttacggtttggacgtcgtacgggggacctaaaggggacccaacgggtcaacgttccgtacctcccccgagtcccctacccaacccgaacggggccccacgtcccggtcccttcccccgtggcccgcccctcgccgtaccacggaccgccgaacccg

SEQ ID NO: 298449 - DNA, 542 bp, Homo sapiens
  misc_feature: GZ8MTXP02I3MOL.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtggcagttatatcatatgatggaggtaaaatatattatggagactccgtgaagggccgattcaccatctccagagacaattccaagacacagtgatctgcaaatgaacagcctgagagcgtgggggacacgggctgtgtattactgtgcgagagcggctggcaacgtacatccatttacggtttggacgtcgtggggccaacgggaccgacggtcactcgtactcccagcctccaccacgggcccacgtccggtccttcccccgtcggccgcccgtcgcctccgacggacgctaacccg

SEQ ID NO: 298450 - DNA, 546 bp, Homo sapiens
  misc_feature: GZ8MTXP02JXQQA.19.26.C04.1.454.CMB.2.raw
  modified_base (433)..(433): a, c, t, g, unknown or other
  misc_feature (433)..(433): n is a, c, g, or t
  modified_base (516)..(516): a, c, t, g, unknown or other
  misc_feature (516)..(516): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggaggcgtggtccagcctgggaggtccctgagactctcctgtgcagcctctggattcaccttcagtagctttggcatccactggtccaccaggctccaggcaaggggctagagtgggtggcagttatatcatatgatggaggtaaaatatattatggagactccgtgaaggccgattcaccatctccagagacaattccaaagaacacagtggatctgcaaatgaaacagacctgacgagctgggggacacggctgtgtattacgtgtgcgagagcgctggcaacgtacatccattacggttggacgtntggggaccaagggaccacggtcacgtcgtccgtaccccacgccctaccaccgaaacggccccaatcccgggcctttcccccgnggccgcccctgcctaccgacgacgcacccg

SEQ ID NO: 298451 - DNA, 626 bp, Homo sapiens
  misc_feature: GZ8MTXP02ICZ7O.19.26.C04.1.454.CMB.2.raw
  modified_base (307)..(307): a, c, t, g, unknown or other
  misc_feature (307)..(307): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtggggaggtccctgagactctcctgtgcagcctctggattccaccttcagtagtctttggcatcccacgtcggggtcccnccgaggcctccgaggccgaaggggctaggaggtggggtggctaggttatatcatatgaagtagggaaagtaaaaatattaagttagtagggagtactccgggtagaacggggcctaattccaccctatcctaccgaagaacgaacctaaattaccgaaagaaacaacgtagtgaaatcgtagactaaaatacgaaactagccgtagagacggcggtaggggaccgacggtctaggtacgttagttacgttaggcggacggaggcggacggtcgtacggaacctaaacgtacctacgttaccgttaacgtttacccgggg

SEQ ID NO: 298452 - DNA, 584 bp, Homo sapiens
  misc_feature: GZ8MTXP02JYFWN.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggagtccctgagactctcctgtgcagcctctggattcacattcagtagctttggcatccacgtgggtcccgccaggcctcccgagggccaagggggctaaggaggtggggtaggctaggttatatcatatgatagggaaaggttaaaatataatttagtgggaacgtacttccggtagaaacggggcctaattccacctatcctaccgagaacgaacaacttaccaaagaaacacagtaggatctagacaaatagaacagtccaggacgagcgtaggggacacggtacgtggtatagttacgtggtacgacgaggacggcggacgtacggacaaacctacgtactaccgttaacgg

SEQ ID NO: 298453 - DNA, 724 bp, Homo sapiens
  misc_feature: GZ8MTXP02JU46S.19.26.C04.1.454.CMB.2.raw
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (334)..(334): a, c, t, g, unknown or other
  misc_feature (334)..(334): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggaggtccctgagactctcctgtgcagcctctggattcaccttcagtagctttggcatcccactgggtccnccaggctccgaggcgaaggggctaggnggtgggngctagttatatcattangagtagggtaaaggtaaaaattgttaagtttagtggggaagtaccgttacccgggtaggaacgggggtcccgtaaatttcccaaccctacttcccgtacccaaggaacgtaaacctaaactttacccgaaaaggtaaaccaacgaacggttagggtaaacttaccgttacggaacctaaaagttaacgaaaccgaacggtaaccgttacggaagggaacggtacggtaccgggggaaccgaccggggtaccgttaggttacggtttaagtttaccggttaggttaggacggtaacgggaacggtccgggaaccgtcgggtaacgtaaaacccggttaactaccgtttacccgttaacggtttttaaccggggg

SEQ ID NO: 298454 - DNA, 730 bp, Homo sapiens
  misc_feature: GZ8MTXP02G2AFT.19.26.C04.1.454.CMB.2.raw
  modified_base (190)..(190): a, c, t, g, unknown or other
  misc_feature (190)..(190): n is a, c, g, or t
  modified_base (255)..(255): a, c, t, g, unknown or other
  misc_feature (255)..(255): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtncacctggtggagtcgtgggggagcgtggtccagcctgggagtccctgagctctctgtgcagcctntgattcaccttnagtgctttggctatccacgtgggtccnccgaggcctccgaggcgaaggggctaggaggtggggtgactagttatactcaatagtagagtaggggtaaaggttaaaaattagttaagtttaagtagggggtaacgttaaccggttacccggggtaaggggtaaaccgggggtccctaatttacccgaaaccctagttaccctacccgaaaggaacgtaaacctaaacgttacccgaaaaggaaacccaacgtaggtacggtaaacttacgtaagaacgtaaaagtacgaaaaccgtacgtacccgtaggaaggacggtacgggtaacgggggaaccgtaacgggtccgttaggttacggttaagttaaccggtgggttacggaccggaacggtacggccggtaacgttacggaaccttaaaaccgtacgtaaccgttaacccggttaaggtttttaacccgggg

SEQ ID NO: 298455 - DNA, 758 bp, Homo sapiens
  misc_feature: GZ8MTXP02JZ93Y.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccgaggcgaagggggctaaggaggtgggtggcagttatatcatatgataggaaggtaaatataattataggagacgtcggtagaacggggccgtatttacaccatcctaccagaacgaactaattaccaaagaacacgagtaggactctagacaaagtagaacagcctaggagagcggtaggggaccgacggtcgttggttacgtactttacgtggtacggacggaagacggcggtacgtacggaccgtaaactaccgtaacttacccgttaaggttttaccggggtttagggaccggtttaccggggtacgggggtaaaccccggaaacggggtaaccccgggtacggttaccggtaccgttccccggttaacccctaccccccgaacggtacccccgttaccccggaaaccccggaaacccgggggtccccctaacgggtttcccccggttacccccgtttccccccggttcgggcccccgttacccccgttcggaccccttacccgggacggtaaacccgcccgtaacccccgg

SEQ ID NO: 298456 - DNA, 622 bp, Homo sapiens
  misc_feature: GZ8MTXP02H23DH.19.26.C04.1.454.CMB.2.raw
  modified_base (215)..(215): a, c, t, g, unknown or other
  misc_feature (215)..(215): n is a, c, g, or t
  modified_base (272)..(272): a, c, t, g, unknown or other
  misc_feature (272)..(272): n is a, c, g, or t
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
  modified_base (409)..(409): a, c, t, g, unknown or other
  misc_feature (409)..(409): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccnccaggctccaggcaaggggctagagtgggtgcagttatatcatatgatggagtaaantatatganatcgtgaaggccgattcacatctccagagactaattacaagaacacagtgatctgacaaatgaacagcctagngagcgtagggggaccaggtctggttagtaacttactggtgacgaggaagcggtcgngggacaaactacatccgtaagtttaccgggtttggaaccgttcggtacgggggacccgaaacggggaccgacggttaccgaacgttccgtcccgtacccccgacgtacccgtccgaaacccgaaacggggcccctaacgttcccggttccctttcccccgcggtcccgtccccgttaacggcccttaccgaccggtaacgcccgtaaccccgg

SEQ ID NO: 298457 - DNA, 684 bp, Homo sapiens
  misc_feature: GZ8MTXP02H4US9.19.26.C04.1.454.CMB.2.raw
  modified_base (279)..(279): a, c, t, g, unknown or other
  misc_feature (279)..(279): n is a, c, g, or t
  modified_base (360)..(360): a, c, t, g, unknown or other
  misc_feature (360)..(360): n is a, c, g, or t
  modified_base (425)..(425): a, c, t, g, unknown or other
  misc_feature (425)..(425): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactggtccacaggctcaggcaaggggctagagtgggtgctagttatatcatatgataggaagtaaatatattanggagactccgtgaacggcattccacatcaccagagaactaattaccaaagaacactagtggatctagacaaatacgaaacncgacctagaggacgcggtacgggggacacgggtcttagtgttaattacgtggtcgacggtaaggnggacggtctaggaccaaactcgaacttaccgtaaggtttacgggtttacggtaccgttcgggacgggggacccgaaacgggacccgaacgggttaccaacgttccccgtaccgtacccccgaacggtacccctacccgaaaccggtaaaccggggtccccctaacggtttcccccggggttccccctttccccccgggtcggcccccgtaccccgttacgggtccccttaaccggacggtaccgtaccccgaaccccgg

SEQ ID NO: 298458 - DNA, 576 bp, Homo sapiens
  misc_feature: GZ8MTXP02JZZZI.19.26.C04.1.454.CMB.2.raw
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
  modified_base (369)..(369): a, c, t, g, unknown or other
  misc_feature (369)..(369): n is a, c, g, or t
  modified_base (381)..(381): a, c, t, g, unknown or other
  misc_feature (381)..(381): n is a, c, g, or t
  modified_base (406)..(406): a, c, t, g, unknown or other
  misc_feature (406)..(406): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggaggtccctgagactctcctgtgcagcctctggattcaccttcagtagctttggcatccacgtcggggtcccnccaggcctccgaggcgaaggggctaggaggtgggtgctagttanatcatatgagtggaagtaaaatntagttatggganactcgtagacgggctatcaccatcnccagacacactaccaaagaacacagtgatctagacaaatacgaaacacgaccgtaggaggacggcggtagggggaaccgacgggtcgttacggttagttacttacggtggtacggcgaacggacggtccggcgtacggactaacgtacacgttaccgtaggtttaccggg

SEQ ID NO: 298459 - DNA, 587 bp, Homo sapiens
  misc_feature: GZ8MTXP02FXDCT.19.26.C04.1.454.CMB.2.raw
  modified_base (277)..(277): a, c, t, g, unknown or other
  misc_feature (277)..(277): n is a, c, g, or t
  modified_base (282)..(282): a, c, t, g, unknown or other
  misc_feature (282)..(282): n is a, c, g, or t
  modified_base (285)..(285): a, c, t, g, unknown or other
  misc_feature (285)..(285): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (304)..(304): a, c, t, g, unknown or other
  misc_feature (304)..(304): n is a, c, g, or t
  modified_base (307)..(307): a, c, t, g, unknown or other
  misc_feature (307)..(307): n is a, c, g, or t
  modified_base (320)..(320): a, c, t, g, unknown or other
  misc_feature (320)..(320): n is a, c, g, or t
  modified_base (328)..(328): a, c, t, g, unknown or other
  misc_feature (328)..(328): n is a, c, g, or t
  modified_base (390)..(390): a, c, t, g, unknown or other
  misc_feature (390)..(390): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccacaggctccgaggcgaaggggctaggagtgggtgcagttatatcatatgatggaagtaaaatntatanganctcgngaggcatcacntcncanagacaatccaaanaacacagnggatctgacaaatacaaactagcctagaggagcggtaggggacacgggctgtagtacttagngtcgagaggagcgcgtagacaactacatacctagtttacgggttgacgttcgtaggggacctaaacgggccgtacggtctacgtccgtccctccccgacgtaccctacccgaaaccgtaacgggcccccacggttccccgtccccgttcccgcggtccccgcgttaccgacgaaccggcggtaccacccgtaaccgg

SEQ ID NO: 298460 - DNA, 735 bp, Homo sapiens
  misc_feature: GZ8MTXP02I9A12.19.26.C04.1.454.CMB.2.raw
  modified_base (273)..(273): a, c, t, g, unknown or other
  misc_feature (273)..(273): n is a, c, g, or t
  modified_base (300)..(300): a, c, t, g, unknown or other
  misc_feature (300)..(300): n is a, c, g, or t
  modified_base (346)..(346): a, c, t, g, unknown or other
  misc_feature (346)..(346): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacggtccctgagactctcctgtgcagcctctggattcaccttnagtagcttggcatccacgtgggtcccnccaggcctccgaggcgaaggggctaggaggtgggtgactagtttanagtcaatagtgtaagtaggggaaaaggttaaaaattattaagtttacgtggggaacgtaacccgttccgggtaaggaaacgggggtccctaaagtttcccgaaaccctagttaccctacccgaaaggaacgtaaaccgtaaactttaccccgaaaagtaaacccacgtaacggtaggtaaacttccgtaaggaactaaaagtacgaaaaccgtacgacccgttaggaaccggaggtaccggtagggggaacctaaccggggtcgttacgggttaggtttaagtttaaccggtgggttacggaccggtaagggtaacgggtaccgggccgttaacggggaaccctaaaccggtacctaacggttaccccgttaaggttttaacccggggg

SEQ ID NO: 298461 - DNA, 581 bp, Homo sapiens
  misc_feature: GZ8MTXP02FR7FX.19.26.C04.1.454.CMB.2.raw
  modified_base (252)..(252): a, c, t, g, unknown or other
  misc_feature (252)..(252): n is a, c, g, or t
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (571)..(571): a, c, t, g, unknown or other
  misc_feature (571)..(571): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttanatcatatgatggagtaaaatatattatgganactccgtgaagggccgatttcaccatctccagagacaattccaaagaacacagtggatctgacaaatgaacagcctagngagcgtaggggacacggctgtgtattactgtgcgagagcggctggacacgtacatacctaagtttacggttggaccgttcgtacgggggaccaaacggggaccacgggtctaacgtccgtcctaccccgacgcccgtaccaccgtaaacgggccctaacgtccggtcccttccccgtcggcccgtccccgtcgacccgtccgacggacnccgaaccccg

SEQ ID NO: 298462 - DNA, 744 bp, Homo sapiens
  misc_feature: GZ8MTXP02H28FY.19.26.C04.1.454.CMB.2.raw
  modified_base (215)..(215): a, c, t, g, unknown or other
  misc_feature (215)..(215): n is a, c, g, or t
  modified_base (451)..(451): a, c, t, g, unknown or other
  misc_feature (451)..(451): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccactgggtccnccaggctccgagggcgaagggggctaggaggtggggtggctagttatatcatatgagtaggaaggtaaaatattaattaagtggagacgtccggtaggaagggccgaatttccacctatcctaccaagaagaacaacttaccaaagaacaacagtaggaatctacgaacaaaagtcgaaacagccgtaggacgaggaccgtagggggacgaacggtcgtgttagtaacgtttacgnggtacggacggaaggcggtcggtacgtacggaacctaacgtactaacgttaccgttaaacggttttacgggttacggtaccggtacgggtaccgggggaaaccgtaacggggaaccccgtacgggttaccgtaccgttacccgtcccctacccccgaacgtaccccgtaaccccggaaaccgggtaacccgggtcccccgtaaccggttcccccgggttccccctttccccccgggaccggtccccgtccccgtacggacccgttacccggaacggacccgtacccgaacccg

SEQ ID NO: 298463 - DNA, 602 bp, Homo sapiens
  misc_feature: GZ8MTXP02FMQEO.19.26.C04.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (299)..(299): a, c, t, g, unknown or other
  misc_feature (299)..(299): n is a, c, g, or t
  modified_base (343)..(343): a, c, t, g, unknown or other
  misc_feature (343)..(343): n is a, c, g, or t
  modified_base (366)..(366): a, c, t, g, unknown or other
  misc_feature (366)..(366): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctggggaggtccctgagactctcctgtgcagcctntggattcaccttnagtagcttggcatccacgtcgggtccnccaggcctccgaggcgaaggggctaggaggtgggtgcagtttantacatatgataggaagtaaaatntattagtggagactcggtagaacgggcctatccacatctacagacgaactaactacaaagaacacgagtgatctagacaaagtagaaacagtaccgagaacggagacggtacggggaacgtacgggtcgttaggtacgttaacgtttacggtggtacggacggtaacggggacgggaccgggtcggtacggaaacctaaaccgtaactaccgttaccgttaacggttttaccgggg

SEQ ID NO: 298464 - DNA, 633 bp, Homo sapiens
  misc_feature: GZ8MTXP02HF9KA.19.26.C04.1.454.CMB.2.raw
  modified_base (268)..(268): a, c, t, g, unknown or other
  misc_feature (268)..(268): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagtctttggcatccacgtggggtccgccaggcctccgagggcgaagggggctaggaggtgggtggctagttatatnatatgatggaaggtaaatatattatggagactccgtagacggccgattcaccatctccagagacaataccaaagaacacagtgactctagacaaatgaacagcctagagagcggtagggggaccacgggtctggttagttagttacttcggtagcggaggaggcggtacgtgggacctaaactactactaccgtagtttacgggttcggtacgttcggtcgggggaccgaacggggacccgacgggtcacgttccgtacccgtccccgacgtcccgtacccgaccggtaaaccggcccctaacgttcccggtccccttcccccgtcggcccgtcccgcgtccgtaccgacggacgccctacccgg

SEQ ID NO: 298465 - DNA, 694 bp, Homo sapiens
  misc_feature: GZ8MTXP02I6FWC.19.26.C04.1.454.CMB.2.raw
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
  modified_base (292)..(292): a, c, t, g, unknown or other
  misc_feature (292)..(292): n is a, c, g, or t
  modified_base (342)..(342): a, c, t, g, unknown or other
  misc_feature (342)..(342): n is a, c, g, or t
  modified_base (376)..(376): a, c, t, g, unknown or other
  misc_feature (376)..(376): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggaggtccctgagactctcctgtgcngctctgattcacttnagtgcttgcatccactgggtccnccaggcctccgaggcgaaggggctaggagtgggtgctagttatatcatangagtaggaaagtaaaattattaattagtgggtanacgtaccggtagaacggggtcctattaccgacctatcctacgaagtaacgaactaaacttacccaaaagaacctaacgaggtaggaacttacgtacgaaacttaaaagaccggaaacgaacggtaacccgtaggaaacgggacgggtaaccggggttacgggggaacccgtaaccgggttcggtttaacggttaggttttaaacgttaaccggttgggttacggccgggtaaacggaacggggtccgggaacgttacggggaacccttaaaaccgtacccgttaacgttacccggtttaaggtttttaaacccggggg

SEQ ID NO: 298466 - DNA, 576 bp, Homo sapiens
  misc_feature: GZ8MTXP02FTZX4.19.26.C04.1.454.CMB.2.raw
  modified_base (363)..(363): a, c, t, g, unknown or other
  misc_feature (363)..(363): n is a, c, g, or t
  modified_base (389)..(389): a, c, t, g, unknown or other
  misc_feature (389)..(389): n is a, c, g, or t
  modified_base (397)..(397): a, c, t, g, unknown or other
  misc_feature (397)..(397): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaagtaaaatatattatggagactccgtggaaggccgattcaccatctccagagacaatccaaagaacacagtgatctagacaaatgaacagcctgagngcgtaggggacacggctgtgtattangtgcgagngcggctgacaacgtacactaccgtagtttacggttggacgtcggtacggggccaaacgggccacggtcacgtccgtacctccccgacgccctaccgaaccgtacgggacccacgttcccgtccccgttcccccgtcgggcccgtcccgtacgcccgtacccgacggaccgtccaacccg

SEQ ID NO: 298467 - DNA, 643 bp, Homo sapiens
  misc_feature: GZ8MTXP02F2ELV.19.26.C04.1.454.CMB.2.raw
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctggggagtccctgagactctcctgtgcagcctcgtggacttcaccttcagtagtctttggctactcccacgtcgggtcccgccgaggcctccgagggacgaaggggctaggaggttggggtcggctaaggtttatatctaatagtagaagttaggggaaaagttaaaaattagttaagttaagtcggggaagtacccgttaccggtagggaacggggtcctaatttacccaacctatccctaccgaaggtaacaactaaacttaccgaaacgaacacgaaggtggaacttacgagaacaaagtagaaacgagtccaggaagcggacggtggggacacgggtcttaggtagttatacgtggtagcggaagcggaccggtgtcggactaacgtactaacgtccgtaaggttttaccgggg

SEQ ID NO: 298468 - DNA, 587 bp, Homo sapiens
  misc_feature: GZ8MTXP02JXIAH.19.26.C04.1.454.CMB.2.raw
  modified_base (387)..(387): a, c, t, g, unknown or other
  misc_feature (387)..(387): n is a, c, g, or t
  modified_base (440)..(440): a, c, t, g, unknown or other
  misc_feature (440)..(440): n is a, c, g, or t
tcagtactctcgtgcacgaccggtgctcgatttagtctagcgactttgggtttggggagaggagcccagcactagaagtcggcggtgtttccattcggtaatcagcactgaacacagaggactcaccatggagtttgggctgagctgggttttcctcgttgctcttttaagaggtgtccagtgtcaggtgcacctggtggagtcgtgggggaggcgtggtccagcctgggaggtccctgagactctcctgtgcagcctctggacttcaccttcagtagctttggcatcccacgtcgggtccccgccgaggcctccgagggccgaaagggggctaggaggtggggtggctagttatatcatagtgagtaggaagtaaaatatattagnggagtacctccggtaggaacggggccgtattccgaccactacctacccagaanactaactaccaagaaacacgagagatctagacaaatagaaccagccgtagagagcggacggggacgacggcgtgtagttagttacgtggtgacggacgacggcggcgtaaggaccaacgtacactaccgtagtttacggtttacggg

SEQ ID NO: 298469 - DNA, 664 bp, Homo sapiens
  misc_feature: GZ8MTXP02HN2Z7.19.26.C04.1.454.CMB.2.raw
  modified_base (282)..(282): a, c, t, g, unknown or other
  misc_feature (282)..(282): n is a, c, g, or t
  modified_base (613)..(613): a, c, t, g, unknown or other
  misc_feature (613)..(613): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaagtaaatatatatgganactccgtaggaaggccgtattcaccatctccagagacaattacaaagaacacagtggatctagacaaatcgaaacagcctgagagcgtacgggggacaacggctaggtgttagttacgtggtgacggaggagggcggacgttggacctaaactaacaacgttacccgtaaagttttacggggtttacgggtaccggttacggttacgggggaacccgtaaaccgggggacccgtaccgggtacgtaaaccgttccggttccctacccccgacggtacccctacccgacccgaaccggggacccctacgtcccggttcccgtttccccccgngggtccccgccccgttacggcccttaccgacggacgaccccgtaaccccgg

SEQ ID NO: 298470 - DNA, 641 bp, Homo sapiens
  misc_feature: GZ8MTXP02G47BT.19.26.C04.1.454.CMB.2.raw
  modified_base (259)..(259): a, c, t, g, unknown or other
  misc_feature (259)..(259): n is a, c, g, or t
  modified_base (273)..(273): a, c, t, g, unknown or other
  misc_feature (273)..(273): n is a, c, g, or t
  modified_base (324)..(324): a, c, t, g, unknown or other
  misc_feature (324)..(324): n is a, c, g, or t
  modified_base (331)..(331): a, c, t, g, unknown or other
  misc_feature (331)..(331): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacgtggtggagtcgtgggggagcgtggtccagccgtgggagtccctgagactctcctgtgcagcctntggattccaccttngtacgcttggcatccacgtgggcgccaggcctcgaggcgaaggggctaggnggtgggngactagttatatcatatgtagtagggaaagttaaaattagttagttaagtgggaacgtaccgtccggtagggaagggcccgtattacccgaccgtacttacccgtaccgaagaacgtaacctaaacgttacccgaaaacgtaaccgtaaacgtaacggtaggtaaactccgttaaggaacctaaaaggtacaaacgtaccgacgtagaacggagtcggtacgggacgaacggtcgtaggttacgttagtacgtggtagtacgaggtcggacgcgtacgaccgtaactacgtactacgtacgtttacgggg

SEQ ID NO: 298471 - DNA, 696 bp, Homo sapiens
  misc_feature: GZ8MTXP02JJ8Z7.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccacaggctccaggcaaggggctaggagtgggtgcagttatatcatatgatggaagtaaaatataattatggagactccgtaggaaggccgtattcaccatactccaagagacaattaccaaagaacacagtagatctagacaaaatgaaacagacctagagagcgtagggggaacacgggtctaggtagttaaagttctggtgacgaagaggcggcgtaggaccaaactacaacttacccgtaagtttaaccggggtttagggaaccgttcgggtacggggggaaccccgaaaagggggtacccgtaacggggtactaacgtcccggttaccctacccccgaacgtccccgtaaccccgaaacccggtaaaccggggaccccctacgggttccccgggttacccccttttacccccccggcggggccccgtcccccgttaccggtcccgtacccggaaccgggtacgaccccgtaaacccccgg

SEQ ID NO: 298472 - DNA, 622 bp, Homo sapiens
  misc_feature: GZ8MTXP02FP0Y9.19.26.C04.1.454.CMB.2.raw
  modified_base (259)..(259): a, c, t, g, unknown or other
  misc_feature (259)..(259): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacgtccctgagactctcctgtgcagcctntggacttcaccttcagtagctttggctactccacgtcgggtcccgccaggcctccgaggacgaaggggctaggaggtgggtgactagttatatcaatagtgagtaggaaagtaaatatattagtggatacgtcgtagaacgggcgtactcacctatactacaagtaacaactaaacttaccgaaaagtaacacgtaagtaggactacgtagaactaaatacgaaacacgtaccgtaggaggacggtcggacggggaacgtcgggtacgttaggttacgttaagtttacgtggtacggacggacggtaggccggtcgtacggaactaaccgtactaacgttacccggttaaggttttaccgggg

SEQ ID NO: 298473 - DNA, 565 bp, Homo sapiens
  misc_feature: GZ8MTXP02FNWD8.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgttgtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactcgtgaaggcgattcacatctccagagacaataccaaagacacagtggaatctgacaaatagaacagcctagagagcgtggggacacggctgtgtattactgtgcgagagcggctggacaactacatacctagttacggttggacgtcgtcgggggaccaaacggggaccacggtcgacgtccggtctaccccgacgccctaccgaccgaaacgggcccacgtccggtccctccccgtcggcccgtccctcgcctaccggacggacgccgtaaccccg

SEQ ID NO: 298474 - DNA, 531 bp, Homo sapiens
  misc_feature: GZ8MTXP02GPF1P.19.26.C04.1.454.CMB.2.raw
  modified_base (274)..(274): a, c, t, g, unknown or other
  misc_feature (274)..(274): n is a, c, g, or t
  modified_base (290)..(290): a, c, t, g, unknown or other
  misc_feature (290)..(290): n is a, c, g, or t
  modified_base (295)..(295): a, c, t, g, unknown or other
  misc_feature (295)..(295): n is a, c, g, or t
  modified_base (311)..(311): a, c, t, g, unknown or other
  misc_feature (311)..(311): n is a, c, g, or t
  modified_base (324)..(324): a, c, t, g, unknown or other
  misc_feature (324)..(324): n is a, c, g, or t
  modified_base (326)..(326): a, c, t, g, unknown or other
  misc_feature (326)..(326): n is a, c, g, or t
  modified_base (329)..(329): a, c, t, g, unknown or other
  misc_feature (329)..(329): n is a, c, g, or t
  modified_base (343)..(343): a, c, t, g, unknown or other
  misc_feature (343)..(343): n is a, c, g, or t
  modified_base (380)..(380): a, c, t, g, unknown or other
  misc_feature (380)..(380): n is a, c, g, or t
  modified_base (408)..(408): a, c, t, g, unknown or other
  misc_feature (408)..(408): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggaggtcctgagactctcctgtgcagcctctggattcacttcagtncttgcatccatggccncagcncaggcaggggctaggngtggtgcagttantnatngataggaataaatntatagtgatactcgtagaacgctatcacatcacaganactactacaacgaacagagtagatcganacaatacgaacagaccgtaggacgacggtcggacgggacgacggtcgtacgttagtacttacgtaggtacgacgacgacggacgtaacgtacggacgtaactactacgtacgttacgttacgg

SEQ ID NO: 298475 - DNA, 616 bp, Homo sapiens
  misc_feature: GZ8MTXP02JI4JO.19.26.C04.1.454.CMB.2.raw
  modified_base (272)..(272): a, c, t, g, unknown or other
  misc_feature (272)..(272): n is a, c, g, or t
  modified_base (281)..(281): a, c, t, g, unknown or other
  misc_feature (281)..(281): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (350)..(350): a, c, t, g, unknown or other
  misc_feature (350)..(350): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggagtaaatntatatgganactcgtgaaggccatcacatcncagagacaataccaagacacagtgatctgacaaatgaacngcctagngagcgtaggggacacggctgtgtattactggtgcgagtagcggcgtggactaacgtacatacctagtttacggtttggaacgtcggtacgggggaccaaacggggacccgaacggggtactaacgttccggtaccctaccccgaacgtccccgtacccgaacccggaaacgggccccctaacggttcccgggttaccccctttccccccggcgggccccgttccccgcgttaccccgtaccgacgggtaccggaccctaaccccgg

SEQ ID NO: 298476 - DNA, 617 bp, Homo sapiens
  misc_feature: GZ8MTXP02FPK0D.19.26.C04.1.454.CMB.2.raw
  modified_base (267)..(267): a, c, t, g, unknown or other
  misc_feature (267)..(267): n is a, c, g, or t
  modified_base (319)..(319): a, c, t, g, unknown or other
  misc_feature (319)..(319): n is a, c, g, or t
  modified_base (337)..(337): a, c, t, g, unknown or other
  misc_feature (337)..(337): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagtctttggcatccactcgggtccaccaggcctccgaggcgaaggggctaggaggtgggtggcagttatatcatangatggaagtaaaatatattatggagactcgtgaaggcgatcacatctcaganacatacaaagaacacagngatctacgacaaatagaacagcctagagagcgtaggggaccacggcttgtagttaattacgtggtgacgtagaggcggactacggaacctaaaccgtactacgtacccgtagtttaacggggtttcggaaccggttcggtacgggggaaccgaaacggggacccgtacgggtactacgtccgtaccctacccgacgccctaccgaaccgaaacgggcccacggttcccgttccctcccccgtcggcccgtccctcggccctacgacggaccgacaacccg

SEQ ID NO: 298477 - DNA, 676 bp, Homo sapiens
  misc_feature: GZ8MTXP02GQ4J4.19.26.C04.1.454.CMB.2.raw
  modified_base (193)..(193): a, c, t, g, unknown or other
  misc_feature (193)..(193): n is a, c, g, or t
  modified_base (264)..(264): a, c, t, g, unknown or other
  misc_feature (264)..(264): n is a, c, g, or t
  modified_base (276)..(276): a, c, t, g, unknown or other
  misc_feature (276)..(276): n is a, c, g, or t
  modified_base (280)..(280): a, c, t, g, unknown or other
  misc_feature (280)..(280): n is a, c, g, or t
  modified_base (304)..(304): a, c, t, g, unknown or other
  misc_feature (304)..(304): n is a, c, g, or t
  modified_base (356)..(356): a, c, t, g, unknown or other
  misc_feature (356)..(356): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagtcttgggttttcctcgttgcttcttttaagaggtgtccagtgtcaggtncacctggtggagtcgtgggggaggcgtggtccagccgtgggacgtccctgacgactctcctgtgcagcctntgattcaccttnagtnctttggcatccacgtcgggtcccncgaggcctccgaggacgaaggggctaggaggtgggtgctagttatatcatanagtagtagggtaaagttaaaatnttaagttagtggacgtacgttccgggtaaggaacggggtccctaatttaccaaaccctattaccctacgaaggaacgtaaacctaaacttaacccgaaaacggaaaccaacgtaagtacggaacttaccgtaagaaacctaaagtaacgaaacgacgaccgtagaacggaggacggtacggggaaccgtacgggtacgttacggttagttaactttacgggacggtacggacggtacggacggacggtaacgtacggtaactaaccgtacgtaccgttaccgttaacggtttaccgg

SEQ ID NO: 298478 - DNA, 606 bp, Homo sapiens
  misc_feature: GZ8MTXP02H2UCG.19.26.C04.1.454.CMB.2.raw
  modified_base (245)..(245): a, c, t, g, unknown or other
  misc_feature (245)..(245): n is a, c, g, or t
tcagtactctcgtgcacgaccggtgctcgatttagtctagcgactttgggtttgggctgagctgggtttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactgggtccaccaggctccaggcaagggctagagtgggngcagttatatcatatgataggaaggtaaaatatattatggagactccgtgaaggcattcaccatctccaagagaacaattaccaaagaaacacagtggatctagacaaaatgaaacagcctagagagcgtagggggacacggctaggttcgtattactgtgcgagaggcggctggacaacgtacaactctagttacggtttggaccggttgtacgggggtacgaaacgggaccgacggtacgatccgtcctccccacgaccctaccgacccgaaacgggcccctaacgttcccggttcccgttcccccgtcgggtccccgtccccgttacgcccgttaccgacggaccgacccgaaccccg

SEQ ID NO: 298479 - DNA, 764 bp, Homo sapiens
  misc_feature: GZ8MTXP02IG5XD.19.26.C04.1.454.CMB.2.raw
  modified_base (282)..(282): a, c, t, g, unknown or other
  misc_feature (282)..(282): n is a, c, g, or t
  modified_base (293)..(293): a, c, t, g, unknown or other
  misc_feature (293)..(293): n is a, c, g, or t
  modified_base (316)..(316): a, c, t, g, unknown or other
  misc_feature (316)..(316): n is a, c, g, or t
  modified_base (322)..(322): a, c, t, g, unknown or other
  misc_feature (322)..(322): n is a, c, g, or t
  modified_base (402)..(402): a, c, t, g, unknown or other
  misc_feature (402)..(402): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagcttttggcatcccacgtggggtccgccaggctccgaggcgaaggggctaggagtggggtgctagttatatcatatgatggaagtaaatntattagtgganactcgagacggcctatcacatcncaaganaacataccaaagacacgagtcgatctacgaacaaagtacgaaacacgacctagggagggacgtcggtaacgggggaaccncgggggtactagggttaagttaacgttacgtggtcggacggaggacggcggacttacgggaacctaaactaaccgtacgttacccgttaacggttttaccggggttacgggtaccggttacgggtaccgggggaacccggaaacggggtaccccgtacgggttacctaacggttcccggttacccctaccccggaacgttacccccgtaacccggaaacccggaaacccgggggttccccctaaaccgggtttcccccgggtttacccccgttcccccccgggttacggggcccccgttacccccggttccggtaccccgtacccgggtaccgggggtaccacccccggtttaaacccccgg

SEQ ID NO: 298480 - DNA, 624 bp, Homo sapiens
  misc_feature: GZ8MTXP02F2VV0.19.26.C04.1.454.CMB.2.raw
  modified_base (305)..(305): a, c, t, g, unknown or other
  misc_feature (305)..(305): n is a, c, g, or t
  modified_base (355)..(355): a, c, t, g, unknown or other
  misc_feature (355)..(355): n is a, c, g, or t
  modified_base (382)..(382): a, c, t, g, unknown or other
  misc_feature (382)..(382): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagccgtgggacgtccctgagactctcctgtgcagcctctggacttcaccttcagtagctttggcatcccacgtcggggtcccnccgaggcctccgaggcgaaggggcctaggaggtggggtgctaaggtttanatcaatatgagtaggaaagttaaaatnttattagtggacgtacgtccggagaacgggcctattccaactatcctacaagacgaactaactaccaaagaaaccacgaagtggtaactcgtacgaactaaaagtacgaaacacgaccgtaggagacgtacggaggggaaccgtacgggtcgttacggttagttaagttacgtggtacggcggaaaggcggtacggcgtacggaacctaaactacgtacgttaccgtaacggttttaacggg

SEQ ID NO: 298481 - DNA, 573 bp, Homo sapiens
  misc_feature: GZ8MTXP02G5H0O.19.26.C04.1.454.CMB.2.raw
  modified_base (260)..(260): a, c, t, g, unknown or other
  misc_feature (260)..(260): n is a, c, g, or t
  modified_base (272)..(272): a, c, t, g, unknown or other
  misc_feature (272)..(272): n is a, c, g, or t
  modified_base (303)..(303): a, c, t, g, unknown or other
  misc_feature (303)..(303): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (405)..(405): a, c, t, g, unknown or other
  misc_feature (405)..(405): n is a, c, g, or t
  modified_base (408)..(408): a, c, t, g, unknown or other
  misc_feature (408)..(408): n is a, c, g, or t
  modified_base (413)..(413): a, c, t, g, unknown or other
  misc_feature (413)..(413): n is a, c, g, or t
  modified_base (415)..(415): a, c, t, g, unknown or other
  misc_feature (415)..(415): n is a, c, g, or t
  modified_base (431)..(431): a, c, t, g, unknown or other
  misc_feature (431)..(431): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgtgggggagcgtggtccagccgtgggagtccctgagctctcctgtgcagcctntggattcacttnagtagtctttggctatccgacgtcgggtccnccaggcctccgagggcgaaggggctaggaggtggggtcgctagtttanatcatangagtggaagtaaatntattagnggatacgtcgagacggctatcactntcncagananactacaagaacacagngatctagactaaatagaacacgacgtagagacggcggtagggacgacgggtcttaggtacgttagttacgtggtacgtacggacggacggcggtcgtacggaacctaacgtactaacgttacccgttaaggttttaccgggg

SEQ ID NO: 298482 - DNA, 707 bp, Homo sapiens
  misc_feature: GZ8MTXP02HFX8Y.19.26.C04.1.454.CMB.2.raw
  modified_base (281)..(281): a, c, t, g, unknown or other
  misc_feature (281)..(281): n is a, c, g, or t
  modified_base (290)..(290): a, c, t, g, unknown or other
  misc_feature (290)..(290): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagctttggcatccacgtgggtccgccaggctccgaggcgaaggggctaggaggtgggtggctagttatatcatatgatggaagtaaatntatatgganactcgagaaggccattcacatctcagagacaatacccaaagaacacgagtggatcgtagactaaaagtcgaaacacgtcctaggaggacgcggtacgggggaccacggggtcttagggttagttaaattacgttggtagacggaagacgggcgggacgtaggacctaaaacctactaacgttacccgtaaggtttaccggggtttacggacggtttaccggtcgggggaacccgtaaacggggccccgtaaacgggttctaaccgttccggtaccctacccccgacggtacccctaacccgaacccggaaaccgggtcccctaacggtttccccgggttacccctttcccccggtacgggtccccgtcccccgttacggccccgttaccggaacggggttaccacccgtaaccccgg

SEQ ID NO: 298483 - DNA, 631 bp, Homo sapiens
  misc_feature: GZ8MTXP02FUA9G.19.26.C04.1.454.CMB.2.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (298)..(298): a, c, t, g, unknown or other
  misc_feature (298)..(298): n is a, c, g, or t
  modified_base (344)..(344): a, c, t, g, unknown or other
  misc_feature (344)..(344): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtncacctggtggagtcgtgggggagcgtggtccagcctgggagtccctgagactctcctgtgcagcctctggacttcaccttnagtgctttggcatccacgtgggtcccncaggcctccgaggcgaaggggctaggaggtgggtgctagttatatnatatgatagggaaagtaaaatataattagtgggactacgtcggtagaacgggtcctatccacctagtccctacaagacgaactaaattacccgaaaagaaccaacgtaagtggaacttaccgtagaactaaaagtacgaaacacgtaccgtaggaacggaggtacggtacgggggaacctcgggtacgttaggttagtttaacgttaccgtacgggtacggacggtaaggacggaccgggtaacgacggaacctaaacgtactactacggttacgttttaaccgggg

SEQ ID NO: 298484 - DNA, 645 bp, Homo sapiens
  misc_feature: GZ8MTXP02FTGYS.19.26.C04.1.454.CMB.2.raw
  modified_base (253)..(253): a, c, t, g, unknown or other
  misc_feature (253)..(253): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttanatcatatgatggaaggtaaaatatattatggagactccgtgaaggccgattcaccatctcagagacaattccaagaacacagtggaatctgacaaaatgaaacagcctagagagcgtgggggaccacgggctgtgtattactgtgcgagagcggctggctaaacacgataccgtagtttacgggtttacggacggttcgtacgggggacccaaacgggggacccgtacgggtactaacgttccggttaccctcccccgaacggtccccttaccccgaaacccgaaaccgggggcccccaaacggttcccggggttcccctttcccccccgtcggggccccgtcccccttcgggacccttccccggaacgggtaaccgcccgtaaacccccgg

SEQ ID NO: 298485 - DNA, 679 bp, Homo sapiens
  misc_feature: GZ8MTXP02FO1LD.19.26.C04.1.454.CMB.2.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggacttcaccttcagtagtctttggcatccacgtcgggtccgccaggcctccgaggcgaaggggctaggagtgggtgctagttatatcatatgatggaagtaaatatattagtggagactccgtaggaacggcgattcacatctcagagacaataccaaagaacacgagtggatctagacaaatcgaaacacgacctaggaggagtcggtagggggaaccacgggtcttaggtagttattacgtaggtgacggagacggcggcgtacggaacctaacgtaacgacgttaccgttaacgtttacggggtttcgggtaccggttcgggtaccgggggtaacccgaaacgggggtacccgtacgggtcctaacgttcccggtccctaccccgacgtccccaacccgacccgaaaccgggcccctaaccggttcccggtaccccttcccccggtggccccgtcccgtaccggtacccgtacccggacggaaccgcccgtaaccccgg

SEQ ID NO: 298486 - DNA, 648 bp, Homo sapiens
  misc_feature: GZ8MTXP02JWC52.19.26.C04.1.454.CMB.2.raw
  modified_base (338)..(338): a, c, t, g, unknown or other
  misc_feature (338)..(338): n is a, c, g, or t
  modified_base (394)..(394): a, c, t, g, unknown or other
  misc_feature (394)..(394): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagtctttggcatccacgtcgggtcccgccaggcctccgagggcgaagggggctaggaggtggggtggctagttatatcatatgatggaagtaaatatattatggagactcgtagaaggccatcacatctacagagacaataccaaanaacacagtgatctgacaaatagaaacagcctagagagcggtagggggacacgggtntggtagtattacgtgtgcgagacgcggctggactaacgtacattacccgtagtttaaccgggtttacgggaccggttacggttacgggggacccgaaacggggacccgtaaccgggtacgtacgttcccggtcccctaccccgaccgtcccctacccgaaccggtaaccggggacccctacgtcccggttccccgttcccccggtcggccccgtaccccgtcgcccgtaccgacgggacctaccgaacccccgg

SEQ ID NO: 298487 - DNA, 619 bp, Homo sapiens
  misc_feature: GZ8MTXP02IWL88.19.26.C04.1.454.CMB.2.raw
  modified_base (253)..(253): a, c, t, g, unknown or other
  misc_feature (253)..(253): n is a, c, g, or t
  modified_base (258)..(258): a, c, t, g, unknown or other
  misc_feature (258)..(258): n is a, c, g, or t
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggagtccctgagactctcctgtgcngcctntggattcaccttnagtgctttggctatccgacgtcgggtcccnccaggcctccgaggcgaaggggctaggaggtgggtgcagtttatatcatagtgagtggaaagttaaaatgttaattagtgggatacgttccggaggaacgggctagttccaacctatcctcgaagacactaactaccaaagtaacacagtacggtataccgtagaactaaagtagaacgacgtaccgtggaagacggtacggtaggggaaccgcgggtcgttaggttagttacgtttacgtggtacggtcggaaaggtcggaccgggtcgtacggaacctaaacctacgtacgtttacccgtaggttttaacccgggg

SEQ ID NO: 298488 - DNA, 621 bp, Homo sapiens
  misc_feature: GZ8MTXP02H9LXB.19.26.C04.1.454.CMB.2.raw
  modified_base (258)..(258): a, c, t, g, unknown or other
  misc_feature (258)..(258): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcactggtggagtcgtgggggaggcgtggtccagccgtgggagtccctgagactctctgtgcagcctnggacttcaccttcaggtagtcgtttggctatcccgacgtcggggtcccgccaggccctccgaggcgaaagggggtctaggagggttgggtgctaaggttatatcatatgatagggaagtaaaatntaattatgggaagtactccggtaggaaacgggtccgtaattaccaaccgtatcctaccgaagaacgaactaaacttaccaaagaaacaacagtagaagtactacgaacaaagtagaaacagccgagacggaggcggtaggggaacgacggtcgtaggttagtattacgtggtaggcgaacggtaggcgggtaacgacggtaccgaaactacgtacttaccgttaacggtttaccgggg

SEQ ID NO: 298489 - DNA, 600 bp, Homo sapiens
  misc_feature: GZ8MTXP02GHFUJ.19.26.C04.1.454.CMB.2.raw
  modified_base (285)..(285): a, c, t, g, unknown or other
  misc_feature (285)..(285): n is a, c, g, or t
tcagtactctcgtgcacgaccggtgctcgatttagtctagcgactttgggtttgggctgagctgggtttttcctcgttgctacttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtgcagttatatcatatgatggagtaaaatatattatgganactccgtgaaggcgattcaccatctccagagacaatccaaagaacacagtgatctgacaaatgaacagcctagagagcgtggggacacggctgtagttattacgtgtgacgaggagcggctcggacaactacatacctaatttacgggttggacgttcgtgggggacccaaacggggacccacgggttcaacgttccgtcccgtacccccacggtcccctacccgaaaccgaaacggggccccaacgttcccgggttcccttccccccgtgggccccgtccccgtcgcccgtcccgaacggccgaccgaaccccg

SEQ ID NO: 298490 - DNA, 589 bp, Homo sapiens
  misc_feature: GZ8MTXP02H9VLK.19.26.C04.1.454.CMB.2.raw
  modified_base (214)..(214): a, c, t, g, unknown or other
  misc_feature (214)..(214): n is a, c, g, or t
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (386)..(386): a, c, t, g, unknown or other
  misc_feature (386)..(386): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtggcagttatatcatatgatggaagtaaatatatanganactcgtgaggccatcacatctccagagacaattccaaagaacacagtggatctagacaaatgaaacagcctgagagcgtagggggacacgggctgtgtattacngtgcgagagcggctggacaacgtacactaccgtagtttacggttggtaccgtcggtcggggaccgaaacggggaccgacgggtctacgtccgtcctaccccgacgtccctaccgaacccgtaaacggacccctacgttcccggtccccttcccccgtcggccccgtcccgtacgtcccgtaccgacggtacgacccgtacccg

SEQ ID NO: 298491 - DNA, 436 bp, Homo sapiens
  misc_feature: GZ8MTXP02JP101.19.26.C04.1.454.CMB.2.raw
  modified_base (275)..(275): a, c, t, g, unknown or other
  misc_feature (275)..(275): n is a, c, g, or t
  modified_base (356)..(356): a, c, t, g, unknown or other
  misc_feature (356)..(356): n is a, c, g, or t
  modified_base (363)..(363): a, c, t, g, unknown or other
  misc_feature (363)..(363): n is a, c, g, or t
  modified_base (369)..(369): a, c, t, g, unknown or other
  misc_feature (369)..(369): n is a, c, g, or t
  modified_base (397)..(397): a, c, t, g, unknown or other
  misc_feature (397)..(397): n is a, c, g, or t
  modified_base (407)..(407): a, c, t, g, unknown or other
  misc_feature (407)..(407): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (420)..(436): a, c, t, g, unknown or other
  misc_feature (420)..(436): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccaccaggctccaggcaaggggctagagtgggtgctagttatatcatatgatggagtaaaatntattatggagactcgtgaaggccgattcacatctccagagacaattaccaaagaacacagtgatctcgacaaagtgaaacngcctagngagtgnggggacacgggctgtgtaaatctgtcgngagagcgggngngagagngngannnnnnnnnnnnnnnnn

SEQ ID NO: 298492 - DNA, 803 bp, Homo sapiens
  misc_feature: GZ8MTXP02HQGX8.19.26.C04.1.454.CMB.2.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (288)..(288): a, c, t, g, unknown or other
  misc_feature (288)..(288): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccacgtgggtccnccaggcctccgaggcaagggggctaggaggtgggtgcagttanatcatatgataggaagtaaatatattagnggagactccgtagaagggccgtattccacatcctaccagagacaattccaaagacacagtgatctgacaaatgaacagcctagacgagcgtaggggacctacggcgttgtagttattacgtggtacggacggaaggaggccgggtacgttacgggaacccaaacgtttacaaccgtttacccgttaaaggtttttaccgggggtttttacgggaacccgggtttccgggtacggggggtaaccccgtaaacgggggaccccctaacgggggttaccctaaacggtttcccccgggtccccttaaccccccggaaaccggttccccccgttaaaacccccggtaaacccccgggaaaacccgggggtcccccctttaaacggggttaccccccgggggtttacccccttttaccccccccgggaccgggggttccccccgtaaccccccggttaccgggttcccccggtaacccggtaacccgggggtaccaccccccggtttaaaccccccgggg

SEQ ID NO: 298493 - DNA, 696 bp, Homo sapiens
  misc_feature: GZ8MTXP02IBB6D.19.26.C04.1.454.CMB.2.raw
  modified_base (316)..(316): a, c, t, g, unknown or other
  misc_feature (316)..(316): n is a, c, g, or t
  modified_base (365)..(365): a, c, t, g, unknown or other
  misc_feature (365)..(365): n is a, c, g, or t
  modified_base (371)..(371): a, c, t, g, unknown or other
  misc_feature (371)..(371): n is a, c, g, or t
  modified_base (385)..(385): a, c, t, g, unknown or other
  misc_feature (385)..(385): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggaggcgtggtccagccgtgggaggtccctgacgactctcctgtgcagtcctgtggtacttccacctttcagtacgtctttggacctatcccgacgtcgggtcccncccgaggcctccgaggaccgaaggggctaggaggtgggtggctagttanatcatngataggaataaatntatagtgatacgtcgtagaacggggcctattaccacccgtatcctaccgaagtaacgaaacctaacttaccaaaagaaccaacgagtaggtaactccgttaaggaaactaaaagtacgaaacgtacgtaccgtaaaggaccggaaggaccggttacgggggaaccgtacccggggtacgtttaacggttacggtttaaaacgttcgtttaagggtccggacgggtaaagggtccgggtaaccgggccggttacggaaccgtaaaacctaaccgtaaccgtttaacccgtttaagggttttaaacccggggg

SEQ ID NO: 298494 - DNA, 569 bp, Homo sapiens
  misc_feature: GZ8MTXP02IJ4YY.19.26.C04.1.454.CMB.2.raw
  modified_base (214)..(214): a, c, t, g, unknown or other
  misc_feature (214)..(214): n is a, c, g, or t
  modified_base (282)..(282): a, c, t, g, unknown or other
  misc_feature (282)..(282): n is a, c, g, or t
  modified_base (288)..(288): a, c, t, g, unknown or other
  misc_feature (288)..(288): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (366)..(366): a, c, t, g, unknown or other
  misc_feature (366)..(366): n is a, c, g, or t
  modified_base (371)..(371): a, c, t, g, unknown or other
  misc_feature (371)..(371): n is a, c, g, or t
  modified_base (382)..(382): a, c, t, g, unknown or other
  misc_feature (382)..(382): n is a, c, g, or t
  modified_base (473)..(473): a, c, t, g, unknown or other
  misc_feature (473)..(473): n is a, c, g, or t
  modified_base (532)..(532): a, c, t, g, unknown or other
  misc_feature (532)..(532): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtgggtgcagttatatcatatgatggagtaaaatatatatgganactcgngaggccatcacatcncaganacaatacaaagaacacagtgatctagacaaatgaacagcctgaggngcgtaggggacncgggntgtatattacngtgacgagagcggctggacaactacactacctaagtttacggttggaccgtcggtcggggaaccaacgggaccacggtcacgtccgttccnccccgacgtccctacccgaccgaaaccgggcccctacggttcccggtccctttccccgnggcccgtcccgtcgcctaccgacggaccgaccacccg

SEQ ID NO: 298495 - DNA, 622 bp, Homo sapiens
  misc_feature: GZ8MTXP02G446Z.19.26.C04.1.454.CMB.2.raw
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
  modified_base (388)..(388): a, c, t, g, unknown or other
  misc_feature (388)..(388): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtgggtccgccaggcctccgaggcgaagggggctaggaggtgggtggctagttatatcatatgatggaagtaaatatatangganactcgtgaggcgatcacatcncagagacaataccaaagaacacagtgatcngacaaatagaacagcctagacggagcggtgggggaaccaccgggtntagtgttaattacgtaggtgcggaaggaggcggcgtaggactaaactacactaccgtagtttaacgggttggtaaccggtcggtcgggggaaccgaacggggtacccgacgggttcacgttacccggtccctaccccgacgtccctacccgaaccggaaaccggtccctaacgtcccgggttcccctcccccggtggcccgccccgtacgccctacgcggaacgcccaacccgg

SEQ ID NO: 298496 - DNA, 534 bp, Homo sapiens
  misc_feature: GZ8MTXP02FP9SQ.19.26.C04.1.454.CMB.2.raw
  modified_base (296)..(296): a, c, t, g, unknown or other
  misc_feature (296)..(296): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
  modified_base (372)..(372): a, c, t, g, unknown or other
  misc_feature (372)..(372): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatccactgggtccnccaggctccgaggcaaggggctaggaggtggggtggcaggttanatcatatgatggaagtaaaatntattatgganactcgtgaagggccattcacatctcagagacatacaagaacacagagatctagacaatagaacagaccgtagagagcgtagggacgaggccccccgtgtcgtattacgtggtgacggacggaggacggcgtcggacacgtacactaccgtacgtttaacggg

SEQ ID NO: 298497 - DNA, 638 bp, Homo sapiens
  misc_feature: GZ8MTXP02JG6O8.19.26.C04.1.454.CMB.2.raw
  modified_base (263)..(263): a, c, t, g, unknown or other
  misc_feature (263)..(263): n is a, c, g, or t
  modified_base (275)..(275): a, c, t, g, unknown or other
  misc_feature (275)..(275): n is a, c, g, or t
  modified_base (304)..(304): a, c, t, g, unknown or other
  misc_feature (304)..(304): n is a, c, g, or t
  modified_base (394)..(394): a, c, t, g, unknown or other
  misc_feature (394)..(394): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcactggtggagtcgtgggggagcgtggtccaggccgtggggacgtccctgacgactctcctgtgcagcctntggattcacttnagtgtcttggcatccgacgtcgggtcccnccgaggcctaccgagggcgaaggggctagggacggttggggtggctaaggtttatagtcaagttagtggaagtagggaaagttaaaattnttaagttacgtgggaacgtaccgttccgggtaggaaacggggtcctaattccactatacctacaagtacgaactaaacttaccaaaagtaacaacgtagtacgtatacgtagtaacaaagtacgaacgacgacgagacggtacggacggtacgggaccacggtcgttacgtacgttattacgtgtacggacgacggacggcggtcgtacggaacctaactactacgtaccgtagtttaccgggg

SEQ ID NO: 298498 - DNA, 691 bp, Homo sapiens
  misc_feature: GZ8MTXP02FRL5I.19.26.C04.1.454.CMB.2.raw
  modified_base (302)..(302): a, c, t, g, unknown or other
  misc_feature (302)..(302): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggtttttcctcgttgcttcttttaagaggtgtccagtgtcaggtgcacctggtggagtcgtgggggagcgtggtccagccgtgggaggtccctgagctctcctgtgcagcctcgtggattcacttcagtagtctttggcatccacgtgggtcccnccaggctccgaggcgaaggggctaggaggtggggtgcgtaagtttatagtcatatgtagtagggtaaaggttaaaaattattaatttaagtgggaagtacccgttccggtaggaacgggggtcctaatttacccgaaaccctattacccgtacccgaaagaacgtaacctaaaacttaccccgaaaagaaaccaacgaaggttaggaaacttaccgtaggaaccaaaagttacggaaaaccgacgtacccgtaggaaggaacggtacggtacgggggaccgaccggggtacttacggtacgtttaagttacgttaggtcggtaccgggtaacggacggaccggcgtcggaacctaaaacttacgacttaccgttaggttttaaccgggg

SEQ ID NO: 298499 - DNA, 686 bp, Homo sapiens
  misc_feature: GZ8MTXP02F7GAF.19.26.C04.1.454.CMB.2.raw
  modified_base (253)..(253): a, c, t, g, unknown or other
  misc_feature (253)..(253): n is a, c, g, or t
  modified_base (276)..(276): a, c, t, g, unknown or other
  misc_feature (276)..(276): n is a, c, g, or t
  modified_base (369)..(369): a, c, t, g, unknown or other
  misc_feature (369)..(369): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctaggagtgggtgcagttanatcatatgatggaaggtaaaatntattatggagactcgtgaaggccattcaccatctaccagagacaattaccaaagaacaacagtaggatctcgaacaaatagaaacacgtaccnggagacgcggtacgggggaaccgacgggtacgtaggtttagttaaagtttacgttaggtacgggacgaaggtaacggggaccggtcgttacggggaaccgtaaaaccgtacgtaacttaccgtaaacgttttaaaccgggggtttacggtacggttacggttaccgggggaaccgaaaacggggacccgtaacgggtacctaacgttccggtaaccctccccgacgcccctaccgaaaccgtaccgggacccctagtcccgttaccgtcccccgttaggcccgtcccgttcgccgtacgaacggaccgccgaacccg

SEQ ID NO: 298500 - DNA, 686 bp, Homo sapiens
  misc_feature: GZ8MTXP02I67UA.19.26.C04.1.454.CMB.2.raw
  modified_base (341)..(341): a, c, t, g, unknown or other
  misc_feature (341)..(341): n is a, c, g, or t
  modified_base (353)..(353): a, c, t, g, unknown or other
  misc_feature (353)..(353): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggagtaaaatatattatggagactccgtgaagggccgattcaccatctccagagacaattccaaagaacacagtgatcngacaaatgaacngacctgagagcgtgggggacacggctggtatattactgtgcgaggagcgggtcgtgggaccaaactacgacgttaccgtaaacgttttaacggggtttcgggtaccgttaccggtcggggggacccctaaaacggggggacccctaacgggggtacctaaacggttccggttacccctacccccgaaaccgtccccgtaccccgtaaacccggaaaaccgggggtcccctaaacgtttccccgggggtacccctttacccccccggtcgggttccccggcccccgtttaccggccgttaccccgaacgggtaccggaccccgtaaaccccggg

SEQ ID NO: 298501 - DNA, 608 bp, Homo sapiens
  misc_feature: GZ8MTXP02JTSPO.19.26.C04.1.454.CMB.2.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (345)..(345): a, c, t, g, unknown or other
  misc_feature (345)..(345): n is a, c, g, or t
  modified_base (356)..(356): a, c, t, g, unknown or other
  misc_feature (356)..(356): n is a, c, g, or t
  modified_base (564)..(564): a, c, t, g, unknown or other
  misc_feature (564)..(564): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctaggagtgggtggcagttatatcatatgatggaggtaaatntatanggagactcgtgaaggccgatcacatcaccagagacaattcaaagaacacagtgatctgacaaatnaacagcctagngagcgtggggacacgggctgtgtactttacgtggtgcgaggagcggactagggacctaaacgtacagttaccagttttaaccgggtttcggaccgttacggtcgggggaccctaaagggggacccgtacgggtaccacgtccgtacgtacccccgagtccctacccgaaccgaacgggccccaacgttcccggtcccgtttcccccgnggtcccgccccgttacgcccgtccgacggtacgcccgtaacccg

SEQ ID NO: 298502 - DNA, 693 bp, Homo sapiens
  misc_feature: GZ8MTXP02G0FO3.19.26.C04.1.454.CMB.2.raw
  modified_base (352)..(352): a, c, t, g, unknown or other
  misc_feature (352)..(352): n is a, c, g, or t
  modified_base (383)..(383): a, c, t, g, unknown or other
  misc_feature (383)..(383): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggaggtccgggggaggcgtggtccagccgtgggacgtccctgagactctcctgtgcagcctctggacttcaccttcagtagtctttggcatccacgtcggggtccccgccaggcctccgagggcgaaggggctaggaggtgggtggctagttanatcatagtgataggaagtaaaatatattagnggagactcggtaggaacggggcctaattccaccactctacccgaagaacgaacaaaacttaccgaaaacgtaaacgaactaagggttacgaacttcgtaacgtaaactaaaagtacgaaaacgacggtaccgtaaggaggaacgggcggttaagggggaaccgtaccggggtacgttaggtttacggttaacgtttaccggtagggttacggaccggggtaaaggtaccgggtcgggaccggttaacgggaaccctaaacgttaaacgtaccgttaaccgtttaacggttttaacggggtttaaccgggg

SEQ ID NO: 298503 - DNA, 668 bp, Homo sapiens
  misc_feature: GZ8MTXP02IUB18.19.26.C04.1.454.CMB.2.raw
  modified_base (240)..(240): a, c, t, g, unknown or other
  misc_feature (240)..(240): n is a, c, g, or t
  modified_base (246)..(246): a, c, t, g, unknown or other
  misc_feature (246)..(246): n is a, c, g, or t
  modified_base (280)..(280): a, c, t, g, unknown or other
  misc_feature (280)..(280): n is a, c, g, or t
  modified_base (284)..(284): a, c, t, g, unknown or other
  misc_feature (284)..(284): n is a, c, g, or t
  modified_base (338)..(338): a, c, t, g, unknown or other
  misc_feature (338)..(338): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagtctttggcatccagtcgggtccaccaggctccaggcaaggggctagngtgggngcagttatatcatatgatggaagtaaatatatangganactcgtgaacgggccattcacatctaccgagacgaacaattaccaaagaaccanaaggtggaaatctagactaaatacgaaacagccttagaggacgtcggtagggggacctcggggtctggttagttaacttacgtaggtcgacggtaagtacgggcggaccgttacggacgtaaaaccttacgtaccgttaaccgttaaagttttaccgggggtttacgggtaaccggttccggtacgggggtacccaaacgggggtaccgtacggtcgtaacgttccgtacccgtaccccacgtccctacccgaccgaccggggtacccacgttccgtacccttccccgtcggcccgtcccgtacgccgtaccgacggacgacccgtaccg

SEQ ID NO: 298504 - DNA, 713 bp, Homo sapiens
  misc_feature: GZ8MTXP02JIDDX.19.26.C04.1.454.CMB.2.raw
  modified_base (286)..(286): a, c, t, g, unknown or other
  misc_feature (286)..(286): n is a, c, g, or t
  modified_base (398)..(398): a, c, t, g, unknown or other
  misc_feature (398)..(398): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattcaccttcagtagtctttggcatccacgtgggtccgccaggcctccgaggccaagggggctaggaggtgggtggctagttatatcatatgatggaaggtaaaatntaattatggaagactccggtaggaaggggccgtaattcgaacctatcctaccgagaagaacaaacttcccaaaggaacacgtaggtggaatcgtacgacaaaagtgaaaacngtaccaggaggagccggtagggggaaccacggggctggtgttaacttacgtggtcgacgaggtaggccgacgtcggaactaaaccgtactaaacgtcccgtaaaagttttcggggttaacggtaacggttcccggtacgggggtacccaaaacgggggacctaacggggttcaaccgttcggtaccccctacccccgacgtaccccgtaacccgacccggtaaaacccggggtccccaaacgtttacccccggggtcccttcccccgtaaggggcccctccccgtacgccctaccggacggacccgcgaaccccg

SEQ ID NO: 298505 - DNA, 685 bp, Homo sapiens
  misc_feature: GZ8MTXP02IQ7TO.19.26.C04.1.454.CMB.2.raw
  modified_base (306)..(306): a, c, t, g, unknown or other
  misc_feature (306)..(306): n is a, c, g, or t
  modified_base (404)..(404): a, c, t, g, unknown or other
  misc_feature (404)..(404): n is a, c, g, or t
  modified_base (537)..(537): a, c, t, g, unknown or other
  misc_feature (537)..(537): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcggtggtttcgtcgttagctctttaagaggtgtcagtgtcaggtgcacctggtggagtcgtgggggaggcgtggtccaggcctggggagtccctgagactctcctgtgcagcctctggattccaccttcagtagtctttggctactcccacgtcggggtccncccgaggcctccgaggaccgaaagggggctaagggagggttggggtagggcctaaggtttaataagtcaatagttgaataggggtaaagtaaaaattntaatttagtcggggaaataccgtaccggtagggaaacgggggtccctaaatttcccaaccctataccctaccaaggaacgaaactaaactttacccgaaaagaaaccaacgaggttacggaattaccggtaanaacgtaaacgtaacgaaacgaacgaccgtagaagacggacggtacggggacgacggtacgttacggttagttagttacgttaggtacggacggacggacggcggtaacgtacggtaacgtaactactacgttacgttacggtttacgg

SEQ ID NO: 298506 - DNA, 543 bp, Homo sapiens
  misc_feature: GZ8MTXP02F8J85.19.26.C04.1.454.CMB.2.raw
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (374)..(374): a, c, t, g, unknown or other
  misc_feature (374)..(374): n is a, c, g, or t
  modified_base (378)..(378): a, c, t, g, unknown or other
  misc_feature (378)..(378): n is a, c, g, or t
  modified_base (384)..(384): a, c, t, g, unknown or other
  misc_feature (384)..(384): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (414)..(414): a, c, t, g, unknown or other
  misc_feature (414)..(414): n is a, c, g, or t
  modified_base (437)..(437): a, c, t, g, unknown or other
  misc_feature (437)..(437): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtggggaggtccctgagactctcctgtgcagcctctggattcaccttcagtagcttggcatccacgtcgggtcccnccaggcctccgaggcaaggggctaggaggtgggtgctagttanatcatangatggaagtaaaatntattagngganactcgngaaggcatcacatcncaganacataccaanaacacagtgatctagacaaatanaacagaccgtagacgagcgaggggacgacggcgtgtagttagttacgtggtagacgaggacggcggcgtcggactaaacgtactacgtaccgtacggtttaccggg

SEQ ID NO: 298507 - DNA, 581 bp, Homo sapiens
  misc_feature: GZ8MTXP02HLRVS.19.26.C04.1.454.CMB.2.raw
  modified_base (216)..(216): a, c, t, g, unknown or other
  misc_feature (216)..(216): n is a, c, g, or t
  modified_base (292)..(292): a, c, t, g, unknown or other
  misc_feature (292)..(292): n is a, c, g, or t
  modified_base (411)..(411): a, c, t, g, unknown or other
  misc_feature (411)..(411): n is a, c, g, or t
  modified_base (500)..(500): a, c, t, g, unknown or other
  misc_feature (500)..(500): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccacgtggggtccnccaggcctccgaggcgaaggggctaggaggtgggtggctagttatatcatatgatggaagtaaaatatatatgganactccgtgaaggccgattcaccatcctccagagacaattaccaaagaacacagtgatctagacaaatgaaacagcctagaggacgcgtacgggggaacacgggtctagtgtaattacgnggtgcgagagcggactggacaactacatacctaagtttacgggtttggacgtcggtggggaccaagggaccacggtcgaatcgtacccncccgaatccctaccgacgaaccggccctacgtccggtcccctccccgtggccgtcccctgcctccgacggcacctacccgg

SEQ ID NO: 298508 - DNA, 579 bp, Homo sapiens
  misc_feature: GZ8MTXP02FY09G.19.26.C04.1.454.CMB.2.raw
  modified_base (296)..(296): a, c, t, g, unknown or other
  misc_feature (296)..(296): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (558)..(558): a, c, t, g, unknown or other
  misc_feature (558)..(558): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagcttggcatccactgggtccncaggctcaggcaagggctagaggtgggtgcagttatancatangatggaagtaaaaatatattatggganactcggtagaaggggccattcaactatctaccaagagaacaaacgttacccaaaagaaacaacaaggtaggtaattaccgtagacaaaattacgaaactaagaccctgagagacggtacggggacgaacggggcttagtaggttactttaacgtgttaggacgtaggcggacggcgtacggacaaaacctanacgtacctaagtttaaccggg

SEQ ID NO: 298509 - DNA, 640 bp, Homo sapiens
  misc_feature: GZ8MTXP02H16FM.19.26.C04.1.454.CMB.2.raw
  modified_base (344)..(344): a, c, t, g, unknown or other
  misc_feature (344)..(344): n is a, c, g, or t
  modified_base (443)..(443): a, c, t, g, unknown or other
  misc_feature (443)..(443): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtggggaggtcctgagactctccgtgtgcacgcctcgtggtacttcctaccttcgagtacgtctttggctactccacgtcgggtcccgccgaggcctaccgaggcgaaggggctaggnggtgggtggctagttatatctaatatggaagtaggtaaagtaaaattattaagttagtggaacgtactaccggttagaacgggcctagttaccacctancctacgagaacgactaaactaccaaagaaccagagtagattcgtagaactaaagtacgaacgacgtacgtaagaggtacggcggtacgggggactaccgggacttggttaacgttagttaccgtgggtacgacggaggtacgccggggtaacgtcggaactaaacctacgtaaccttaccgttaaggtttaccgggg

SEQ ID NO: 298510 - DNA, 578 bp, Homo sapiens
  misc_feature: GZ8MTXP02IBLJQ.19.26.C04.1.454.CMB.2.raw
  modified_base (261)..(261): a, c, t, g, unknown or other
  misc_feature (261)..(261): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (405)..(405): a, c, t, g, unknown or other
  misc_feature (405)..(405): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (421)..(421): a, c, t, g, unknown or other
  misc_feature (421)..(421): n is a, c, g, or t
  modified_base (446)..(446): a, c, t, g, unknown or other
  misc_feature (446)..(446): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggaggcgtggtccagccgtggggaggtccctgagactctctgtgcagcctntggtattcaccttcagtagtcttggctatcccagtcgggtcccnccgaggcctccgaggcgaaggggctaggaggtggggtgctaagttatatcatangagtaggaagtaaatntatagtggatactcgtagaggccatcacancnaganactatacaanacacagtgatcgtagactaaagtanaacacgcctaggagacggacggtacggggacgtaacgggtcttaggtagtttacgttaacgttggaggtacggaggacggcgggtaaccgtacggactaaacgacgtaccgttacttacggtttaaccgggg

SEQ ID NO: 298511 - DNA, 641 bp, Homo sapiens
  misc_feature: GZ8MTXP02JIPJ2.19.26.C04.1.454.CMB.2.raw
  modified_base (260)..(260): a, c, t, g, unknown or other
  misc_feature (260)..(260): n is a, c, g, or t
  modified_base (304)..(304): a, c, t, g, unknown or other
  misc_feature (304)..(304): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctgggtggagtcgtgggggagcgtggtccagcctggggagtccctgagactctcctgtgcagcctntggattcaccttcagtagtctttggcactccacgtcgggtcccnccgaggcctcgaggcgaaggggctaggaggtggggtgactagttatatcaatatcgagtagggaagttaaaaatntaattagtgggaataccgttcgggtagaacggggtcctaattccacctatcctaccgaaggacaactaaacttacccgaaagtaacacgtaagtaggtatcgtagaactaaatacgaaacacgtaccgtaggaacgacggtacggtacggggacgtacggtcgttaggtagtttaacgttacgtggtacggacggaaggacggtacgggtcgtacggaacctaaacgtacctaacgtttaccgttaacggttttaaccgggg

SEQ ID NO: 298512 - DNA, 595 bp, Homo sapiens
  misc_feature: GZ8MTXP02F9Y1G.19.26.C04.1.454.CMB.2.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (327)..(327): a, c, t, g, unknown or other
  misc_feature (327)..(327): n is a, c, g, or t
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (396)..(396): a, c, t, g, unknown or other
  misc_feature (396)..(396): n is a, c, g, or t
  modified_base (399)..(399): a, c, t, g, unknown or other
  misc_feature (399)..(399): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacgtccctgacgactctcctgtgcagcctgtggattcacttnagtagtcttggcatcccagtcgggtccnccaggcctcgaggcgaaggggctaggnggtgggtgctagttnatcaatntgagtaggaaagtaaaatntaatagtgganctcgagacggcatcacntcncgagagaacactacaaagaacacgagtgatctagacaaagtacgaaacgtacgaccgtaggaaggacggacggtagggggaaccgtaccggggtacgttacggttaagttacgtttaccggtaggttggaccgggtaaggacggtcccgggaagtacggaacctaacgtactacttacccgtagttttaaccgggg

SEQ ID NO: 298513 - DNA, 616 bp, Homo sapiens
  misc_feature: GZ8MTXP02I2T5X.19.26.C04.1.454.CMB.2.raw
  modified_base (175)..(175): a, c, t, g, unknown or other
  misc_feature (175)..(175): n is a, c, g, or t
  modified_base (216)..(216): a, c, t, g, unknown or other
  misc_feature (216)..(216): n is a, c, g, or t
  modified_base (256)..(256): a, c, t, g, unknown or other
  misc_feature (256)..(256): n is a, c, g, or t
  modified_base (284)..(284): a, c, t, g, unknown or other
  misc_feature (284)..(284): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (382)..(382): a, c, t, g, unknown or other
  misc_feature (382)..(382): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctntggattccacctttcagtagctttggcatccagtgggtccnccaggctccaggcaaggggctaggaggtgggtgcagttanatcatatgatggaaggtaaatatattanggagactcgtgaagggccattcacatctcagagacatcccaagacacagtgatctgacaaatgaacngcctagngacgcgtaggggaccngggctgtntacttacgtgtgcggaagngacggcgtggacaaactacgacttacccgtagtttaccgggtttacggacgttcggtacgggggaccaaacggggacgacggtcaacgttccgtacccgtccccgtacgtaccccgtaccgaaaccggacggggacccctaacgttcccgttacccctcccccgttacggcccgtccccgtcgtacccgtaccgacgggaccacccgtaacccgg

SEQ ID NO: 298514 - DNA, 643 bp, Homo sapiens
  misc_feature: GZ8MTXP02I4YJS.19.26.C04.1.454.CMB.2.raw
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (291)..(291): a, c, t, g, unknown or other
  misc_feature (291)..(291): n is a, c, g, or t
  modified_base (297)..(297): a, c, t, g, unknown or other
  misc_feature (297)..(297): n is a, c, g, or t
  modified_base (312)..(312): a, c, t, g, unknown or other
  misc_feature (312)..(312): n is a, c, g, or t
  modified_base (315)..(315): a, c, t, g, unknown or other
  misc_feature (315)..(315): n is a, c, g, or t
  modified_base (317)..(317): a, c, t, g, unknown or other
  misc_feature (317)..(317): n is a, c, g, or t
  modified_base (327)..(327): a, c, t, g, unknown or other
  misc_feature (327)..(327): n is a, c, g, or t
  modified_base (341)..(341): a, c, t, g, unknown or other
  misc_feature (341)..(341): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
  modified_base (395)..(395): a, c, t, g, unknown or other
  misc_feature (395)..(395): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagtctttggcatccacgtcgggtccgccaggcctccgaggcaagggggctaggagtgggtgctagttatatcatatgatggaagtaaatntatangganactcgngaggccatcacatcncananacaatccaanacacgagtgatcanacaatanaacngcagagacgcggacggggacaggtctgtgttactagtggtagngaggagcgtacgtggacctaaacactacgttaccgttaaggtttacgggtttcggtacggttaccgggtacgggggaacccgaacgggggtacccacgggtactacgttccccggtaccctccccgacgtaccccgtacccggaaacccggtaaccggggtccctaccggtttcccgttaccccgttcccccgacggggtcccacccccgttgtaccccgtacgaacgggaccgtacccctacccggg

SEQ ID NO: 298515 - DNA, 559 bp, Homo sapiens
  misc_feature: GZ8MTXP02JC52M.19.26.C04.1.454.CMB.2.raw
  modified_base (293)..(293): a, c, t, g, unknown or other
  misc_feature (293)..(293): n is a, c, g, or t
  modified_base (323)..(323): a, c, t, g, unknown or other
  misc_feature (323)..(323): n is a, c, g, or t
  modified_base (363)..(363): a, c, t, g, unknown or other
  misc_feature (363)..(363): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctgggaggtccctgagactctcctgtgcagcctctggattcacttcagtgcttggcatccactgggtccnccaggctccaggcaagggctaggagtgggngcagttagatcatatgatggaagtaaatgtattatggganacgtccgtagaagggcgaagttcaccatctccagagacaatccaaagaacacgagtggaatccgtagaacctaaagtacgaaacgacgaccttagacggtagcggtaggggaacgcgggtactcgttaggtattaaccgtgtacggcgagacggtcggcgttaggccaaactactactaccctaagtttaccgggg

SEQ ID NO: 298516 - DNA, 709 bp, Homo sapiens
  misc_feature: GZ8MTXP02G7K0U.19.26.C04.1.454.CMB.2.raw
  modified_base (323)..(323): a, c, t, g, unknown or other
  misc_feature (323)..(323): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaccgtggtggagtcggtgggggaggcgtggtccaggccgtggggacggtccctgacgtacctctccgtgtcgcacgcctgtggtacttcaccttcgagttagtcgtttggctactccgacgtcgggtcccnccgaggtcctaccggaggacgaaggggtctaggaggtggggtgactaggttatatcaattagcggtaagtagggtaaaagttaaaattattaagttagagggtagtaccgtacgggtagggaacggggtacctacttacccgaacctacgttcccgtaaccgaaacgaacgtaaacctaaaacgtacccgaaaagtaaccctaaagtaccggtaggtaaacttacgaacggtaaactaaaacggtaacgaaacgtacgaccgtaaggacggtacggtacgggtacggggaacgtacggtgttaacggttagttaacgttcgtaggcgacggaggtacggcggtaacgtacggactacctacgtacgttacgtaacggtttacgggg

SEQ ID NO: 298517 - DNA, 553 bp, Homo sapiens
  misc_feature: GZ8MTXP02FYCDA.19.26.C04.1.454.CMB.2.raw
  modified_base (275)..(275): a, c, t, g, unknown or other
  misc_feature (275)..(275): n is a, c, g, or t
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (414)..(414): a, c, t, g, unknown or other
  misc_feature (414)..(414): n is a, c, g, or t
  modified_base (479)..(479): a, c, t, g, unknown or other
  misc_feature (479)..(479): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggaggcgtggtccagccgtggggaggtccctgagactctcctgtgcagcctctggattcaccttnagtanctttggctatcccacgtcgggtacccgccaggcctccgaggcgaaggggctaggaggtgggngctagttanatcatangatggaagtaaaatntattagngganacgtcgtagagggctatcacatctacaganactataccaaagacacagagatctagacaatacgaacagcctagagagcggtagggacacgggtntagtacgtagttacgtgtacggcgtaggacgcggcgtacggactaaacgactacgtacccgtaggtttaacggg

SEQ ID NO: 298518 - DNA, 770 bp, Homo sapiens
  misc_feature: GZ8MTXP02FZ8NN.19.26.C04.1.454.CMB.2.raw
  modified_base (180)..(180): a, c, t, g, unknown or other
  misc_feature (180)..(180): n is a, c, g, or t
  modified_base (211)..(211): a, c, t, g, unknown or other
  misc_feature (211)..(211): n is a, c, g, or t
  modified_base (404)..(404): a, c, t, g, unknown or other
  misc_feature (404)..(404): n is a, c, g, or t
  modified_base (408)..(408): a, c, t, g, unknown or other
  misc_feature (408)..(408): n is a, c, g, or t
  modified_base (457)..(457): a, c, t, g, unknown or other
  misc_feature (457)..(457): n is a, c, g, or t
tcagtactctcgtgcacgaccggtgctcgatttagtctagcgacttttgggtttggggagaggagcccagcactagaagtcggcggtgtttccattcggtgatcagcactgaacacagaggactcaccatggagtttgggctgagcttgggttttcctcgttgtcttcttttaagaggtntccagtgtcaggtgcaccgtggtggagtcgngggggagtcgtggtcaggccgtggggacgtccctgacgactctcctgtgccacgtcctcgtaggtacttccgtaccttcgaagttcgtcgtttcggcaactcccgtaccgttcgggggccccaccgagggtccctaccggagggaccggtaaagggggtctaagggtagggtggggtgggcttaaggtttaanagtntaagtagtaggaagttaggggtaaaagttaaaaattattaatttaaggnggaaacggtaccgttcgggtaggaaaccggggtctaacttacccaactacgtacctaccgaaagacgtaaactaaactaccgaaaagtaaactacggtaaagttcggaaacttaccaagaaacctaaaagtcggaaaaccgtaggtacccgaagggaacgggttacggtaccggggtaacgggggaaccctaggggttcttagggtttaacgtttaacgttaaggtcgggtaaaggccggtaaaaggggcggcgggtcgtaaccggacctaaaacgttacctacgttaaccggtttaacggttttaacggggg

SEQ ID NO: 298519 - DNA, 714 bp, Homo sapiens
  misc_feature: GZ8MTXP02JQCEE.19.26.C04.1.454.CMB.2.raw
  modified_base (317)..(317): a, c, t, g, unknown or other
  misc_feature (317)..(317): n is a, c, g, or t
  modified_base (345)..(345): a, c, t, g, unknown or other
  misc_feature (345)..(345): n is a, c, g, or t
  modified_base (352)..(352): a, c, t, g, unknown or other
  misc_feature (352)..(352): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagtccgggttttcctcgttgctcttttaagaggtgtccagtgtcaggtgcaccgtggtggagtcgtgggggagcgtggtccagccgtgggagtccctgacgactctcctgtcgcacgtcctcgtggtacttccaccttcagtacgtctttggcctactccgacgtcggggtcccncgacggcctccgaggacgagggctaggnggtgggngactaggttatgtactagtagtagagtagggaaagttaaaatagtacgttaagtagggacgtaacgtcggtagggaaaccgtctaacgttaccaaccgtactaccgtaccgaagtacgaaactaaacgttaaccaaaacggaaacctacggaaggttacgaacgttacgtaagaaacgtaaagtaacgaaccgtacggaaccgtggaaagaccgggtagtaccggggaacgtacgggtacgttacggttagtttacgtaacggttcggaggttacggaaacggtccggccggtacggtaacggaccaaaccggttacgtaccgtttaacccggttaagggtttacccgggttttaaccgggg

SEQ ID NO: 298520 - DNA, 732 bp, Homo sapiens
  misc_feature: GZ8MTXP02GBPWU.19.26.C04.1.454.CMB.2.raw
  modified_base (259)..(259): a, c, t, g, unknown or other
  misc_feature (259)..(259): n is a, c, g, or t
  modified_base (301)..(301): a, c, t, g, unknown or other
  misc_feature (301)..(301): n is a, c, g, or t
  modified_base (367)..(367): a, c, t, g, unknown or other
  misc_feature (367)..(367): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggacgtccctgagactctccgtgtgcagcctntggattcacttgagtagcttggctatcccacgtcgggtcccnccgaggcctaccgaggaccgaaagggggtcctaaggacgggttggggtacggtactaaggttttanagtacgtaagttagtaggtaagtaaggggtaaagttaaaattagttaagttaacggtgggtaacgtaccgttaccgggagggtaacggggtaccctaacgttacccaacctacgttacccgtaccgaaagaacgtaaacctaaacgtaaccgaaaacgaaaccgtaacgtaaggtacgtaacgtacgtacgaaacgtaaagtacgaaacgacgtaccgtaggaacgtacgggtaccggaggggaaccgtacggtacgttacggttacgtttaacgttacgtacgggttaggtacgggacggtacgggtcggtaacgtacggaacctaaaccgtaacgtaccgtaccggtttaaacggtttacggg

SEQ ID NO: 298521 - DNA, 626 bp, Homo sapiens
  misc_feature: GZ8MTXP02JF46P.19.26.C04.1.454.CMB.2.raw
  modified_base (218)..(218): a, c, t, g, unknown or other
  misc_feature (218)..(218): n is a, c, g, or t
  modified_base (262)..(262): a, c, t, g, unknown or other
  misc_feature (262)..(262): n is a, c, g, or t
  modified_base (291)..(291): a, c, t, g, unknown or other
  misc_feature (291)..(291): n is a, c, g, or t
  modified_base (294)..(294): a, c, t, g, unknown or other
  misc_feature (294)..(294): n is a, c, g, or t
  modified_base (356)..(356): a, c, t, g, unknown or other
  misc_feature (356)..(356): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttgggctgagctgggttttcatcgttgctcttttaagaggtgtccagtgtcaggtgcacctggtggagtcgtggggggaggcgtggtccagcctgggaggtccctgagactctcctgtgcagcctctggattcaccttcagtagtctttggcatccacgtgggtccnccaggcctccgaggcgaaggggctagaggtggggtgctagttanatcatagtgataggaagtaaatatatagnganctcgagaggctatcacatcaccagacaactactacaagaacacagtagatccagaactaaanacgaacacgcgtagacgacgcggtaggggacgacggtcttaggtnttacttacgtggtcgacggtagagccggacgtcggaacaaactacacttaccgtaggtttacgggttggaccgtcgggtacgggtaccgacgggtaccacgggtcaacgttcccgtaccctaccccacgcccctacccgaaaccgtacccgggccctaccgggttcccgtccccgtacccgtcgggcccgccccgttcggtcccgacccgacggtaccgaccccg

SEQ ID NO: 298522 - DNA, 733 bp, Homo sapiens
  misc_feature: GZ8MTXP02IGN63.19.26.C04.1.454.CMB.2.raw
  modified_base (405)..(405): a, c, t, g, unknown or other
  misc_feature (405)..(405): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagccgtgggacgtccctgagactctctgtgcagcctgtggtacttccaccttcaggtacgtcgtttggctacgtcccgacgtcggggtcccaccgtagggcctaccggaggacgaaagggggctaaggaggtggggtggactaagttatatctaatagtagaagttagggaaagttaaaaatnttaacgttagtacgggaacgtaaccgtaccggtaggaaaccggggtcctaaactttacccgaaacccttatacccgtacccgaagtaacgtaaactaaaccgttaaccaaaagtaaacaacgtaaggtaggtaaacttccgtagaactaaaacgtacggaaaccacggtccgtaaggaacgggtaacggtccgggtaagggggacccgtacggggttacgttacggttagtttaaccggttaacgtgggtacggaccgggaaggtacggccgggtaacgtacggaacctaaaccgtacgtacgttacccgtttaaggtttaaccgggg

SEQ ID NO: 298523 - DNA, 806 bp, Homo sapiens
  misc_feature: GZ8MTXP02FK1OD.19.26.C04.1.454.CMB.2.raw
  modified_base (191)..(191): a, c, t, g, unknown or other
  misc_feature (191)..(191): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgcttcttttaagaggtgtccagtgtcaggtncaccgtggtggagtcgtggggaggcgtggtccaggccgtgggacggtccctgacgactctcctgtgcagtcctcgtggtacttcctaccgttcagttacgtctttggacctacgtcccgtaccggtcggggtccccgccgtaacgggtcccaccggagggaccgaacgggggtcgtaaaggacgggttgggggtcgtaaaccgtaggtttaaacttatacgaatttaaggtacgtaagttaaggggaaaaggttaaaaattaagttagttaagtacggggaaacgtacccggtttaccggtaggggtaaaaccgggtccttaaattaccccaaaccgtacttacccgtaccaaacgggtaaacaaccgtaaaaccttaaccgaaaacgtaaaccgaacgtaacggttacggaaactacgtaacgaaactaaagacgaaacgacgtacccgagaacggacggtacggtacggggaaaccgcggggtaacgttcggtttaaacgttaccgtttaaacggttacgggtacggtaaccggtaacggacggtaccggtaaccgtaacgaaccgtaaaccgtaaccgtaaccgtaacccggtttaacggtttaaccggggg

SEQ ID NO: 298524 - DNA, 643 bp, Homo sapiens
  misc_feature: GZ8MTXP02IO21R.19.26.C04.1.454.CMB.2.raw
  modified_base (217)..(217): a, c, t, g, unknown or other
  misc_feature (217)..(217): n is a, c, g, or t
  modified_base (265)..(265): a, c, t, g, unknown or other
  misc_feature (265)..(265): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggagcgtggtccagcctgggagtccctgagactctcctgtgcagcctctggattccaccttcagtagtctttggcatccacgtcgggtccnccgaggctccgaggcgaaggggctaggaggtggggtgctagttatatnatagtgataggaagtaaatatatatggagactcgtaggaacggccgtatccactatcctaccaagtacgaactaattaccaaagaacacgagtggatcgtagacaaagtgaaacagcccttaggacgtaggacggtacggggacgtaccggtgtagttagttaacttacgtggtcgacggaggcggacggcgtacggactaacgtactacgttaccgtaggtttacgggttacggcgttacgggtcggggaaccgaaaccgggacgtaaccggtctacgtcccgtaccctccccgacgccctacccgaccggaaccgccctacgtcccgtcccgtccccgcggccgtccccgcgtcccacggacgaccgcctacccgg

SEQ ID NO: 298525 - DNA, 535 bp, Homo sapiens
  misc_feature: GZ8MTXP02H92A0.19.26.C04.1.454.CMB.2.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (299)..(299): a, c, t, g, unknown or other
  misc_feature (299)..(299): n is a, c, g, or t
  modified_base (336)..(336): a, c, t, g, unknown or other
  misc_feature (336)..(336): n is a, c, g, or t
  modified_base (346)..(346): a, c, t, g, unknown or other
  misc_feature (346)..(346): n is a, c, g, or t
  modified_base (391)..(391): a, c, t, g, unknown or other
  misc_feature (391)..(391): n is a, c, g, or t
  modified_base (425)..(425): a, c, t, g, unknown or other
  misc_feature (425)..(425): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (447)..(447): a, c, t, g, unknown or other
  misc_feature (447)..(447): n is a, c, g, or t
  modified_base (451)..(451): a, c, t, g, unknown or other
  misc_feature (451)..(451): n is a, c, g, or t
  modified_base (472)..(472): a, c, t, g, unknown or other
  misc_feature (472)..(472): n is a, c, g, or t
  modified_base (507)..(507): a, c, t, g, unknown or other
  misc_feature (507)..(507): n is a, c, g, or t
  modified_base (511)..(511): a, c, t, g, unknown or other
  misc_feature (511)..(511): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtncacctggtggagtcgtgggggaggcgtggtccagcctgggaggtccctgagactctcctgtgcagcctctgattcaccttnagtgctttggcatcccacgtgggtcccnccaggcctccgaggcgaaggggctaggacggtggggngactagttanagttcatagtgagtggaaacgttaaaatagttattagtcggggancttaccggagaacgggtcattcacatctacaganacatacaaagacaanacngatngtanaatacgacagtccgagacgancgagggacacgggctgtgtattacgtgtgcgacgngcgngacgacactatactactagttacg

SEQ ID NO: 298526 - DNA, 647 bp, Homo sapiens
  misc_feature: GZ8MTXP02H5YCC.19.26.C04.1.454.CMB.2.raw
  modified_base (448)..(448): a, c, t, g, unknown or other
  misc_feature (448)..(448): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtgggggaggcgtggtccagcctgggaggtccctgagactctcctgtgcagcctctggattccaccttcagtagtctttggcatccgactcgggtccacgaggctccgaggcgaaggggctaggagtggggtgactagttatagtcatagtgatagggaaggtaaaatataatagtaggagacgtacggtaggaagggccgtatccaaccgtatcctacgaagagaactaacgttaccaaagaacaacgagtacgatctagacaaatgaacagaccgtagacgtacggcgtaggggaccgaggcgtagtagtacttagcggtgacgnggacgcggcgtacggacaactcactacctaggttcggttagacgttggacgggcgaacggtacccaggtccgaacgtccgtaccctcccgaccgtcccaccccgaccggaaacccggtccgaacccgttcccggtccccgtttacccccggccggtcccgccttacccgccggtaccgaacggccacccgtaaccccgg

SEQ ID NO: 298527 - DNA, 694 bp, Homo sapiens
  misc_feature: GZ8MTXP02IXIPD.19.26.C04.1.454.CMB.2.raw
  modified_base (213)..(213): a, c, t, g, unknown or other
  misc_feature (213)..(213): n is a, c, g, or t
  modified_base (253)..(253): a, c, t, g, unknown or other
  misc_feature (253)..(253): n is a, c, g, or t
  modified_base (273)..(273): a, c, t, g, unknown or other
  misc_feature (273)..(273): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
  modified_base (348)..(348): a, c, t, g, unknown or other
  misc_feature (348)..(348): n is a, c, g, or t
  modified_base (392)..(392): a, c, t, g, unknown or other
  misc_feature (392)..(392): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatccagtgggtccncaggctccgaggcaaggggctagaggtgggtgctagttantcatatgatggaagtaaatntatanganactcgtagaaggctatcacatcacagagacaataccaaagacacagtgatcgtagacaatagaaacngacctagagagtcggtaggggaccagggtctagtagtattacgngtcgacgagagcggtccgtaggacctaaactacacgttacccgtaaggtttacgggttacggtaccgttaccgggtagggggacccgaaacggggtacccgtacgggtaccgtaacgttcccggttaccctacccccgaaacgtcccccgttacccggaaacccggtaaaccggggtacccccttaacggttacccccgggtttaccccgtttacccccccggttggggaacccccggtcccccgttaccgggcccccgttaccccgggaaacggggttcccaacccccggttaaccccggg

SEQ ID NO: 298528 - DNA, 658 bp, Homo sapiens
  misc_feature: GZ8MTXP02JDIZF.19.26.C04.1.454.CMB.2.raw
  modified_base (264)..(264): a, c, t, g, unknown or other
  misc_feature (264)..(264): n is a, c, g, or t
  modified_base (270)..(270): a, c, t, g, unknown or other
  misc_feature (270)..(270): n is a, c, g, or t
  modified_base (284)..(284): a, c, t, g, unknown or other
  misc_feature (284)..(284): n is a, c, g, or t
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (323)..(323): a, c, t, g, unknown or other
  misc_feature (323)..(323): n is a, c, g, or t
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctgagactctcctgtgcagcctctggattcaccttcagtagtctttggcatccacgtcgggtccaccgaggcctccgaggcgaaggggctaggaggtgggtgctagttanatcatntgatggaagtaaantatagngagactcgagaggctatcacntctacagacganaactaccaaanaaccacgagtggactcgtacgaactaaagtgaaacctcgtaccgnggacggacgccgggtagggggaacctacgggtacttagggttacgttaacgtttacgtggtaggacggagtaacgggcgtcgtagggacctaaactacgacttacccgtagtttacgggtcggtacgtcggttggggaacccacgggactcgggctacgtcccgtccctacccgcgtcccgtacccgaaccggaccggccccgtaccgtttccccgtaccccgttcccgccggtccccgtacccgacgttacccgagccggaccgtaccgtaaccccgg

SEQ ID NO: 298529 - DNA, 669 bp, Homo sapiens
  misc_feature: GZ8MTXP02GYYZ0.19.26.C04.1.454.CMB.2.raw
  modified_base (283)..(283): a, c, t, g, unknown or other
  misc_feature (283)..(283): n is a, c, g, or t
  modified_base (309)..(309): a, c, t, g, unknown or other
  misc_feature (309)..(309): n is a, c, g, or t
  modified_base (348)..(348): a, c, t, g, unknown or other
  misc_feature (348)..(348): n is a, c, g, or t
  modified_base (524)..(524): a, c, t, g, unknown or other
  misc_feature (524)..(524): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccaccaggctccaggcaaggggctagagtgggtgcagttatatcatatgatggaagtaaatatattatgganctccgtgaaggccatcacatctacanagacataccaagacacagtagatctcgactaaatgaacncgacctagagaggcggtagggggaaccacggtcgtgtagtacgtttaacgtggttcgacgtaggaccggacggctaggaccgtaaactcgtacctacctacggtttaagggttcggacgttcggtacgggggtaaccgaaacgggacccgtacggtacgacgttacccggtacccnccccgaaccggtcccctacccggaacccggtaaaccgggggcccctaacccggtacccggtttccccgttacccccccggtgggtccccgtaccccggttacccgcttaccccgggacggttaacccgcccgtttaacccccggg

SEQ ID NO: 298530 - DNA, 666 bp, Homo sapiens
  misc_feature: GZ8MTXP02FY1O1.19.26.C04.1.454.CMB.2.raw
  modified_base (271)..(271): a, c, t, g, unknown or other
  misc_feature (271)..(271): n is a, c, g, or t
  modified_base (301)..(301): a, c, t, g, unknown or other
  misc_feature (301)..(301): n is a, c, g, or t
  modified_base (332)..(332): a, c, t, g, unknown or other
  misc_feature (332)..(332): n is a, c, g, or t
  modified_base (339)..(339): a, c, t, g, unknown or other
  misc_feature (339)..(339): n is a, c, g, or t
  modified_base (351)..(351): a, c, t, g, unknown or other
  misc_feature (351)..(351): n is a, c, g, or t
  modified_base (388)..(388): a, c, t, g, unknown or other
  misc_feature (388)..(388): n is a, c, g, or t
tcagtactctcgtgcacgaccggtgctcgatttagtctagcgactttgggttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacgtggtggagtcgtgggggagcgtggtccagccgtgggacgtccctgacgactctcgtgtgcagcctctgattccacttnagtagcttggaccacccgtacgtcgggccnccgaggcctaccgaggcgaaggggtctaggnggtgggngactagttatanacatagtagagtagggtaaagtaaaatattagttagnggtagcctacggtaggaaccgggctaacttccaacctactacctacgaagaacgaactaaataccgaaagtaacacgtagtagactagtacgaactaaagtacgaaactacggtaccgtaggacggacggtaccgggtacggggaaccgtacgggtcgtttaggtaacgttagttaccggtagggtaccggacggtaagggtacggccggtacgtaacgggtaaccctaaacgtaccgtaacgtttaccggttaacgggtttaccggtttaaccgggg

SEQ ID NO: 298531 - DNA, 678 bp, Homo sapiens
  misc_feature: GZ8MTXP02JE7ZU.19.26.C04.1.454.CMB.2.raw
  modified_base (307)..(307): a, c, t, g, unknown or other
  misc_feature (307)..(307): n is a, c, g, or t
  modified_base (360)..(360): a, c, t, g, unknown or other
  misc_feature (360)..(360): n is a, c, g, or t
  modified_base (370)..(370): a, c, t, g, unknown or other
  misc_feature (370)..(370): n is a, c, g, or t
  modified_base (397)..(397): a, c, t, g, unknown or other
  misc_feature (397)..(397): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagcgtgggttttcctcgttgctcttttaagaggtgtccagtgtcaggtgcacctggtggagtcgtggggagcgtggtccagccgtgggacgtccctgagactctcctgtcgcagcctcgtggattccgacctttcagtagtctttggcatccacgtcgggtcccnccgagggccctccgaggacgaacggggctaggagggtgggtcggctagtttanagtcaagttnagagtggaaagtaaattagtattacgngggacgtacgtaccggtagggaacgggtccctattacccgaaacctacttccgtaccgaagaacgtaaactaaacttaccgaaacgaactaacgagtacggtaaatccgtataccaaagtacgaaacacgtacgtaggacgacggcggtacggggaactcgggaccgttagttacggttacgtttaacggtaggttacggtacgggtaaaacggcgggtacgggtcgttacgggaaccttaaaccggtactaaccgttacggttaacgttttaaccggggg

SEQ ID NO: 298532 - DNA, 652 bp, Homo sapiens
  misc_feature: GZ8MTXP02FOY32.19.26.C04.1.454.CMB.2.raw
  modified_base (251)..(251): a, c, t, g, unknown or other
  misc_feature (251)..(251): n is a, c, g, or t
  modified_base (431)..(431): a, c, t, g, unknown or other
  misc_feature (431)..(431): n is a, c, g, or t
  modified_base (589)..(589): a, c, t, g, unknown or other
  misc_feature (589)..(589): n is a, c, g, or t
tcagtactctcgtgcacgaccggtgctcgatttagtctagcgactttgggtttgggctgagctgggttttcctcgttgctcttttaagaggtgcccagtgtcaggtgcacctggtggagtctgggggaggcgtggtccagcctgggaggtccctgagactctcctgtgcagcctctggattcaccttcagtagctttggcatccactgggtccacaggctccaggcaaggggctagagtgggtgcagttanatcatatgatggaagtaaatatatagtgagactccgtagaggccgattcactatctacagagacaattccaagtaacacgagtagatcgtagacaaatgaacagcctagagagcgtaggggacagggtctggtatagttacgtggtcgacggagagggtcggcgtacggactaacgtaanactacgtaacgttaccgggtttaggaccggttacggttacgggggaccgtaacggggaaccgtaccgggtactaacgttccgttaaccgtccccgagtacccccgtaccgaaaccgaaccggggcccctaaggttcccccggtaccgttttccccccncggggcccccgtttaccccgtcggccccgttaccgaacgggtaaccgtccccgtaaccccggg

SEQ ID NO: 298533 - DNA, 641 bp, Homo sapiens
  misc_feature: GZ8MTXP02H7YW1.19.26.C04.1.454.CMB.2.raw
  modified_base (164)..(164): a, c, t, g, unknown or other
  misc_feature (164)..(164): n is a, c, g, or t
  modified_base (248)..(248): a, c, t, g, unknown or other
  misc_feature (248)..(248): n is a, c, g, or t
  modified_base (258)..(258): a, c, t, g, unknown or other
  misc_feature (258)..(258): n is a, c, g, or t
  modified_base (388)..(388): a, c, t, g, unknown or other
  misc_feature (388)..(388): n is a, c, g, or t
  modified_base (437)..(437): a, c, t, g, unknown or other
  misc_feature (437)..(437): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctnttttaagaggtgtccagtgtcaggtgcacctgggtggagtcgtgggggagcgtggtccagcctgggaggtccctgagactctcngtgcagcctntggtatcaccttcagtagtctttggactactcccagtcgggtccgccgtaggcctccgaggacgaaggggctaggaggttggggtggactaggttatagtacattagcgaagtagggaaaggtaaaaatntaagttaatcggaatacgtccgtaggaaacggtccgtattcccaactanacctacagtaacgactaaaagttacccaaagtaacaaccgtaggttacgaaactcgtaggaactaaaagtcgaaaccgagtaccgtaggaacgtacggcggtagggggaccaacgggtattacggtacgttagttacgtcggacggacgacggtacggcggtaacgtacggaccaaactacgtacgtaccgttacggtttacgg

SEQ ID NO: 298534 - DNA, 734 bp, Homo sapiens
  misc_feature: GZ8MTXP02IEBH2.19.26.C04.1.454.CMB.2.raw
  modified_base (285)..(285): a, c, t, g, unknown or other
  misc_feature (285)..(285): n is a, c, g, or t
  modified_base (289)..(289): a, c, t, g, unknown or other
  misc_feature (289)..(289): n is a, c, g, or t
  modified_base (309)..(309): a, c, t, g, unknown or other
  misc_feature (309)..(309): n is a, c, g, or t
  modified_base (312)..(312): a, c, t, g, unknown or other
  misc_feature (312)..(312): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattcaccttcagtagctttggcatccactcgggtccaccaggctccgaggcgaaggggctaggaggtgggtgctagttatatcatatgatggagtaaaatatatangganactcgtgaaggccgatcacntcncagagaacaattaccaaagaacacgagtaggattacacgaacaaaagtcgaaacacgccgtagaggaacggcggtacgggggaactaccgggtcgttaggttacgttaagtttaaaccgtggttacgaccggaaaggaacgggcgggtaccgttacggggaaccctaaaaccgttaactaaccgttacccgttaaaggtttttaacccggggtttagggtaaaccggttcgggtaacgggggacccgtaaaaacgggggcccgtaaacggtcccgtaacgttcccgtacccgttacccccgacgtacccctacccggaaccggaaccggtacccccgtacgttccccgggttcccctttccccccggtcggtccccggtcccctacggtccccgttaccgaccgggtaccaccgtacccccg

SEQ ID NO: 298535 - DNA, 730 bp, Homo sapiens
  misc_feature: GZ8MTXP02GNYTR.19.26.C04.1.454.CMB.2.raw
  modified_base (300)..(300): a, c, t, g, unknown or other
  misc_feature (300)..(300): n is a, c, g, or t
  modified_base (325)..(325): a, c, t, g, unknown or other
  misc_feature (325)..(325): n is a, c, g, or t
  modified_base (334)..(334): a, c, t, g, unknown or other
  misc_feature (334)..(334): n is a, c, g, or t
  modified_base (353)..(353): a, c, t, g, unknown or other
  misc_feature (353)..(353): n is a, c, g, or t
  modified_base (367)..(367): a, c, t, g, unknown or other
  misc_feature (367)..(367): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtcgtggggggaggcgtggtccagcctgggaggtccctgagactctcctgtgcagcctctggattcaccttcagtagtctttggctactccacgtgggtcccgccgaggcctccgagggacgaaggggctaggaggtggggtgctaagttatatacatatgagtaggaagtaaatatatagngagtactcgaggacggctatacacntctacaganaactaactacaaagaacanagtagatcacgaanaaatagaaacagacgtaggagacggacggtacggggaccgacggtacgttggttacgttaattacggtggtacggaggaacgggaggtccgggacgttacgggaaacctaaaccgtacgtaaccgttacgttaacgggttttaccgggttacgggttaccgggtacgggtaccgggggtaacccgaaaaccgggtacccgtaaccggttactaacccgtccccggttaccctacccccgtaaaccgtcccgtaaccccgaaccgggtaaaccccgtaccccgtacggttacccccgttccccgttcccccggtcggtccccgcccgtacgcccgtaaccgaccggaccgacccctaacccggg

SEQ ID NO: 298536 - DNA, 816 bp, Homo sapiens
  misc_feature: GZ8MTXP02G27XL.19.26.C04.1.454.CMB.2.raw
  modified_base (260)..(260): a, c, t, g, unknown or other
  misc_feature (260)..(260): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggaggtccctgagactctcctggtgcagcctntggattccaccttcagtacgctttggctactccgacgtgggtcccgccgaggcctccgaggcgaaggggctaggaggtgggtggctaggttatatcaattatacggtagtagggtaaaggttaaaaattattaaagtttagtggggtaaacgtaccgttacccgggtaggaaacgggggtacccgtaagtttcccaaaccctaacgttcccgtaacccgaaaggaacggtaaaacctaaacgtttaccccgaaaacggaaacctaaccgtaaagggttaggtaaaacgttccgtaaggtaaacccgtaaaagttaccggaaaaccgaaccggtacccgtagggaaacgggacgggtaaccggggttacggggggtaaaccgtacccgggggtacgtttacggggtttacggtttaaaggtttaacccggttaaggggttacggacccggggttaacggaacggggtaccgggggttaaccggtacggggtaaaacccgtaaaaccttaaaaccgtaccgtttaaacccggttaaacggttttttaaaccccggggg

SEQ ID NO: 298537 - DNA, 691 bp, Homo sapiens
  misc_feature: GZ8MTXP02GBQPM.19.26.C04.1.454.CMB.2.raw
  modified_base (259)..(259): a, c, t, g, unknown or other
  misc_feature (259)..(259): n is a, c, g, or t
  modified_base (272)..(272): a, c, t, g, unknown or other
  misc_feature (272)..(272): n is a, c, g, or t
  modified_base (277)..(277): a, c, t, g, unknown or other
  misc_feature (277)..(277): n is a, c, g, or t
  modified_base (300)..(300): a, c, t, g, unknown or other
  misc_feature (300)..(300): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacgtccctgagactctcctgtgcagcctntggacttcacttnagtcncttggcactccacgtcgggtccnccgaggcctccgaggcgaaggggctaaggaggtggggtagacgtaagtttaactagtacagttaatgaacgttagggaaaagttaaaaattattaactttagtcgggaagtaaccgttccggtaggaacggggccctaattcccgaacctagtacctaccgaagtaacgaactaaacgtaccgaaaacgaaacacgaaggtaggtaacttacgtacgaaacctaaaagtacgaaaaccgacgtacccgtaggaaggacgggttacgggtacggggaaccgtacgggtgttacggttacgttaagtttaaccgtggtacggacggaggtacggtccggaagtaccggaactaaccgtacctaaccgttaccggtttacgttttaaccggggg

SEQ ID NO: 298538 - DNA, 670 bp, Homo sapiens
  misc_feature: GZ8MTXP02JOKQ1.19.26.C04.1.454.CMB.2.raw
  modified_base (293)..(293): a, c, t, g, unknown or other
  misc_feature (293)..(293): n is a, c, g, or t
  modified_base (297)..(297): a, c, t, g, unknown or other
  misc_feature (297)..(297): n is a, c, g, or t
  modified_base (322)..(322): a, c, t, g, unknown or other
  misc_feature (322)..(322): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctggggggaggcgtggtccagcctgggaggtccctgagactctcctgtgcagcctctggattccaccttcagtagctttggcatccactcgggtccgccaggctccgaggcgaagggggctaggaggtggggtgcagttatatcatatgatggaaggtaaaatattaattagngganactccgtgaaggccgattcacatcnccagagacaataccaaagaacacagtgatctagacaaatagaactagacctagaggacgcggtagggggaaccacgggtcgttggttacttattacgtggtcgacggagaggcggtacgtggacaaacgtacaacgttaccctaaggtttaccgggttaggtaccgtacgggtcggggaaccgtaaacgggacccgtaacgggtcaacgttccggtacccgtccccacggtccccgtaccgacccggaaaccgggtaccctacgttccccggttaccccttcccccggtacggtccccggtccccgtacggtcccgtaccggaccgggtacgacccgttaaaccccgg

SEQ ID NO: 298539 - DNA, 691 bp, Homo sapiens
  misc_feature: GZ8MTXP02IN8S2.19.26.C04.1.454.CMB.2.raw
  modified_base (171)..(171): a, c, t, g, unknown or other
  misc_feature (171)..(171): n is a, c, g, or t
  modified_base (189)..(189): a, c, t, g, unknown or other
  misc_feature (189)..(189): n is a, c, g, or t
  modified_base (256)..(256): a, c, t, g, unknown or other
  misc_feature (256)..(256): n is a, c, g, or t
  modified_base (426)..(426): a, c, t, g, unknown or other
  misc_feature (426)..(426): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctggttttcctcgttgctcttttaagnggtgtccagtgtcaggtncacctggtggagtcgtgggggagcgtggtccagccgtgggagtccctgagctctcctgtgcagcctntgattcaccttcagtagtctttggctactcccacgtcggtcccgccgaggcctccgaggcgaaggggctaggagtgggtggtactagttatatcatatgagtaggtaaagttaaaactattaattagtgggataccgtccgggtaagaacggggtcctattccaacctanccgttaccaagacgaactaaacttacccgaaaagtaacgaaccgtaaggtacggtaattaccgtagaaaccaaagttacggaaaccgtaacggtacccgtaggtaaacggacggtacgggtaggggaaacgtaccggggtacgtttacgggttaacgttagtttaaccggttggtacggaaccgggtacggaacgggtccgggttaaccgagggtaaccctaaacgtaaacgtaccctttaaccggttaacgttttaaccggggg

SEQ ID NO: 298540 - DNA, 758 bp, Homo sapiens
  misc_feature: GZ8MTXP02JL0PS.19.26.C04.1.454.CMB.2.raw
  modified_base (262)..(262): a, c, t, g, unknown or other
  misc_feature (262)..(262): n is a, c, g, or t
  modified_base (435)..(435): a, c, t, g, unknown or other
  misc_feature (435)..(435): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggagcgtggtccaggccgtgggacggtccctgagtactctctgtgcagcctntggtacttccacccttgagtacgtcgttggctaactcctacgtcggggtcccgacccgtaacggcctccggtacggaccggaacggggaccgtaggacgggttggggtagggtacctaaggtttaagtactactaagtagtacggtagttaagggtaaaaggttaaaaaattnttaacggtttaagtggggtaaacggtaccgttaccgggttacggaaacggggtaccccgtaattcccgtaacctaaccttacctacccgaaaggtaacgtaaccgtaaacttacccgaaaacgtaaccgaaacgtaggtacgtaagtacccgtagtaacgtaaaacgtacgaaacgtaacgaccgtaagaacggaacggtcggtacggggaaccgtaggaccttaggtcggtttaaatccgttaggacgtaacggacggtacggaccggaacgtaacggtaccgtaaacctacgtaacctccggttaaacgttttaaccgggg

SEQ ID NO: 298541 - DNA, 515 bp, Homo sapiens
  misc_feature: GZ8MTXP02JBDDP.19.26.C04.1.454.CMB.2.raw
  modified_base (259)..(259): a, c, t, g, unknown or other
  misc_feature (259)..(259): n is a, c, g, or t
  modified_base (302)..(302): a, c, t, g, unknown or other
  misc_feature (302)..(302): n is a, c, g, or t
  modified_base (345)..(345): a, c, t, g, unknown or other
  misc_feature (345)..(345): n is a, c, g, or t
  modified_base (367)..(367): a, c, t, g, unknown or other
  misc_feature (367)..(367): n is a, c, g, or t
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (422)..(422): a, c, t, g, unknown or other
  misc_feature (422)..(422): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagtactctcgtgcacgaccggtgctcgatttagtctagcgactttgggtttgggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggaggtccctgagactctcctgtgcagcctntggattcaccttcagtagctttaggcatcccacgtgggtcccnccaggcctaccaggcaacggggctaggagtgggtggcagttanatcatatgatggaagtaaaatntatatganactcgtgaagggccatcacatcancgaanacatccaaagaacacagngatcagcaaananacancagagagcgaggacgacgcgtgtagtatacgtgtacgacgacgagcggcgcggacactaacactactacgttacgg

SEQ ID NO: 298542 - DNA, 573 bp, Homo sapiens
  misc_feature: GZ8MTXP02F87DX.19.26.C04.1.454.CMB.2.raw
  modified_base (388)..(388): a, c, t, g, unknown or other
  misc_feature (388)..(388): n is a, c, g, or t
  modified_base (447)..(447): a, c, t, g, unknown or other
  misc_feature (447)..(447): n is a, c, g, or t
  modified_base (455)..(455): a, c, t, g, unknown or other
  misc_feature (455)..(455): n is a, c, g, or t
tcagtactctcgtgcacgaccggtgctcgatttagtctagcgactttgggtttggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggccgtgggaggtccctgagactctcctgtgcagcctctggattcaccttcagtagcttggcatccacgtgggtccgccaggcctccgaggacgaaggggctaggaggtgggtgggactagtttatatcaatagtgagtggaaagtaaaatagtaattagtggganacgtccggtagagggctaattccactatctaccgaagagaacaataccaaagaaccganagtgtaanactagacaaagtcgaaacagactagagagcgagggacgacggcgtagtagtagtacgtggtacgacgaggacggcgtaacgtacgaacctaacgtacgtacgtaccgtaagtttacgg

SEQ ID NO: 298543 - DNA, 701 bp, Homo sapiens
  misc_feature: GZ8MTXP02F8O9B.19.26.C04.1.454.CMB.2.raw
  modified_base (289)..(289): a, c, t, g, unknown or other
  misc_feature (289)..(289): n is a, c, g, or t
  modified_base (293)..(293): a, c, t, g, unknown or other
  misc_feature (293)..(293): n is a, c, g, or t
  modified_base (373)..(373): a, c, t, g, unknown or other
  misc_feature (373)..(373): n is a, c, g, or t
  modified_base (411)..(411): a, c, t, g, unknown or other
  misc_feature (411)..(411): n is a, c, g, or t
  modified_base (446)..(446): a, c, t, g, unknown or other
  misc_feature (446)..(446): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagtctttggcatccacgtcgggtccaccgaggctccgaggcgaagggggctaggaggtgggtggcagttatatcatatgagtggaagtaaatatatangganactcgtagaggcatcacatcacagagactaactaccaaagaacacgagtaggatcagacaaactagaaacacgtaccagngaagcggtaggggacacggtctgtacttaatacgttgngacggaggacgtcggactgggaacctaacgtaacncgttacccgttaaggtttaccgggtttcggggtacgttcccgggttacgggggaaaccctaacgggggtaacccgtaccgggttacctacgttcccggttaccccacccccgtaacgtccccctaacccggaaacccggaccgggtacccctacggttacccccggtttacccccttcccccccgggtacgggcccccgttaaccccgccggttacccacccgggttacggggacccacccgtaaacccccgggg

SEQ ID NO: 298544 - DNA, 527 bp, Homo sapiens
  misc_feature: GZ8MTXP01DQUHM.13.36.D03.1.454.CMB.2.raw
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
  modified_base (460)..(460): a, c, t, g, unknown or other
  misc_feature (460)..(460): n is a, c, g, or t
  modified_base (493)..(493): a, c, t, g, unknown or other
  misc_feature (493)..(493): n is a, c, g, or t
  modified_base (517)..(517): a, c, t, g, unknown or other
  misc_feature (517)..(517): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaagtaaaagtgtgcactggtaccagcagaagccaggccaggcccctgtgctggtcgtctatgttgatagcgaccggccctnagggatccctgagcgattcncgggctccaactctgggaacncgggccactctgaccatcagtagggtcgaaggccgggatgaggccgatatacngtcaggtgtgggggatggtagtcgtgagcatgtggctagttcgggnggaagggaccaaacgtcgacccgtctaggttcngcccaaggctcgcccctggttccncgttcgtccg

SEQ ID NO: 298545 - DNA, 528 bp, Homo sapiens
  misc_feature: GZ8MTXP01BVDFQ.13.36.D03.1.454.CMB.2.raw
  modified_base (413)..(413): a, c, t, g, unknown or other
  misc_feature (413)..(413): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatggaggccgatatacngtcaggtgtgggggataggtagtcgtgagcatggtggtattcgggcggagggaaccaaagttggaaccgttcgtaggtcagcccaaggctcgcccctcggcactcttcgtccccg

SEQ ID NO: 298546 - DNA, 576 bp, Homo sapiens
  misc_feature: GZ8MTXP01DHDFW.13.36.D03.1.454.CMB.2.raw
  modified_base (208)..(208): a, c, t, g, unknown or other
  misc_feature (208)..(208): n is a, c, g, or t
  modified_base (302)..(302): a, c, t, g, unknown or other
  misc_feature (302)..(302): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagtgtcaccatctcttgttctggaggcagtgccaacatcgggagtaattatgcattctggtatcaacaactccaggaacgccccagactccncatctatagcaataaccagcgccctcgacggggtcctgacccgattcctctggctccaagtctggcacctcacgcctccctggccatcaggtcggctccggtccgacgatgaggctgtatttatactgttccagtcttgggatgacacgtccgtaagtaacgttacgtttggggttttccgggcgggtaacggggttacccgttaaggtttacggaaccccgggtaccccgttaagggttcccacggaccccgtaaacgggcccgttccccggg

SEQ ID NO: 298547 - DNA, 539 bp, Homo sapiens
  misc_feature: GZ8MTXP01DCMN0.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaagtaaaagtgtgcactggtaccagcagaagccaggccaggcccctgtgctggtcgtctatgttgatagcgaccggccctcagggatccctgagcgattctcgggctccaactctgggaacacgggccaactctgaccatcagtagggtcgaaggcgggatgaggccgactatactgtcaggtgtgggggatagtagtcgtgagcagtgcggtagttcggcgggaggggaaccaaacgttgacccggttctacgggtcacgcccaaggcctcgccccgtcggcactcgttcgttccccc

SEQ ID NO: 298548 - DNA, 700 bp, Homo sapiens
  misc_feature: GZ8MTXP01AEFQ2.13.36.D03.1.454.CMB.2.raw
  modified_base (209)..(209): a, c, t, g, unknown or other
  misc_feature (209)..(209): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctggggaccccccgggnagagtcgtcacctatcttcttgttcgtggaggcagtcgaccaacgtagtacgggtaattaattatgactattcgtaggtactaccaaaccaacctaccccgaacggaaccccgcccccagtacctcctacactactaatacgactaaactaaccgacggcccggtccctaccggaccggggtcctaggacccgtacttccgtcgtcggcctaccgaacgttcgtcggcctacctcaccgtccctcccgtcgacctacgtcgacggtcgggtcccgtcccgggtaccgacgtagtacggtacggtcgttagtaactttacgttacgttcgttacgtacggttcggttaggggtactcggaaccgtacggtccgttaaggtaacgtttacgggtttcgggggtttccgggacggggtaacgggttaccgttaacgggttccggaaccccgtccgtaacggccgtacggaccccgtaacgggttcccgtcccgg

SEQ ID NO: 298549 - DNA, 526 bp, Homo sapiens
  misc_feature: GZ8MTXP01BH2FL.13.36.D03.1.454.CMB.2.raw
  modified_base (365)..(365): a, c, t, g, unknown or other
  misc_feature (365)..(365): n is a, c, g, or t
  modified_base (448)..(448): a, c, t, g, unknown or other
  misc_feature (448)..(448): n is a, c, g, or t
  modified_base (459)..(459): a, c, t, g, unknown or other
  misc_feature (459)..(459): n is a, c, g, or t
  modified_base (519)..(519): a, c, t, g, unknown or other
  misc_feature (519)..(519): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcaggggctgttgaagccttcggagaccctgtcccctcacgtgcgctgtctctggtgggttcttcagtggttactactggagctggatccgccagtccccagggaagggctggagtggagttgggggaaatcaaatcatagtggaagcaccaacctacaaccgtcctcgagaagccgngtcaccatgtcagtagacacgtcaagacagtctcccgtgacggtgagctctgtgaccgcggcggacacggctgtgtacgttcngtgcgagaggntaagttttgactcgttcatttccttccgttgacttcgtgggcctacgggacccttagtcnccgttcg

SEQ ID NO: 298550 - DNA, 697 bp, Homo sapiens
  misc_feature: GZ8MTXP01ASNCE.13.36.D03.1.454.CMB.2.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (230)..(230): a, c, t, g, unknown or other
  misc_feature (230)..(230): n is a, c, g, or t
  modified_base (264)..(264): a, c, t, g, unknown or other
  misc_feature (264)..(264): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctggggaccccccgggnagngtgtcacatctnttgtcnggagcagtcgaccaacagtcgggtaagtaattangactattcgtaggtatacaaacaacctacccgaacggaacccgcccccagacctcctactactactatacgacaaactaaccgacggcccggtaccctacccggaccggggtcctacggtaacccgtacttacctccgtcggtcctacccgtaacgtccgtcggacctaccctcaccgtcccctcccgtcggaccctacgttcgtacgggtccgggccgttccccgggtaccgaacgtagtacgggtacggtcgttagtaactttacgttacgttcgttacgaggttcggttagggagttacggaaccgtacgtaccgtaaggttaaacgttcgggtttacggggtttccgggacgggtaacgggttaccgttacggttccggaacccggtacccgttaacgggacgacggacccgtaacggttcccgtcccg

SEQ ID NO: 298551 - DNA, 711 bp, Homo sapiens
  misc_feature: GZ8MTXP01BO8EG.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccctaggacagacggccaggattacctgtagggggaaacaacattaggaagtaaaagtgtgcactggtaccagcagaagcaggccaggcccctgtgctggtcgtctatgtgatagcgaccggccctcgagggactcccgtgacgcgtacttccgtcggggcctacccaacgtccgtacggggaaccaccgggcccaaccttcctacggaaccccagttccgaagggttacgggggtaccggaaacgggcccggggggaattagggaacggggacccgtaaacgttaacgtttaacgtcggtacgtaaggggttgggttaggggggaagttaggggttaaggtcggttaggaggcgtaagttgggttggttaagttccggggacgggaaggggaaaccctaaaacgttcggtaaccccggttccgttaagggtacccgacggccccgaaacggggtcccgttcccggtcccccccgttcgggtcccttacccgtttcccggttccggtttccccccccgg

SEQ ID NO: 298552 - DNA, 616 bp, Homo sapiens
  misc_feature: GZ8MTXP01EA300.13.36.D03.1.454.CMB.2.raw
  modified_base (209)..(209): a, c, t, g, unknown or other
  misc_feature (209)..(209): n is a, c, g, or t
  modified_base (212)..(212): a, c, t, g, unknown or other
  misc_feature (212)..(212): n is a, c, g, or t
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
  modified_base (270)..(270): a, c, t, g, unknown or other
  misc_feature (270)..(270): n is a, c, g, or t
  modified_base (278)..(278): a, c, t, g, unknown or other
  misc_feature (278)..(278): n is a, c, g, or t
  modified_base (294)..(294): a, c, t, g, unknown or other
  misc_feature (294)..(294): n is a, c, g, or t
  modified_base (300)..(300): a, c, t, g, unknown or other
  misc_feature (300)..(300): n is a, c, g, or t
  modified_base (306)..(306): a, c, t, g, unknown or other
  misc_feature (306)..(306): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggaccccccgggnagngtncactntctnttgtcgnggagcagtcacaanagtcggataatangctattctgtanacaacacnccgacggaccgcccancctctnatctanagacaactaccgcgccgcctcggacggtccagacctattcctcgtcgctaccgacgtcgtcggaccacctcaccgtccctacccgtacgcctagtcgtacggtcggtccgtcccgggaccgacgtagtacgtacggtcgttagttatttacgttacgttcgttcgtaggttcggttaggactacgacgtacgtcgtaagtaacgtttacgggtttcggggtttacgggacgggtaacgggttaaccgttacggttaccggtaacccgtaccgtaacggtaccgaccggacccgtaacggttcccgtcccg

SEQ ID NO: 298553 - DNA, 579 bp, Homo sapiens
  misc_feature: GZ8MTXP01EA5ZT.13.36.D03.1.454.CMB.2.raw
tcagtcacgtactacacgaccggtgctcgatttagctgcgtcacgatctctcttggggagtctgggcctaaggaagcagcactggtggtgtctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaagtaaaagtgtgcactggtaccagcagaagccaggccaggcccctgtgctggtcgtctatgttgatagcgaccggccctcgagggactccctgacgcgtattcgtcgggctccaactcgtagggaacacggccactctcgaccatcagtagggtcgaaggccggggatggacggccgtaatatacgtgtacgagggtggtagggggataggtagtcgtgagctagtggtggtagttcgggcgggaaggggaaccaaagttggaacccgttcgtagggtccacggccccaaggggcctccgcccccgttcgggtccaccgttccgttcggtttcccccc

SEQ ID NO: 298554 - DNA, 566 bp, Homo sapiens
  misc_feature: GZ8MTXP01DO019.13.36.D03.1.454.CMB.2.raw
  modified_base (374)..(374): a, c, t, g, unknown or other
  misc_feature (374)..(374): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtgggggcgcaggggctgttgaagccttcggagaccctgtcccctcacgtgcgctgtctcgtgggttgggttcttcagtggttactactggagctggatccgccagtccccgagggaaggggctggagtggattgggggaaatcgaatcatagtggaagcaccaacctaccaaccgtccctcgagaacgccgngtcaccatgcagtagacacgtccaaagaaccagttcctccctaggagggtgagctctgtcgacccgccggggcggacgacggctagtgtacgttcgtagtgcgagaggctaagttttgacttcgttctatttccttcccgtttgaccttcgtcggggaaccacggggtacccttagtccgaacccgttcccg

SEQ ID NO: 298555 - DNA, 549 bp, Homo sapiens
  misc_feature: GZ8MTXP01CAF10.13.36.D03.1.454.CMB.2.raw
  modified_base (286)..(286): a, c, t, g, unknown or other
  misc_feature (286)..(286): n is a, c, g, or t
  modified_base (421)..(421): a, c, t, g, unknown or other
  misc_feature (421)..(421): n is a, c, g, or t
  modified_base (470)..(470): a, c, t, g, unknown or other
  misc_feature (470)..(470): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgngctggtcgtctatgttgatagcgaccggccctcgagggatccctgagcgacttcgtcgggctcccaactctgggaacacggccactctgaccatcagtagggtcgaaggccggggatggacggccgatattacgngtcaggtgtgggggataggtagtcgtgagcagtgtggtattcgggcggngggaaccaaacgttcggacccgttcgtagggtcacgcccgaaggcctcgccccctcgggtccacctcgttcgttccccc

SEQ ID NO: 298556 - DNA, 548 bp, Homo sapiens
  misc_feature: GZ8MTXP01BHLSY.13.36.D03.1.454.CMB.2.raw
  modified_base (370)..(370): a, c, t, g, unknown or other
  misc_feature (370)..(370): n is a, c, g, or t
  modified_base (419)..(419): a, c, t, g, unknown or other
  misc_feature (419)..(419): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctggtagggggaaacaacattggaagtaaaagtgtgcactggtaccagcagaagcaggccaggcccctgtgctggtcgtctatgttgatagcgaccggccctgaggggactccctgacgcgtacttccgcggggctccaactcgtgggaaccncggccactctgaccatcagtaggcgagcgggatggaggccgatatacgngtcgagggtgtggggggattaggtagtcgtgagcgagttggtggtattcggggacgggagggaaccaaacgttggacccgttcgtagggtcacgcccaggcctcgcccctggtcactcgttcgttcccc

SEQ ID NO: 298557 - DNA, 552 bp, Homo sapiens
  misc_feature: GZ8MTXP01CACY9.13.36.D03.1.454.CMB.2.raw
  modified_base (319)..(319): a, c, t, g, unknown or other
  misc_feature (319)..(319): n is a, c, g, or t
  modified_base (424)..(424): a, c, t, g, unknown or other
  misc_feature (424)..(424): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctnagggactcccgtgacgcgacttcgtcgggctccgaactcgtagggaacacgggccactctgaccatcagtagggtcgaaggccggggatggaggccgatattacngtcagggtgtgggggataggtagtcgtgagcgagtggtgtagtcgggcgggacggaaccgaaagttcgacccgttcgtacggcacgccaggcctccgccccgtcggccttacgtcgttccgttccccg

SEQ ID NO: 298558 - DNA, 594 bp, Homo sapiens
  misc_feature: GZ8MTXP01BQTI0.13.36.D03.1.454.CMB.2.raw
  modified_base (286)..(286): a, c, t, g, unknown or other
  misc_feature (286)..(286): n is a, c, g, or t
  modified_base (494)..(494): a, c, t, g, unknown or other
  misc_feature (494)..(494): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtagggggaaacaacattaggaagtaaagtgtgcactggtaccagcagacgcgagccacgccctgngcgtggtcgtctagtgttagatagccgacccggccctgagggactccgtgacgcgtacttcgtcggcctaccaacgtcgtacgggaaccgaccggccactctacgacacgtcgagggtacgggacggaacgggccggggtatacgggacggaccgtaacttagttacgtgtacgagggtggtagggggtattaggtagtcgtagagtntagtggtggtgttcgggacgggacgggaacaacgttcggaccgttcgtaggcacggcccgaggtctcccgccccgtcggcttacctccgttcgtaacccc

SEQ ID NO: 298559 - DNA, 691 bp, Homo sapiens
  misc_feature: GZ8MTXP01B649U.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctccgtgacctcctatgtgctgactcagcccaccctcggtgtcagtcggccccaggacagacggccaggattaccgtggtagggggaaacaacattaggaaagtaaaagtgtgcactggtaccagcagaagccaggccacggcccctgtcgctggtcgtctatgttgataggcgaccggccctcgagggactcccgtgacgcgtacttcccgtccgggctacccgaaactccgtaaacgggaacccaaccgggccctaacgttccgtacgaaccctagtacgaaagggtacggggtacggaaacgggcccgggggaatacgggaacgggacccgtaacgttaagttaccgtgtacgaagggttggtaggggtaagttaggttaggtcgtaggagctagtggttaggtacgttcggggcggtaaacgggaaccgtaaaacgtcggaaccccggttcgttacgggtaccaacggccccgaaagggttccctaacccgggccccctcgggtccctaccgttcccttcccggtttaaccccctaaccccg

SEQ ID NO: 298560 - DNA, 583 bp, Homo sapiens
  misc_feature: GZ8MTXP01AQK27.13.36.D03.1.454.CMB.2.raw
  modified_base (287)..(287): a, c, t, g, unknown or other
  misc_feature (287)..(287): n is a, c, g, or t
  modified_base (369)..(369): a, c, t, g, unknown or other
  misc_feature (369)..(369): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattagggaagtaaaagtgtgcactggtaccagcagaagcaggccaggcccctgngctggtcgtctatgttgatagcgaccggccctcagggatcccgtgagcgactttccgcggggctcccaactcgtcgggaacncgggccactctgaccatccgagtacggggtacgaagggccggggatggaacgggccgtaactacttacgtgtacgagggtgtaggggggataggtagtcgtgagcagtggtggtagttcgggcgggagggaaccaaagttcggacccgttcgtacggtcacggcccgaagggtcctaccgcccccgtcggtccaccttccgttcgttaaccccc

SEQ ID NO: 298561 - DNA, 528 bp, Homo sapiens
  misc_feature: GZ8MTXP01AC07O.13.36.D03.1.454.CMB.2.raw
  modified_base (339)..(339): a, c, t, g, unknown or other
  misc_feature (339)..(339): n is a, c, g, or t
  modified_base (360)..(360): a, c, t, g, unknown or other
  misc_feature (360)..(360): n is a, c, g, or t
  modified_base (410)..(410): a, c, t, g, unknown or other
  misc_feature (410)..(410): n is a, c, g, or t
  modified_base (419)..(419): a, c, t, g, unknown or other
  misc_feature (419)..(419): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattggaagtaaaagtgtgcactggtaccagcagaagcaggccaggcccctgtgctggtcgtctatgttgatagcgacggccctcagggatccctgagcgacttcncgggctccaactctgggaacncggccactctgaccatcagtaggtcgaagccgggatgagcgactatacgngtcaggtgngggggataggtagtcgtgagcagtgtggtattcgggcggagggaaccaaacgttggaacccgttcgtagggtcagcccaagggctcgcccctggcactcttcgttcccc

SEQ ID NO: 298562 - DNA, 657 bp, Homo sapiens
  misc_feature: GZ8MTXP01EPKJ7.13.36.D03.1.454.CMB.2.raw
  modified_base (276)..(276): a, c, t, g, unknown or other
  misc_feature (276)..(276): n is a, c, g, or t
  modified_base (368)..(368): a, c, t, g, unknown or other
  misc_feature (368)..(368): n is a, c, g, or t
  modified_base (379)..(379): a, c, t, g, unknown or other
  misc_feature (379)..(379): n is a, c, g, or t
  modified_base (421)..(421): a, c, t, g, unknown or other
  misc_feature (421)..(421): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggcttggttgaaaggccctttcgggacgaccccttgtcccctcacgtgcgctgtctcgtgggtggttctcagtggtactacnggagctggactccgccacgtccccgaggggagggctggagtggagttaggggaaatcgaatcagtagtggaagcacaacctaccaccgtccngagaacgccgngtcacatcgtacagtagacacgtaccaaagacctagttaccncccgttaggaacggggttgaggctcgtgtacggacccgccggggacggaccgacggtctggttcgtaccgtttcgtgggtgtacggaaggtacgggttacttaaacggttttttgggaaccctttcggttccttaacgttttccctttccccgttttggttaaccgtttttccgggacgggggtaacccgtaaacgggggtaccccttaacggtcccgttaaccccggtttcccgg

SEQ ID NO: 298563 - DNA, 569 bp, Homo sapiens
  misc_feature: GZ8MTXP01DV91P.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaagtaaaagtgtgcactggtaccagcagaagcaggccaggcccctgtgctggtcgtctatgttgatagcgaccggccctcgagggatccctgagcgtacttcgtcgggctcccaactcgtagggaacacggccactctcgaccatcagtagggtcgaaggccggggatgaggccgatatactgtcagggtgtgggggattaggtagtcgtgagcagtggtggtagttcgggcgggtagggaaccaaacgttggacccggttccgtagggtcacggcccgaagggcccttcggcccccgttcgggtccaccgttccgttccgtttccccc

SEQ ID NO: 298564 - DNA, 758 bp, Homo sapiens
  misc_feature: GZ8MTXP01AMHCZ.13.36.D03.1.454.CMB.2.raw
  modified_base (208)..(208): a, c, t, g, unknown or other
  misc_feature (208)..(208): n is a, c, g, or t
  modified_base (211)..(211): a, c, t, g, unknown or other
  misc_feature (211)..(211): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagngtcgtcacctatctcttgttcgtggaggcagtcgaccaactagtacgggtaattaattatcgactattcgtaggtactaccaaacctaacctaccccgaaacgggaaccccggacccccaacgtaccctcctactacttactaataacgacctaaactaacccgacggcccggtcccgtacccggtaccggggtcctacggtacccgtacttccgtcgtcggtccctaccgtacgtcgtcggacctaccgtccaccgtccccgtccccgtcggaccctacgtccggtacggggttccggggtcccgttaccccggggtaccgaacgtacgtacgggacggtcgttacgttaacttttacgttaccgtttgttaccgacggttcggttagggtactacggaaccgtacggtaccgttaaggtaacggttttacgggtttcgggggtttaccggggaccgggtaacggggttaaccgttaacgggttccggaaccccggtacccggttaacgggtccgaccggttacccggtaacggttcccgtcccgg

SEQ ID NO: 298565 - DNA, 813 bp, Homo sapiens
  misc_feature: GZ8MTXP01BYFVX.13.36.D03.1.454.CMB.2.raw
  modified_base (207)..(207): a, c, t, g, unknown or other
  misc_feature (207)..(207): n is a, c, g, or t
  modified_base (242)..(242): a, c, t, g, unknown or other
  misc_feature (242)..(242): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccggnagagtgtcaccatctcttgtctggagcagtgcaantcgggataattatgctattcgtagtactacaactacctcccgaagggaccccgccccagccctacctacacttctaatacgaactaaacgtaacccgacggcccggtacccccgtacgggtaacccgggggttccctacggtaaaccccgttactttaccccgttcccggtcggggtaccccttaaacccgggtaaacggtttcccggtaccggggaaccccctaacccccttcccggtaacccgttccccccttaccccgggttccgggaccccttaaacgtcccggtaaccgggggtccggggtccccgttacccccggggttaccccggaagttacgtacggggttaaccgggtccttaagggtttaaacttttaacgtttaaccgttcggtttaaccgacggtttccggggttaagggtcttaaccggaccgtcgttaacccgttaagttaaaccgttttcggggtttcggggtttaccgggacggggtaacggttaccgttagggtttcccgaacccggttccgtaacggtacccacggttaccccgaaggttcccttcccccggg

SEQ ID NO: 298566 - DNA, 545 bp, Homo sapiens
  misc_feature: GZ8MTXP01AXYCT.13.36.D03.1.454.CMB.2.raw
  modified_base (420)..(420): a, c, t, g, unknown or other
  misc_feature (420)..(420): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaagtaaaagtgtgcactggtaccagcagaagccaggccaggcccctgtgctggtcgtctatgttgatagcgaccggccctcgagggactccctgagcgacttcgtcgggctccaactcgtgggaacacggccactctgaccatcagtaggtgaaggccggggatggaggccgatattacngtcagggtgtgggggataggtagtcgtgagcagtgtggtagttcgggcgggagggaaccctaaagttcgaacccgttccgtaggtcaggcttcgaaggctcgcccctggctaacgttcgttcccg

SEQ ID NO: 298567 - DNA, 599 bp, Homo sapiens
  misc_feature: GZ8MTXP01C3EDK.13.36.D03.1.454.CMB.2.raw
  modified_base (293)..(293): a, c, t, g, unknown or other
  misc_feature (293)..(293): n is a, c, g, or t
  modified_base (385)..(385): a, c, t, g, unknown or other
  misc_feature (385)..(385): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacagttagggaaagtaaaagtgtgcactggtaccagcagaagccaggccaggcccctgngctggtcgtctatgtgatagcgaccggccctgaggggactcccgtgagcgtattccgtcgggctaccaactcgtagggaacacggccactcncgacatcaggtagggtacgaacgggccggggatggacggaccgaacttattactgtcagggtggtgggggtataggtagtcgtagagcagtggtggtagtcgggcgggtagggaaccctaaacgcggtaccgttccgttaagggccaacggcccgaacgggccctaccggccccccgttgggtcccaccgtttccgttccggtttaaccccccc

SEQ ID NO: 298568 - DNA, 539 bp, Homo sapiens
  misc_feature: GZ8MTXP01DWEWY.13.36.D03.1.454.CMB.2.raw
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
  modified_base (365)..(365): a, c, t, g, unknown or other
  misc_feature (365)..(365): n is a, c, g, or t
  modified_base (495)..(495): a, c, t, g, unknown or other
  misc_feature (495)..(495): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaatggggcncaggggctgttgaagccttcggagaccctgtcccctnacgtgcgctgtctctgggtgggttcttcagtggttactactggagctggatccgccagtccccagggaagggctggagtggattggggaaatcaatcatagtgaagcaccaacctaccaaccgtccctcgagaacgcccgngtccaccatgcagtacgacacgtccaagaccagttctccctagagggtgagctctgtgaacgcggcggacacggcgtgtgtacttctgtagcgagagctaattttggactggttctattccttccgtttnttacgttctcgggcctacgggacccttagtccgttaaccgtccg

SEQ ID NO: 298569 - DNA, 736 bp, Homo sapiens
  misc_feature: GZ8MTXP01AF0KP.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcgccccaggacagacggccaggattaccgtggtaggggaaacaacattaggaaagtaaaagtgtgcactggtaccagcagaacgccaggccacggcccctgtgctggtcgtctatgtgatcgcgacccggccctcgagggactcccgtgacgcgtacttccgtcgggtcctacccgaacgttccgtacggggaacccaccgggacccaaccgttccgtacggaaccctagtaccgaagggttaacggggtaccggaaacgggcccgggggaatacgggaacggggacccgtaacgttaacgtttaaccgtggttaccggaaggggttgggtaggggggtaagttaaggggttaacggttccgggttagaacggtcgtaaggttggggttagggttacggtttaccgggggacggggaacgggggtaaaccctaaaacggttcggtaaccccggttccgtaacgggtccgaccggaccccggaagggtccccgtccggtccccccgttacgggtccttacccgttccgttcccgtttaaccccccg

SEQ ID NO: 298570 - DNA, 582 bp, Homo sapiens
  misc_feature: GZ8MTXP01EJJNC.13.36.D03.1.454.CMB.2.raw
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (366)..(366): a, c, t, g, unknown or other
  misc_feature (366)..(366): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtagggggaaacaacattaggaaagtaaaagtgtgcactggtaccagcagaagccaggccaggcccctgtgctggtcgtctatgttgatagcgaccggccctnagggatcccngagcgacttcgtcgggctccaactcgtgggaacncgggccactctcgaccatcgaggtagggtcgaaggccggggatggacggccgtactattacgtgtcgagggtgtaggggggattaggtagtcgtgagcgtagtggtggtagttcgggcgggaggggaaccaaacgttcggacccggttcgtagggtccacggccccgaagggccctcggccccccgttcgggtccaccttccgttcgtttcccccc

SEQ ID NO: 298571 - DNA, 593 bp, Homo sapiens
  misc_feature: GZ8MTXP01AJMLU.13.36.D03.1.454.CMB.2.raw
  modified_base (189)..(189): a, c, t, g, unknown or other
  misc_feature (189)..(189): n is a, c, g, or t
  modified_base (389)..(389): a, c, t, g, unknown or other
  misc_feature (389)..(389): n is a, c, g, or t
  modified_base (443)..(443): a, c, t, g, unknown or other
  misc_feature (443)..(443): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgaggggcttggttgaagccctttcgggacgtaccctgtccctcacgtgcgctgtctcgtgggtggttcttcagtggttactactggagcgtggatcccgccacggtccccgaggggaaggggctgggagtggagttagggggaaatcgaatcaagtagtaggaagcaaccaacctaccaccgtccctcgagaacgccgngtcaccatgtcagtacgacacgtaccaagaacctgttcctcccgtaggagggtnaggctcgtgtcgacccggcggggcggacgaccggcgttcgtggttacttcgtggtgcggaggacggtcttaagttttcggacttcgttctactttccttcccgttgttacttcgtcggtcggacggtaccgttacgtcgttcccgtcccg

SEQ ID NO: 298572 - DNA, 571 bp, Homo sapiens
  misc_feature: GZ8MTXP01EBC6L.13.36.D03.1.454.CMB.2.raw
  modified_base (219)..(219): a, c, t, g, unknown or other
  misc_feature (219)..(219): n is a, c, g, or t
  modified_base (329)..(329): a, c, t, g, unknown or other
  misc_feature (329)..(329): n is a, c, g, or t
  modified_base (464)..(464): a, c, t, g, unknown or other
  misc_feature (464)..(464): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattaccngtaggggaaacacattaggaagtaaaagtgtgcactggtaccagcagaagcaggccaggcccctgtgctggtcgtctatgttgatagcgaccggccctgagggactcccngacgcgattcctcgggctcccaactctagggaacacggccactctgaccatcagtagggtacgaagggccggggatggacgggccgtaactagttaactgtcgaggtggtagggggtagttaggtagtcgtgagngtagtggtggtgtcgggacgggaacggaacctaacgttcggtaccgttcgtacggtcgacgccgacggcctccgccccgtcggtccttaccgtccgttccgtccccg

SEQ ID NO: 298573 - DNA, 600 bp, Homo sapiens
  misc_feature: GZ8MTXP01AY9OI.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccagattaccgtgtaggggaaacaacagttaggaagtaaagtgtagcactggtaccagcagaacgccaggccacggcccctgtgcgtggtcgtctagtgttagataggccggacccggccctcgagggactcccgtggacgcgtacttccgtcggggcctacccgaaactcggtacgggaaccaccgggccactctacgaccagtcgaggtagggtacgaacgggccgggatgggacgaccgatattacgtgtacgagggtgtaggggggtatagggtacgtggtagagctagttggtggtagtccgggagggagggaacctaaacgttggacccgttcgaggtccacgcccgacggctccgccccgtggcaccttccgttccgtaacccc

SEQ ID NO: 298574 - DNA, 739 bp, Homo sapiens
  misc_feature: GZ8MTXP01CVUGV.13.36.D03.1.454.CMB.2.raw
  modified_base (221)..(221): a, c, t, g, unknown or other
  misc_feature (221)..(221): n is a, c, g, or t
  modified_base (384)..(384): a, c, t, g, unknown or other
  misc_feature (384)..(384): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgnggtagggggaaacaacagttaggaagtaaaagtgtagcactggtaccagcagaagccaggccaggcccctgtcgctggtcgtctatgtgatagcgaccggccctgacgggactcccgtgacgcgtacttccgtcggggctacccgaaactccgtagggaaccnccgggacccacttccgacggaccctatccgaggttaaggggtaccggaaagggcccggggggaattcgggaacggggtcccgtaacgttacgtttaccgtaggtacgtaaggggttgggtaggggggtaagtttaagggttaacggttcgggtaggtacggacgtaagttgggttaggggttacgttccgggggaccgggaacgggggaaacccctaaaacggttcgggtaaccccggttccggtttaaacggggtcccaaaccgggccccgaaacgggggtccccttacccgggtcccccccgttaccggggttcccttacccctttcccgtttccccgggtttaacccccccg

SEQ ID NO: 298575 - DNA, 601 bp, Homo sapiens
  misc_feature: GZ8MTXP01DUSU5.13.36.D03.1.454.CMB.2.raw
  modified_base (214)..(214): a, c, t, g, unknown or other
  misc_feature (214)..(214): n is a, c, g, or t
  modified_base (256)..(256): a, c, t, g, unknown or other
  misc_feature (256)..(256): n is a, c, g, or t
  modified_base (271)..(271): a, c, t, g, unknown or other
  misc_feature (271)..(271): n is a, c, g, or t
  modified_base (371)..(371): a, c, t, g, unknown or other
  misc_feature (371)..(371): n is a, c, g, or t
  modified_base (377)..(377): a, c, t, g, unknown or other
  misc_feature (377)..(377): n is a, c, g, or t
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcacgcccaccctcagccgtcgtcggggaccccccgggnagagtgtccaccatctcttgttctgggaggcagtcgaccaanagtcgggataattangctatttctaggtatacaaaccaacctccccgaaaggacccgcccccagaccctcctacatctaatagacaaactaaccaggccgccctcgacgggtccngacctnttctctgcctaccgaagtctcggccacctcacgccctccgtcgccagtcgaggtcgggcctccgggaccgacgagtggacgtcgttagtatttacgttacgttgttcngtcgttagggntgacngtcctaagtaacgttcggtttcggggtttcggacgggtacgggttaccgttaggttccgaacccgtccgttggccacggaccgtaacggttccgtcccgg

SEQ ID NO: 298576 - DNA, 605 bp, Homo sapiens
  misc_feature: GZ8MTXP01DK794.13.36.D03.1.454.CMB.2.raw
  modified_base (291)..(291): a, c, t, g, unknown or other
  misc_feature (291)..(291): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtagggggaaacaacattaggaaagtaaaagtgtgcactggtaccagacagaagcaggccaggcccctgngctggtctctatgtgatagcgaccggccctgacgggactccccgtgacgcgtattccgtcgggcctcccaactccgtagggaaccacgggccactcgtacgaccatcgagtagggtacggaaggccggggatcggaggccgtactacttacgtgtcgtagggtggtagggggtaagttaggttagttcggtagagctagttggttagggttagttcgggcgggaacgggtaaccaaacggttcgaccgttccgtaggtcacgttcccgaacgtccgtacgcccccgttcggcttacctcgttccgttaaccccc

SEQ ID NO: 298577 - DNA, 657 bp, Homo sapiens
  misc_feature: GZ8MTXP01C5E3B.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcacgccaccctcggtgtcagtcggccccaggacagacggccaggacttaccgtggtagggggaaacaacagttaggaaagtaaagtgtgcactggtaccagacaagaacgccaggccacggcccctgtcgctggtcgtctatgtgataggccgaccgccctgagggtactccgtgagccgtacttccggtcggcctaccgaactcgacgggaacaccggcctactcgtacgaacctatacgaggtacgggtacggaacgggccggggagtaggaacggtccgtaacttagttacgtgtacgagggttggtagggggtaagttaggttaggtcggtagagcgtagttaggtggttacggttcggggacgggaacgggtaaaccgaaacgttcgggtaaccgttccgtacggtccgttaccgcccggaaacggtcccgtaccccgccccgttcggtacccttaccgttcccgttcccgtttaacccccc

SEQ ID NO: 298578 - DNA, 761 bp, Homo sapiens
  misc_feature: GZ8MTXP01DZGYH.13.36.D03.1.454.CMB.2.raw
  modified_base (287)..(287): a, c, t, g, unknown or other
  misc_feature (287)..(287): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctggtaggggaaacaacagttaggaaagtaaaagtgtgcactggtaccagcagagcagccaggccctgngctggtctctatgttgatacgcgaccggccctgagggactcccgtgagcgtacttccgcgggctaccaactcgtacgggaaccacgggccacgttcacgaacccagtaccaggtacgggtacggaacgggccggggagtacggaacgggtacccgaacttaacgttaaccgtcgttacggtaaaggggttgggttagggggggtaaactttaaggggtttaaaggttccgggttagggaaacggtcgttaaaggtttggggttagggggtttaaacgtttcccggggggaaaccggggtaacgggggaaaacccctaaaaaccgggtttccgggaaaccccgggtttaccgttaaacgggggttacccgaaacccgggttacccccgaaacgggggtcccctttacccgggcccccccccgttttggggccccttaacccgttccccggttttcccgggtttaacccccccccg

SEQ ID NO: 298579 - DNA, 698 bp, Homo sapiens
  misc_feature: GZ8MTXP01EAZUF.13.36.D03.1.454.CMB.2.raw
  modified_base (235)..(235): a, c, t, g, unknown or other
  misc_feature (235)..(235): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacggccaggattacctggtaggggaaacanattaggaaagtaaagtgtgcactggtaccagcagaacgcaggccacggcccctgtgctggtcgtctagtgtgatagccgacccggccctcgagggactcccgtgacgcgtacttccggtcgggcctcccgaactcgtacgggaaccacggcccacgtcctacgacccagtccgagggtacggggtacggaaacgggccgggggagtaggaacgggtaccgtaacgttaagttaaccgtgtacggtaggggttaggttagggggggtaagttagggttaaggtcgggttagaacggtgtaagtttgggtagggttaggttaccgggggacggggaaacggggtaaacccgtaaacgttccgggtaacccggttaccgtaacgggtacccgacgggccccgaaacgggtccgtacccggcccccgttccgggtacccttaccgttcccgttcccgtttccccccg

SEQ ID NO: 298580 - DNA, 628 bp, Homo sapiens
  misc_feature: GZ8MTXP01DM524.13.36.D03.1.454.CMB.2.raw
  modified_base (288)..(288): a, c, t, g, unknown or other
  misc_feature (288)..(288): n is a, c, g, or t
  modified_base (367)..(367): a, c, t, g, unknown or other
  misc_feature (367)..(367): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtaggggaaacaacattaggaaagtaaaagtgtagcactggaccagcagaagccaggccaggccctgngctggtctctatgttgatagcgaccggccctcgagggactccctgagcgtactcgtcgggctccaactcgtagggaacncggccaactctagaccatcgagtagggtacggaaggccggggagtaggacgggaccgtacgttacgttaacgtgtacgtagggtggtaggggggtaagttaggtagtcggtgagtcgaagttggtggttaagttcgggcgggaacgggaaaccctaaacgttcgggacccgttaccggtaggtaccgacggccccgttaaacgggccctcccggccccccgttcgggtaccttacccgtttccttcccggtttcccccccg

SEQ ID NO: 298581 - DNA, 706 bp, Homo sapiens
  misc_feature: GZ8MTXP01AEYX8.13.36.D03.1.454.CMB.2.raw
  modified_base (187)..(187): a, c, t, g, unknown or other
  misc_feature (187)..(187): n is a, c, g, or t
  modified_base (208)..(208): a, c, t, g, unknown or other
  misc_feature (208)..(208): n is a, c, g, or t
  modified_base (261)..(261): a, c, t, g, unknown or other
  misc_feature (261)..(261): n is a, c, g, or t
  modified_base (310)..(310): a, c, t, g, unknown or other
  misc_feature (310)..(310): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctnagcgtctcgggacccccgggnagagtgtcaccatctcttgtctggagcagtgaccaacagtcgggagtaattangctattctggtatacaacaactcccgaaggaccggcccccagacctccncatctatagcaataccagccgccctcgacggggtcctgacccgattcctctggcctaccaagtcctggccacctcacgtccctcccgtggccctagtcgaggtcgggccttcccgggtaccgacgtaagtcggaacgggtccttaggtaacttttacgtttaacccgttaggtttacccgtacggttacggtttacggggtacttaccgggtaaccgtaccggttacccggttaaaggtttaaccggttttacgggggtttttaccgggggtttaccgggggaaccggggttaaccggggttaacccgttaacgggtttaccccgggtaaccccgggttcccgttaacgggtacccgtacccgggaccccggttaacgggttccccgttccccggg

SEQ ID NO: 298582 - DNA, 608 bp, Homo sapiens
  misc_feature: GZ8MTXP01CSVTL.13.36.D03.1.454.CMB.2.raw
  modified_base (211)..(211): a, c, t, g, unknown or other
  misc_feature (211)..(211): n is a, c, g, or t
  modified_base (261)..(261): a, c, t, g, unknown or other
  misc_feature (261)..(261): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcgcagggctgttgaagccttcgganaccctgtccctcacgtgcgctgtctcgtggtggttctcagtggtactacnggagctggactccgccagtccccgaggggaagggctggaggtggagttagggggaaatcaattcagttaggtaggaaacgccaaccaaaccctaccgaacccgtcccgtcgagaacgccgaagtccaccatgtacagtacacacgtaccaaagacctagttcctacccgtaggagggtgacgcttcgtcggcgacccgccggggcggacgaccggtcgtgtcgtacttcgtgtcgcgtaggaggtctaagttttcggacttcgttctactttccttcccgtttgttaccgtttcggtcggggtcccgtaacggggtaccccgttagtcccgttaacccgtttcccgg

SEQ ID NO: 298583 - DNA, 535 bp, Homo sapiens
  misc_feature: GZ8MTXP01EZRLU.13.36.D03.1.454.CMB.2.raw
  modified_base (319)..(319): a, c, t, g, unknown or other
  misc_feature (319)..(319): n is a, c, g, or t
  modified_base (440)..(440): a, c, t, g, unknown or other
  misc_feature (440)..(440): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacacattggaagtaaaagtgtgcactggtaccagcagaagccaggccaggcccctgtgctggtcgtctatgttgatagccgaccggccctnagggactccctgagcgacttcgtcgggctccaactctagggaacacagtcactctgaccatcagcgggaccagcctattgatgagctgtctacttctggtctagggccgtagggacaacgngcgtgctggtcggcggaggaaccgagttcgtggaccgttgttacggcgcgccccaagggcctccgcccccgtgggttcctaaccgttccgtcccg

SEQ ID NO: 298584 - DNA, 523 bp, Homo sapiens
  misc_feature: GZ8MTXP01AS1WP.13.36.D03.1.454.CMB.2.raw
  modified_base (208)..(208): a, c, t, g, unknown or other
  misc_feature (208)..(208): n is a, c, g, or t
  modified_base (435)..(435): a, c, t, g, unknown or other
  misc_feature (435)..(435): n is a, c, g, or t
  modified_base (492)..(492): a, c, t, g, unknown or other
  misc_feature (492)..(492): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagtgtcaccatctcttgttctggaggcagtgccaacatcgggagtaattatgcattctggtatcaacaactcccaggaacggcccccagactcctcatctatagcaataaccagcggcctccgaggggtcctgaccgattctcgtgctcaagtctggcactcagcctccctggccatcagtgggcttccggcacgatgaggctgattatactgttcagcttgggntgacacgcctgaaattcgttgggtttcggcggtagggaccttaaggttggaaccccncccgttaaggccacgcccaagggcctcccgg

SEQ ID NO: 298585 - DNA, 581 bp, Homo sapiens
  misc_feature: GZ8MTXP01ACCCJ.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcgagggactccctgagcgtacttccgcgggcctcccaactcgtacggggaaccaccgggcccaactctagacccatccgaggtacggggtcgaaagggcccgggggatggaacgggcccgtaacttagttaccgtgtacgagggttggtaggggggataggtagtcggtgagcagtggtggtagttcgggcgggagggaaccaaacgttggaccgttcgtaggtcacgcccaggctcgcccctggcacctcgttcgttccccg

SEQ ID NO: 298586 - DNA, 636 bp, Homo sapiens
  misc_feature: GZ8MTXP01CJ8EB.13.36.D03.1.454.CMB.2.raw
  modified_base (237)..(237): a, c, t, g, unknown or other
  misc_feature (237)..(237): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (381)..(381): a, c, t, g, unknown or other
  misc_feature (381)..(381): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacaggacgccaggacttacctggtaggggaaacaanagttaggaaagtaaagtgtagacacgtggtaccagacagaacgcaggccacggccctgcgctggtctntatgtnatagcgaccgccctcgagggactcccgtgacgcgtacgttcgtcgggcctaccgaacgtcgtacggaacnccggaccactcgtacgaccatccgaggtacgggtacggaacggccggggatagggaacggccgtaacgttattaaccgtgtacgtagggttggtagggggtattaggtacggtgtagagcgtagtgggtagttacggtcgggacggggtacgggaaacctaacgttcggtaccgttaccgtacgggtacacggcccgaagggtccctaccggtcccccgttagggtcccttaccgttccttccggtttaaccccc

SEQ ID NO: 298587 - DNA, 701 bp, Homo sapiens
  misc_feature: GZ8MTXP01EHKMY.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggctggttgaaggtcccttcggacgacccctgtccctcgacgtgcgctgtctcgtggttgggttcttcgagtggttactacgtggagctggactccgcacggtccccgagggaagggctggagtggagttaggggaaatcgaatcagtagtggaagtcaaccaacctaccgaaaccgtccctacgaacgaacgcccgaagtccaaccagtcgtacagtacgaccaccgtacgaaacgaacctagttcctcccgtaggaacgggttcgacgtccgttcgtcggtacggaccccggccggggaccggtaaccgaccgggtcgttcggttcgttaccgtttcgtcggttcgaccgggtaaggtacggttacctttaaaggttttttcgggaaccgtttccggttacttaacgttttccccgtttcccgttttcgttacccgttttcccgggtacgggggcccgttaaccgggggtaaccccttacggttcccgttaacccggtttcccgg

SEQ ID NO: 298588 - DNA, 617 bp, Homo sapiens
  misc_feature: GZ8MTXP01DYAS7.13.36.D03.1.454.CMB.2.raw
  modified_base (189)..(189): a, c, t, g, unknown or other
  misc_feature (189)..(189): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgaggggcttggttgaagccctttcgggacgacccctgtcccctcgacgtgcgctgtctcgtgggttgggttcttcagttggttactacgtggagctggatccgccacggtccccgagggaagggctggagtggagttaggggaaatcgaatcgataggtagaagcaccaaactaccgaacccgtccacgagaacgccgaagtccactatgcagtagacacgtacaaacgactagttcctccgtaggagggtgacgccttcgtgtcggaccccgccggggaccggacgtaccggtcgttgtcgttacctgtgtcgcgagtcggtctaagttttcggacttcggttactacgtttcccttccgtttcgttaccgttcggtcggggaacccgtaacggggtacccttacggtaaccgcccggtttcccgg

SEQ ID NO: 298589 - DNA, 515 bp, Homo sapiens
  misc_feature: GZ8MTXP01CW71B.13.36.D03.1.454.CMB.2.raw
  modified_base (207)..(207): a, c, t, g, unknown or other
  misc_feature (207)..(207): n is a, c, g, or t
  modified_base (257)..(257): a, c, t, g, unknown or other
  misc_feature (257)..(257): n is a, c, g, or t
  modified_base (431)..(431): a, c, t, g, unknown or other
  misc_feature (431)..(431): n is a, c, g, or t
  modified_base (450)..(450): a, c, t, g, unknown or other
  misc_feature (450)..(450): n is a, c, g, or t
  modified_base (473)..(473): a, c, t, g, unknown or other
  misc_feature (473)..(473): n is a, c, g, or t
  modified_base (476)..(476): a, c, t, g, unknown or other
  misc_feature (476)..(476): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagagtgtcaccatctcttgtctggagcagtgccaacatcgggataattangcattctggtatcaacaactcccaggaaccggccccagactcctcatctatagcaaataaccagcggccctccaggggtcctgacccgtattctctggcctccaaagtctggcaccgtcacgcctccctgccatcagtcgggctccggtcgacgatgaggctcgtattattacngttcagtcttgggatgacngcctaagattacgttgggttcgnggnggaccgttagttcgaaccgccttggcagccaaggctccg

SEQ ID NO: 298590 - DNA, 545 bp, Homo sapiens
  misc_feature: GZ8MTXP01A9SEH.13.36.D03.1.454.CMB.2.raw
  modified_base (475)..(475): a, c, t, g, unknown or other
  misc_feature (475)..(475): n is a, c, g, or t
  modified_base (495)..(495): a, c, t, g, unknown or other
  misc_feature (495)..(495): n is a, c, g, or t
  modified_base (517)..(517): a, c, t, g, unknown or other
  misc_feature (517)..(517): n is a, c, g, or t
  modified_base (539)..(539): a, c, t, g, unknown or other
  misc_feature (539)..(539): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcagggctgttgaagccttcggagaccctgtccctcgcgtgcgctgtctctggtggttcttcagtggtactactggagctggatccgccacgtccccgaggggagggctggagtggagttgggggaaatcgaatcgatagtggaagcaccaacctaccaaccgtcctacgacgaacgccgaagtcaaccatgtacagtacgacacgtacaagaccagttctccctaggacggtgacgctcgtgtcgaccgcggggcggacgacggctgtgtctcgtgtgcgagacgntaagttttcgacgttcgttntacttcttcccgttgacttcgngggccacgggtacccttgtccnccgtcg

SEQ ID NO: 298591 - DNA, 562 bp, Homo sapiens
  misc_feature: GZ8MTXP01BIU9E.13.36.D03.1.454.CMB.2.raw
  modified_base (189)..(189): a, c, t, g, unknown or other
  misc_feature (189)..(189): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncaggggctgttgaagccttcggagaccctgtccctcacgtgcgctgtctcgtggtgggttcttcagtggttactactggagctggatccgccagtccccagggagggctggagtggattgggggaaatcaatcatagtggaagcaccgaacctaccaaccgtccctcgacgaacgccgaagtcaccatgtcagtacgacacgtacaagaccagttctccctggagggtgagctctgtcgaccgccgggcggacgaccggctgtgtacgttcgtgtgccgagacggtctaagtttttggacttcgttctacttcttcccgtttgactttcgtcggggtcctaacggggtacccttaggtccgttaaccgttccg

SEQ ID NO: 298592 - DNA, 693 bp, Homo sapiens
  misc_feature: GZ8MTXP01DPLD9.13.36.D03.1.454.CMB.2.raw
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacaggacggccaggattaccgtggtaggggaaacaacagttagggaaagtaaagtgtgcacgtggtaccagcaagaagccaggccaggcccctgtcgctggtcgtctatgttgatagccgaccggccctagagggactcccgtgagcgtacttccgtcgggcctacccaacgtccgtagggaaccaccggccctaacgtcctcgacctagtccgaggttagggacgaagggccggggatgggaacggccgtaacttagttaccgtggtacgagggttggtagggggtaagttaagggttacggttcggagtagtcgtaggttgggttaggggttacggttccggggacgggaacgggggtaaacccctaaaacggttccgggtaaccccgttaccggtaacggggtcccgaaccgggttccccgaaacggggtccctacccggtccccccgttcgggtaccttaccctttcccgttcccgtttaaccccccc

SEQ ID NO: 298593 - DNA, 596 bp, Homo sapiens
  misc_feature: GZ8MTXP01CXPM4.13.36.D03.1.454.CMB.2.raw
  modified_base (217)..(217): a, c, t, g, unknown or other
  misc_feature (217)..(217): n is a, c, g, or t
  modified_base (364)..(364): a, c, t, g, unknown or other
  misc_feature (364)..(364): n is a, c, g, or t
  modified_base (487)..(487): a, c, t, g, unknown or other
  misc_feature (487)..(487): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggcccaggacagacgccagattacgnggtagggaacacagtaggaaagtaaagtgtgacacgtggtaccagcaagacgcaggccacggccctgcgctggtctctatgtgatgccgaccgccctgaggactcccgtgcgcgtacttccgtcggctaccaactcgtacgggaacnccggaccacgtctacgaccagtaccgaggtacgggtacggaacgggccgggggatagggacggaccgtaacttaacgttacgtgtcgaggggttggtagggggtattaggtagtcggtgacgntaggttgtgtagttcgggacgggacggaacctaaacgttcggacccgttcgtaggtcgacgcccgacgctccgccccgtcggtccttaccgttcgttcccgttcccccg

SEQ ID NO: 298594 - DNA, 575 bp, Homo sapiens
  misc_feature: GZ8MTXP01EMZGO.13.36.D03.1.454.CMB.2.raw
  modified_base (187)..(187): a, c, t, g, unknown or other
  misc_feature (187)..(187): n is a, c, g, or t
  modified_base (369)..(369): a, c, t, g, unknown or other
  misc_feature (369)..(369): n is a, c, g, or t
tcagtcacgtactacacgaccggtgctcgatttagctgcgtcacgatctctcttggggtcacatgggagtgctttctgagagtcatggacctcctgcacaagaacatgaaacacctgtggttctgcctcctcctggtggcagctcccagatgggtcctgtcccaggtgcagctacagcaatggggcncaggggctgttgaagccttcgggagaccctgtcccctcacgtgcgctgtctcgtgggttgggttcttcagtggttactacgtggagctggatccgccagtccccagggagggctggagtggattgggggaaatcaatcagtagtggaagcaccaacctacaaccgtcctacgagaacgccgngtccaccatgtacagtagacacgtccaaagaaccagttcctcccgtaggagggttgagctcgtgtcgaccgcgggcggacgacggctgtgtacttcgtgtgcgagagtctaatttttgggacttcggttctatttccttcccgtttgaccgtttcgtcggggtcccgtacggggtaacccttaggtcccgttaaccggtttcccgg

SEQ ID NO: 298595 - DNA, 638 bp, Homo sapiens
  misc_feature: GZ8MTXP01CKR1X.13.36.D03.1.454.CMB.2.raw
  modified_base (371)..(371): a, c, t, g, unknown or other
  misc_feature (371)..(371): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattacctgtagggggaaacaacagttggaaagtaaaagtgtgcactggtaccagcagaagccaggccaggcccctgtgctggtcgtctatgttgatagcgaccggccctcgagggactccctgagcgtacttcgcgggctccaactcgtagggaaccncggcccactctgaccatcgagtagggtacgaaggccgggggaatcggagggcccgtaacttagttaccgtgtacgagggttggtaggggggtattagggttagtcggtagacgtcgaagttggtgggttaacgttcggggacgggaacggggtaaacctaaacggttcggaacccgttccgtaaacgggtcaacccgggcccgaacgggtcccttcccggccccccgtttcgggcccttaccgttcccgttccgggtttcccccccg

SEQ ID NO: 298596 - DNA, 621 bp, Homo sapiens
  misc_feature: GZ8MTXP01AEZAG.13.36.D03.1.454.CMB.2.raw
  modified_base (189)..(189): a, c, t, g, unknown or other
  misc_feature (189)..(189): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcncgagggctgttgaagccttcggacgaccctgtccctcacgtgcgctgtctcgtggtggttcttcgagtggttactacgtggagctggactccgccaggtccccgaggggaagggctggaggtggagttagggggaaatcgaatcgaagtaggtaggaacgaccaaccaacctaccaccgtccctacgacgaacgccgaagtccaccgatcgtacagtacgaccacgtaccaaagaacctagttcctcccgtaggacgggtgacgtctcgtaggtcgacccggcccggggcggaccgtacggcgtgtcgttaccttcgtggtcgcgagtacggtcttaagttttcggacttcgttcttacgtttccttccgtttgaccgtttcggtcggggtcccgtaacggggtacccttacggtcccgttaaccgttcccg

SEQ ID NO: 298597 - DNA, 595 bp, Homo sapiens
  misc_feature: GZ8MTXP01DOZNW.13.36.D03.1.454.CMB.2.raw
  modified_base (188)..(188): a, c, t, g, unknown or other
  misc_feature (188)..(188): n is a, c, g, or t
  modified_base (226)..(226): a, c, t, g, unknown or other
  misc_feature (226)..(226): n is a, c, g, or t
  modified_base (378)..(378): a, c, t, g, unknown or other
  misc_feature (378)..(378): n is a, c, g, or t
  modified_base (436)..(436): a, c, t, g, unknown or other
  misc_feature (436)..(436): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaatggggcncaggggctgttgaagccttcggagacccctgtcccctnacgtgcgctgtctcgtgggttgggttcttcagttggttactactggagctggactccgccaggtccccgagggaagggctggagtggagtttagggggaaatcgaatcagtagtgaagcaaccaactaccaaccgtcctacgagaacgccgngtccaccatcgtcagtagaccacgtacaaacgaaccagttcctacccgtaggagggtnaggtctcgtgtacgacccgccgggcggacgacggtcctgtcgtacgttcgtgtcgacgaggtagtcttaaagtttttggacttcgttactacgttccttcccgtttgttacctttcggtagggtccgacgggtaaccccttgtccgttaacccgttccg

SEQ ID NO: 298598 - DNA, 621 bp, Homo sapiens
  misc_feature: GZ8MTXP01AYWSD.13.36.D03.1.454.CMB.2.raw
  modified_base (490)..(490): a, c, t, g, unknown or other
  misc_feature (490)..(490): n is a, c, g, or t
  modified_base (505)..(505): a, c, t, g, unknown or other
  misc_feature (505)..(505): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggctggttgaacgtcccgttcgggacgacccctggtcccctcacgtgcgtctgtctcgtggtggttcttcgagtggttactacgtggagctggatccgcacgtccccgagggagggctggagtggagttggggaaatcgaatcagtaggtgaagcaccaactaccgaaccgtcctacgagaacgccgaagtccaaccatcgtacagtacgacacgtaccaaagacctagttcctaccgtaggacgggtgacgctcgtaggtcgacccgcggacggacgacggctgtcgtacttcgngtcgcgagtacggtnttaagttttcggacttcggttcttaacgtttcccgttccgttttcggaccgtttccgggtacgggggtaaccctaacgggggtaaccccttaggttccccgaacccggtttcccgg

SEQ ID NO: 298599 - DNA, 561 bp, Homo sapiens
  misc_feature: GZ8MTXP01BBD3R.13.36.D03.1.454.CMB.2.raw
  modified_base (209)..(209): a, c, t, g, unknown or other
  misc_feature (209)..(209): n is a, c, g, or t
  modified_base (262)..(262): a, c, t, g, unknown or other
  misc_feature (262)..(262): n is a, c, g, or t
  modified_base (306)..(306): a, c, t, g, unknown or other
  misc_feature (306)..(306): n is a, c, g, or t
  modified_base (343)..(343): a, c, t, g, unknown or other
  misc_feature (343)..(343): n is a, c, g, or t
  modified_base (349)..(349): a, c, t, g, unknown or other
  misc_feature (349)..(349): n is a, c, g, or t
  modified_base (353)..(353): a, c, t, g, unknown or other
  misc_feature (353)..(353): n is a, c, g, or t
  modified_base (420)..(420): a, c, t, g, unknown or other
  misc_feature (420)..(420): n is a, c, g, or t
  modified_base (466)..(466): a, c, t, g, unknown or other
  misc_feature (466)..(466): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtcgtcgggacccccgggnagagtgtcaccatctcttgtctggaggcagtcgaccaacatcgggataattangcattctgtatacaacaactcccaggaccgccccagactcctanatctatagcaaataaccagcgccctcgacggggtccngaccgnttcnctggctaccagtctggcacctcacgcctcccgtggccatcgacggtcgggcctccgggtccgacgtntggaggcgtgtaagtttattacgttgttcagtcgttagggatgacngctaagtaagttacggtttgggtttcgggacgggtagggttaccgttaggttcgaacccgtccgtaaggtccgacgaccgtaacggccgtcccgg

SEQ ID NO: 298600 - DNA, 657 bp, Homo sapiens
  misc_feature: GZ8MTXP01AF3V3.13.36.D03.1.454.CMB.2.raw
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctccagatgggtcctgtcccaggtgcagctacagcaagtggggcgcagggctgttgaagccttcggagaccctgtccctcacgtgcgctgtctcgtgggtgggttcttcgagttggttactacgtggagcgtggactccgccacggtccccgaggggaacgggcgtggaggtgggagttagggggaaatcgaatcgaagtaggtaggaagtacaaccaacctaccaaccgtcccgtacgagaacgccgaagtccaaccatcgtacagtacgaccacgtaccaacgaacctagttcctcccgtaggacgggtcgagtcctcgtggtacgacccggccggggacggacgtaccgggtcttcggtcgttacgttcgtggtcgacggaggtacgggtcttaaaggttttcgggaccttcgttacttacgttttcccttcccgtttggttaccgtttcgggtacggggtaacccgtaaccggggtaaccccttcggttcccgttaacccggtttcccgg

SEQ ID NO: 298601 - DNA, 639 bp, Homo sapiens
  misc_feature: GZ8MTXP01ARR7O.13.36.D03.1.454.CMB.2.raw
  modified_base (459)..(459): a, c, t, g, unknown or other
  misc_feature (459)..(459): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggctggttgaagcccgttcgggagaccctgtcccctcacgtgcgctgtctcgtgggttgggttcttcagttggttactacgtggagcgtggactcccggccacggtcccccgaggggaaggggctagggaggtggagttagggggaaatcgaagtcaagtaggtaggaacgcaaccaaacctaccaacccgtcccgtacgagaacgcccgaagtaccacccgatcgtacgagtaacgacaccgtaccaaacgaacctaggttccncccgtaggacgggttgacgtcttcgtgtcgacccggccgggacggacgacggcgttgcgttacttgtgtgcgaggtagtccttaagttttgacttcgttacgtactttccgttacccgtttgaccgtttcggtcggggccctaacggggtacccttacggtccgttaacccggtttcccg

SEQ ID NO: 298602 - DNA, 594 bp, Homo sapiens
  misc_feature: GZ8MTXP01AJVXS.13.36.D03.1.454.CMB.2.raw
  modified_base (377)..(377): a, c, t, g, unknown or other
  misc_feature (377)..(377): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcgaggggctgttgaagccttcggacgaccctgtcccctcacgtgcgctgtctcgtggtgggttcttcagtggttactactggagctggatccgccaggtcccccgaggggaaggggctggagtggagttggggaaatcaatcagtagtggaagcaccaacctaccaccgtccctacgagaacgcccgngtccaccatgtcagtacgacacgtaccaaacgaaccacgttcctccccgtaggacgggtgacgcttcgtgtcgacccggccggggcggaccgtaccgggcttgtcgttacgttcgtaggtcgcggagaggtctaaagttttcggacttcgttcgtactttccttcccgtttgacgttcgtcggggcctacgggtacccttacgtccgcccgttcccg

SEQ ID NO: 298603 - DNA, 660 bp, Homo sapiens
  misc_feature: GZ8MTXP01AZ0YZ.13.36.D03.1.454.CMB.2.raw
  modified_base (208)..(208): a, c, t, g, unknown or other
  misc_feature (208)..(208): n is a, c, g, or t
  modified_base (247)..(247): a, c, t, g, unknown or other
  misc_feature (247)..(247): n is a, c, g, or t
  modified_base (262)..(262): a, c, t, g, unknown or other
  misc_feature (262)..(262): n is a, c, g, or t
  modified_base (339)..(339): a, c, t, g, unknown or other
  misc_feature (339)..(339): n is a, c, g, or t
  modified_base (377)..(377): a, c, t, g, unknown or other
  misc_feature (377)..(377): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagccgtctcgggacccccggnagagtgtcaccatctcttgttctggaggcagtgaccaanagtcgggataattangcattctaggtatacaaacaactccccgaaggaacccggcccccagacctcctacactctaatacgacaaataaccngccggccctaccgacggggtccctggacccgtattccncgtcggcctacccgaaagtcctcggaccaccgtcacgtccctcccgtcggccctatccgtaagggtccgggtccttccccgggaccgacgtaactgggtaacgggtccttaggttaacttttaaactacgtttcggttcgtaacgttcggtttaggggtacttagggacctacggtccgtaagttaaacgttcggttttcggggtttcggaaccggggtaggttaaccgttaagttccgaacccgtccgtaacggtcgacgccccgtaagggcccttccccgg

SEQ ID NO: 298604 - DNA, 571 bp, Homo sapiens
  misc_feature: GZ8MTXP01B4GWG.13.36.D03.1.454.CMB.2.raw
  modified_base (365)..(365): a, c, t, g, unknown or other
  misc_feature (365)..(365): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtggcagctcccagatgggtcctgtcccaggtgcagctacagcaagtggggcgcaggggctgttgaagccttcggagaccctgtcccctcacgtgcgctgtctcgtggtgggttcttcagtggttactactggagctggatccgccagtccccagggagggctggagtggattggggaatcaatcatagtggaagcaccaacctaccaaccgtccctcgagaacgccgngtccaccatgtcagtagacacgtccaagaccagttcctccgtagagggtgacgctctgtgacccgccgggcggacacggctgtgtacttcgtgtgcgaggtcggctaagttttggacttcggttctacgtttccttccccgtttgttaccgtttcgtcgggggtccctagggggtaccccttaggtcccgttaacccggtttcccg

SEQ ID NO: 298605 - DNA, 607 bp, Homo sapiens
  misc_feature: GZ8MTXP01CBHYM.13.36.D03.1.454.CMB.2.raw
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
tcagtcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctcgggacccccgggnagagtgtcaccatctcttgtctggaggcagtgccaacagtcgggataattangcattctgtatcaacactcccaggaccgcccccagactcctcatctatagcaataaccagccgccctccgacggggtcctgacccgtattctctggcctccgaagtctcggctacctcacgccctcccgtggcccagtcgacggtcgggcctccggtccgacgatgacggctgtattattactgttccagtcgttgggatcgactacgtccctaaggtaaacgtttacggtttcgggggttttccgggacggggtaacgggggttaacccgttaacgggttaccggaaccccggtccccggtaacgggtcccgaaccggaccccgtaacgggttcccgttccccggg

SEQ ID NO: 298606 - DNA, 577 bp, Homo sapiens
  misc_feature: GZ8MTXP01BNSEV.13.36.D03.1.454.CMB.2.raw
  modified_base (375)..(375): a, c, t, g, unknown or other
  misc_feature (375)..(375): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagccaccctcggtgtcagtcggccccaggacagacggccaggattaccgtggtagggggaaacaacattgggaaagtaaagtgtgcactggtaccagcagaagccaggccaggcccctgtgctggtctctatgttgatagcgaccggccctcgagggactcccgtgacgcgacttcgtcgggctacccaactcgtcgggaaccncgggccactctcgaccatcgagtacgggtacgaagggccggggatcggacgggccgtacttattaccgtgtacgagggttggtagggggtattaggtagtcgtgagcagtgtgtagtcgggcggaggaaccaacgttggacccgttcgtacggtcacgcccgaggcctccgcccccgtcggtccacgtcgttccgttccccc

SEQ ID NO: 298607 - DNA, 667 bp, Homo sapiens
  misc_feature: GZ8MTXP01CBT02.13.36.D03.1.454.CMB.2.raw
  modified_base (397)..(397): a, c, t, g, unknown or other
  misc_feature (397)..(397): n is a, c, g, or t
  modified_base (444)..(444): a, c, t, g, unknown or other
  misc_feature (444)..(444): n is a, c, g, or t
tcagtcacgtactacacgaccggtgctcgatttagctgcgtcacgatctctcttggggtcacatgggaagtgctttctgagagtcatggacctcctgcacaagaacatgaaacacctgtggttctgcctcctcctggtgcagctcccagatgggtcctgtcccaggtgcagctacagcaagtggggcgcgagggcttggttagaacgtcccgtttacgggacgtaccccgtgtcccctcgacggtgccgtctgtctcgtgggttggttcttcgagttggttactacgtggagtctggactcccgccacgtccccgaggggaagggcgtggagtggagttaggggaaatcaatcagtaggaggaagcaacctaaccaccacccgtcacgagaacgcgngtccaccgatcgtcagtagacctacgtacgaaacgacctacgttccncccgtaggtgggtacacgtctcgtaggtccgaacccggccggggtacgggaaccgtccggcgttacggtcgttaccgttcgtagggtcggacggtaaggtcggtacgtttaaagttttcgggaccttcggttaccttacgtttcccttccgttttacggccgttttcgggccggggtaacccgaacgggttaccccgttacgttccgttaacccggtttcccg

SEQ ID NO: 298608 - DNA, 600 bp, Homo sapiens
  misc_feature: GZ8MTXP01DD5WA.13.36.D03.1.454.CMB.2.raw
  modified_base (291)..(291): a, c, t, g, unknown or other
  misc_feature (291)..(291): n is a, c, g, or t
  modified_base (449)..(449): a, c, t, g, unknown or other
  misc_feature (449)..(449): n is a, c, g, or t
  modified_base (478)..(478): a, c, t, g, unknown or other
  misc_feature (478)..(478): n is a, c, g, or t
tcagtcacgtactacacgaccggtgctcgatttagctgcgtcacgatctctcttggggagtctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggacagacgccaggattaccgtgtaggggaaacaacagttaggaaagtaaaagtgtgacagtggtaccagcagagcaggccaggccctgcgntggtctctatgttgatacgccgaccggccctacgagggactcccgagagcgtacttccgtcggctaccaacgtcgtagggaaccacggcctacgtctacgaaccataccgaggtacgggacggaagggtccggggataggacgaccgtattagtacgngtcgtagggtgtggggacttaggtatcgngagcgagttggtggtacgtcgggacggaacgggaaacctaaacgttcggtaacccgttcgtaacggcacgcccgaaggtcccgtccgtcccctgggtaccttccgtcgttcccggtcccccg
